United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 47

SEQ ID NO: 88191 - DNA, 1680 bp, Artificial Sequence
  Description of Artificial Sequence: Synthetic coding sequence
atggccgagaccgtgtggagcaccgacaccggcgaggccgtgtacagaagcagagaccccgtgagaaacctgagactgagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcgagagactgagcagattcggcctgagaaccgagaccaccggcaccgtgaccttcagactgcactgcctgcagcagagcagagccttcatggagagcagcagcctgcagaagagaatgagaagcgtgctggacagactggagggcttcagccagcagagcagcatccacaacgtgctggaggccttcagaagagccagaagaagaatgcaggaggccagagagagcctgccccaggacctggtgagccccagcggcaccctggtgagctag

SEQ ID NO: 88192 - DNA, 1563 bp, Artificial Sequence
  Description of Artificial Sequence: Synthetic coding sequence
atggccgagaccgtgtggagcaccgacaccggcgaggccgtgtacagaagcagagaccccgtgagaaacctgagactgagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcctgagcagcagcaagaccaaggagggcagaaaggtggacggcgagagagtgctgaacccccagcccgtgagcctgagcctgttccccggcaagccccacagcaccgcctggggcctgctgagactgagatacgagctgttcctgagcaagtag

SEQ ID NO: 88193 - DNA, 1650 bp, Artificial Sequence
  Description of Artificial Sequence: Synthetic coding sequence
atggccgtgcccgtgagcagcttcgcccagagaaccagaagcagattcagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcgagagactgagcagattcggcctgagaaccgagaccaccggcaccgtgaccttcagactgcactgcctgcagcagagcagagccttcatggagagcagcagcctgcagaagagaatgagaagcgtgctggacagactggagggcttcagccagcagagcagcatccacaacgtgctggaggccttcagaagagccagaagaagaatgcaggaggccagagagagcctgccccaggacctggtgagccccagcggcaccctggtgagctag

SEQ ID NO: 88194 - DNA, 1071 bp, Artificial Sequence
  Description of Artificial Sequence: Synthetic coding sequence
atgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcgagagactgagcagattcggcctgagaaccgagaccaccggcaccgtgaccttcagactgcactgcctgcagcagagcagagccttcatggagagcagcagcctgcagaagagaatgagaagcgtgctggacagactggagggcttcagccagcagagcagcatccacaacgtgctggaggccttcagaagagccagaagaagaatgcaggaggccagagagagcctgccccaggacctggtgagccccagcggcaccctggtgagctag

SEQ ID NO: 88195 - DNA, 4746 bp, Artificial Sequence
  Description of Artificial Sequence: Synthetic coding sequence
atgaaggcccagggcgagaccgaggagagcgagaagctgagcaagatgagcagcctgctggagagactgcacgccaagttcaaccagaacagaccctggagcgagaccatcaagctggtgagacaggtgatggagaagagagtggtgatgagcagcggcggccaccagcacctggtgagctgcctggagaccctgcagaaggccctgaaggtgaccagcctgcccgccatgaccgacagactggagagcatcgccagacagaacggcctgggcagccacctgagcgccagcggcaccgagtgctacatcaccagcgacatgttctacgtggaggtgcagctggaccccgccggccagctgtgcgacgtgaaggtggcccaccacggcgagaaccccgtgagctgccccgagctggtgcagcagctgagagagaagaacttcgacgagttcagcaagcacctgaagggcctggtgaacctgtacaacctgcccggcgacaacaagctgaagaccaagatgtacctggccctgcagagcctggagcaggacctgagcaagatggccatcatgtactggaaggccaccaacgccggccccctggacaagatcctgcacggcagcgtgggctacctgacccccagaagcggcggccacctgatgaacctgaagtactacgtgagccccagcgacctgctggacgacaagaccgccagccccatcatcctgcacgagaacaacgtgagcagaagcctgggcatgaacgccagcgtgaccatcgagggcaccagcgccgtgtacaagctgcccatcgcccccctgatcatgggcagccaccccgtggacaacaagtggacccccagcttcagcagcatcaccagcgccaacagcgtggacctgcccgcctgcttcttcctgaagttcccccagcccatccccgtgagcagagccttcgtgcagaagctgcagaactgcaccggcatccccctgttcgagacccagcccacctacgcccccctgtacgagctgatcacccagttcgagctgagcaaggaccccgaccccatccccctgaaccacaacatgagattctacgccgccctgcccggccagcagcactgctacttcctgaacaaggacgcccccctgcccgacggcagaagcctgcagggcaccctggtgagcaagatcaccttccagcaccccggcagagtgcccctgatcctgaacctgatcagacaccaggtggcctacaacaccctgatcggcagctgcgtgaagagaaccatcctgaaggaggacagccccggcctgctgcagttcgaggtgtgccccctgagcgagagcagattcagcgtgagcttccagcaccccgtgaacgacagcctggtgtgcgtggtgatggacgtgcaggacagcacccacgtgagctgcaagctgtacaagggcctgagcgacgccctgatctgcaccgacgacttcatcgccaaggtggtgcagagatgcatgagcatccccgtgaccatgagagccatcagaagaaaggccgagaccatccaggccgacacccccgccctgagcctgatcgccgagaccgtggaggacatggtgaagaagaacctgccccccgccagcagccccggctacggcatgaccaccggcaacaaccccatgagcggcaccaccacccccaccaacaccttccccggcggccccatcaccaccctgttcaacatgagcatgagcatcaaggacagacacgagagcgtgggccacggcgaggacttcagcaaggtgagccagaaccccatcctgaccagcctgctgcagatcaccggcaacggcggcagcaccatcggcagcagccccacccccccccaccacacccccccccccgtgagcagcatggccggcaacaccaagaaccaccccatgctgatgaacctgctgaaggacaaccccgcccaggacttcagcaccctgtacggcagcagccccctggagagacagaacagcagcagcggcagccccagaatggagatctgcagcggcagcaacaagaccaagaagaagaagagcagcagactgccccccgagaagcccaagcaccagaccgaggacgacttccagagagagctgttcagcatggacgtggacagccagaaccccatcttcgacgtgaacatgaccgccgacaccctggacaccccccacatcacccccgcccccagccagtgcagcaccccccccaccacctacccccagcccgtgccccacccccagcccagcatccagagaatggtgagactgagcagcagcgacagcatcggccccgacgtgaccgacatcctgagcgacatcgccgaggaggccagcaagctgcccagcaccagcgacgactgccccgccatcggcacccccctgagagacagcagcagcagcggccacagccagagcaccctgttcgacagcgacgtgttccagaccaacaacaacgagaacccctacaccgaccccgccgacctgatcgccgacgccgccggcagccccagcagcgacagccccaccaaccacttcttccacgacggcgtggacttcaaccccgacctgctgaacagccagagccagagcggcttcggcgaggagtacttcgacgagagcagccagagcggcgacaacgacgacttcaagggcttcgccagccaggccctgaacaccctgggcgtgcccatgctgggcggcgacaacggcgagaccaagttcaagggcaacaaccaggccgacaccgtggacttcagcatcatcagcgtggccggcaaggccctggcccccgccgacctgatggagcaccacagcggcagccagggccccctgctgaccaccggcgacctgggcaaggagaagacccagaagagagtgaaggagggcaacggcaccagcaacagcaccctgagcggccccggcctggacagcaagcccggcaagagaagcagaacccccagcaacgacggcaagagcaaggacaagccccccaagagaaagaaggccgacaccgagggcaagagccccagccacagcagcagcaacagacccttcaccccccccaccagcaccggcggcagcaagagccccggcagcgccggcagaagccagaccccccccggcgtggccaccccccccatccccaagatcaccatccagatccccaagggcaccgtgatggtgggcaagcccagcagccacagccagtacaccagcagcggcagcgtgagcagcagcggcagcaagagccaccacagccacagcagcagcagcagcagcagcgccagcaccagcggcaagatgaagagcagcaagagcgagggcagcagcagcagcaagctgagcagcagcatgtacagcagccagggcagcagcggcagcagccagagcaagaacagcagccagagcggcggcaagcccggcagcagccccatcaccaagcacggcctgagcagcggcagcagcagcaccaagatgaagccccagggcaagcccagcagcctgatgaaccccagcctgagcaagcccaacatcagccccagccacagcagaccccccggcggcagcgacaagctggccagccccatgaagcccgtgcccggcaccccccccagcagcaaggccaagagccccatcagcagcggcagcggcggcagccacatgagcggcaccagcagcagcagcggcatgaagagcagcagcggcctgggcagcagcggcagcctgagccagaagaccccccccagcagcaacagctgcaccgccagcagcagcagcttcagcagcagcggcagcagcatgagcagcagccagaaccagcacggcagcagcaagggcaagagccccagcagaaacaagaagcccagcctgaccgccgtgatcgacaagctgaagcacggcgtggtgaccagcggccccggcggcgaggaccccctggacggccagatgggcgtgagcaccaacagcagcagccaccccatgagcagcaagcacaacatgagcggcggcgagttccagggcaagagagagaagagcgacaaggacaagagcaaggtgagcaccagcggcagcagcgtggacagcagcaagaagaccagcgagagcaagaacgtgggcagcaccggcgtggccaagatcatcatcagcaagcacgacggcggcagccccagcatcaaggccaaggtgaccctgcagaagcccggcgagagcagcggcgagggcctgagaccccagatggccagcagcaagaactacggcagccccctgatcagcggcagcacccccaagcacgagagaggcagccccagccacagcaagagccccgcctacaccccccagaacctggacagcgagagcgagagcggcagcagcatcgccgagaagagctaccagaacagccccagcagcgacgacggcatcagacccctgcccgagtacagcaccgagaagcacaagaagcacaagaaggagaagaagaaggtgaaggacaaggacagagacagagacagagacaaggacagagacaagaagaagagccacagcatcaagcccgagagctggagcaagagccccatcagcagcgaccagagcctgagcatgaccagcaacaccatcctgagcgccgacagacccagcagactgagccccgacttcatgatcggcgaggaggacgacgacctgatggacgtggccctgatcggcaactag

SEQ ID NO: 88196 - DNA, 1671 bp, Artificial Sequence
  Description of Artificial Sequence: Synthetic coding sequence
atgaaggcccagggcgagaccgaggagagcgagaagctgagcaagatgagcagcctgctggagagactgcacgccaagttcaaccagaacagaccctggagcgagaccatcaagctggtgagacaggtgatggagaagagagtggtgatgagcagcggcggccaccagcacctggtgagctgcctggagaccctgcagaaggccctgaaggtgaccagcctgcccgccatgaccgacagactggagagcatcgccagacagaacggcctgggcagccacctgagcgccagcggcaccgagtgctacatcaccagcgacatgttctacgtggaggtgcagctggaccccgccggccagctgtgcgacgtgaaggtggcccaccacggcgagaaccccgtgagctgccccgagctggtgcagcagctgagagagaagaacttcgacgagttcagcaagcacctgaagggcctggtgaacctgtacaacctgcccggcgacaacaagctgaagaccaagatgtacctggccctgcagagcctggagcaggacctgagcaagatggccatcatgtactggaaggccaccaacgccggccccctggacaagatcctgcacggcagcgtgggctacctgacccccagaagcggcggccacctgatgaacctgaagtactacgtgagccccagcgacctgctggacgacaagaccgccagccccatcatcctgcacgagaacaacgtgagcagaagcctgggcatgaacgccagcgtgaccatcgagggcaccagcgccgtgtacaagctgcccatcgcccccctgatcatgggcagccaccccgtggacaacaagtggacccccagcttcagcagcatcaccagcgccaacagcgtggacctgcccgcctgcttcttcctgaagttcccccagcccatccccgtgagcagagccttcgtgcagaagctgcagaactgcaccggcatccccctgttcgagacccagcccacctacgcccccctgtacgagctgatcacccagttcgagctgagcaaggaccccgaccccatccccctgaaccacaacatgagattctacgccgccctgcccggccagcagcactgctacttcctgaacaaggacgcccccctgcccgacggcagaagcctgcagggcaccctggtgagcaagatcaccttccagcaccccggcagagtgcccctgatcctgaacctgatcagacaccaggtggcctacaacaccctgatcggcagctgcgtgaagagaaccatcctgaaggaggacagccccggcctgctgcagttcgaggtgtgccccctgagcgagagcagattcagcgtgagcttccagcaccccgtgaacgacagcctggtgtgcgtggtgatggacgtgcaggacagcacccacgtgagctgcaagctgtacaagggcctgagcgacgccctgatctgcaccgacgacttcatcgccaaggtggtgcagagatgcatgagcatccccgtgaccatgagagccatcagaagaaaggccgagaccatccaggccgacacccccgccctgagcctgatcgccgagaccgtggaggacatggtgaagaagaacctgccccccgccagcagccccggcagcaagaaccccgagctgggcagcggctag

SEQ ID NO: 88197 - DNA, 408 bp, Artificial Sequence
  Description of Artificial Sequence: Synthetic coding sequence
atggccgagaagttcgaccacctggaggagcacctggagaagttcgtggagaacatcagacagctgggcatcatcgtgagcgacttccagcccagcagccaggccggcctgaaccagaagctgaacttcatcgtgaccggcctgcaggacatcgacaagtgcagacagcagctgcacgacatcaccgtgcccctggaggtgttcgagtacatcgaccagggcagaaacccccagctgtacaccaaggagtgcctggagagagccctggccaagaacgagcaggtgaagggcaagatcgacaccatgaagaagttcaagagcctgctgatccaggagctgagcaaggtgttccccgaggacatggccaagtacagaagcatcagaggcgaggaccacccccccagctag

SEQ ID NO: 88198 - DNA, 354 bp, Artificial Sequence
  Description of Artificial Sequence: Synthetic coding sequence
atggccacctacagcctggccaacgagagactgagagccctggaggacatcgagagagagatcggcgccatcctgcagaacgccggcaccgtgatcctggagctgagcaaggagaagaccaacgagagactgctggacagacaggccgccgccttcaccgccagcgtgcagcacgtggaggccgagctgagcgcccagatcagatacctgacccaggtggccaccggccagccccacgagggcagcagctacagcagcagaaaggactgccagatggccctgaagagagtggactacgccagactgaagctgagcgacgtggccagaacctgcgagcagatgctggagaactag

SEQ ID NO: 88199 - DNA, 6543 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcaggccaagatccagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88200 - DNA, 6534 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88201 - DNA, 6531 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88202 - DNA, 393 bp, Artificial Sequence
  Description of Artificial Sequence: Synthetic coding sequence
tgaacccccaacagaagaagaaagaagcagctgaacgccgccttcctgccccaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctactag

SEQ ID NO: 88203 - DNA, 6384 bp, Artificial Sequence
  Description of Artificial Sequence: Synthetic coding sequence
gaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagctgagccccagcagcctgcagggctacaccccctacgtgagccacgtgggcctgcagcagcacaccggccccgccgaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88204 - DNA, 2778 bp, Artificial Sequence
  Description of Artificial Sequence: Synthetic coding sequence
ggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcaggccaagatccagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88205 - DNA, 756 bp, Artificial Sequence
  Description of Artificial Sequence: Synthetic coding sequence
tgagagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagggctacaccccctacgtgagccacgtgggcctgcagcagcacaccggccccgccgaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagtag

SEQ ID NO: 88206 - DNA, 6003 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagggctacaccccctacgtgagccacgtgggcctgcagcagcacaccggccccgccgaccccaccagacacctgcagcagagacccagcggctacgtgcaccagcaggcccccacctacggccacggcctgaccagcacccagagcttccacaccagacactgcagcagacacccctag

SEQ ID NO: 88207 - DNA, 2271 bp, Artificial Sequence
  Description of Artificial Sequence: Synthetic coding sequence
atggccgccttcggcctgctgagctacgagcagagacccctgaagagacccagactgggcccccccgacgtgtacccccaggaccccaagcagaaggaggacgagctgaccgccgtgaacgtgaagcagggcttcaacaaccagcccgccttcaccggcgacgagcacggcagcgccagaaacatcgtgatcaaccccagcaagatcggcgcctacttcagcagcatcctggccgagaagctgaagctgaacaccttccaggacaccggcaagaagaagccccaggtgaacgccaaggacaactactggctggtgaccgccagaagccagagcgccatccacagctggttcagcgacctggccggcaacaagcccctgagcatcctggccaagaaggtgcccatcctgagcaagaaggaggacgtgttcgcctacctggccaagtacagcgtgcccatggtgagagccacctggctgatcaagatgacctgcgcctactacagcgccatcagcgaggccaagatcaagaagagacaggcccccgaccccaacctggagtggacccagatcagcaccagatacctgagagagcagctggccaagatcagcgacttctaccacatggccagcagcaccggcgacggccccgtgcccgtgccccccgaggtggagcaggccatgaagcagtgggagtacaacgagaagctggccttccacatgttccaggagggcatgctggagaagcacgagtacctgacctggatcctggacgtgctggagaagatcagacccatggacgacgacctgctgaagctgctgctgcccctgatgctgcagtacagcgacgagttcgtgcagagcgcctacctgagcagaagactggcctacttctgcgccagaagactgagcctgctgctgagcgacagccccaacctgctggccgcccacagcccccacatgatgatcggccccaacaacagcagcatcggcgcccccagccccggcccccccggccccggcatgagccccgtgcagctggccttcagcgacttcctgagctgcgcccagcacggccccctggtgtacggcctgagctgcatgctgcagaccgtgaccctgtgctgccccagcgccctggtgtggaactacagcaccaacgagaacaagagcgccaaccccggcagccccctggacctgctgcaggtggcccccagcagcctgcccatgcccggcggcaacaccgccttcaaccagcaggtgagagccagaatctacgaggtggagcagcagatcaagcagagaggcagagccgtggaggtgagatggagcttcgacaagtgccaggagagcaccgccggcgtgaccatcagcagagtgctgcacaccctggaggtgctggacagacactgcttcgacagaaccgacagcagcaacagcatggagaccctgtaccacaagatcttctgggccaaccagaacaaggacaaccaggaggtggcccccaacgacgaggccgtggtgaccctgctgtgcgagtgggccgtgagctgcaagagaagcggcaagcacagagccatggccgtggccaagctgctggagaagagacaggccgagatcgaggccgagagatgcggcgagagcgaggtgctggacgagaaggagagcatcagcagcagcagcctggccggcagcagcctgcccgtgttccagaacgtgctgctgagattcctggacacccaggcccccagcctgagcgaccccaacagcgagtgcgagaaggtggagttcgtgaacctggtgctgctgttctgcgagttcatcagacacgacgtgttcagccacgacgcctacatgtgcaccctgatcagcagaggcgacctgagcgtgaccgccagcaccagacccagaagccccgtgggcgagaacgccgacgagcactacagcaaggaccacgacgtgaagatggaggagcagagcatcatggcccacatgggcatcgacagcggcaccaccaacatcttcgacgaggtggacaagagcgacttcaagaccgacttcggcagcgagttccccatcttcagccccatgcccggcgagagctgcgagaacgccaacaccagcctgggcagaagaatgagcgtgaactgcgagaagctggtgaagagagagaagcccagagagctgatcttccccagcaactacgacctgctgagacacctgcagtacgccacccacttccccatccccctggtgagccactgcttcagctag

SEQ ID NO: 88208 - DNA, 2166 bp, Artificial Sequence
  Description of Artificial Sequence: Synthetic coding sequence
atggccgccttcggcctgctgagctacgagcagagacccctgaagagacccagactgggcccccccgacgtgtacccccaggaccccaagcagaaggaggacgagctgaccgccgtgaacgtgaagcagggcttcaacaaccagcccgccttcaccggcgacgagcacggcagcgccagaaacatcgtgatcaaccccagcaagatcggcgcctacttcagcagcatcctggccgagaagctgaagctgaacaccttccaggacaccggcaagaagaagccccaggtgaacgccaaggacaactactggctggtgaccgccagaagccagagcgccatccacagctggttcagcgacctggccggcaacaagcccctgagcatcctggccaagaaggtgcccatcctgagcaagaaggaggacgtgttcgcctacctggccaagtacagcgtgcccatggtgagagccacctggctgatcaagatgacctgcgcctactacagcgccatcagcgaggccaagatcaagaagagacaggcccccgaccccaacctggagtggacccagatcagcaccagatacctgagagagcagctggccaagatcagcgacttctaccacatggccagcagcaccggcgacggccccgtgcccgtgccccccgaggtggagcaggccatgaagcagtgggagtacaacgagaagctggccttccacatgttccaggagggcatgctggagaagcacgagtacctgacctggatcctggacgtgctggagaagatcagacccatggacgacgacctgctgaagctgctgctgcccctgatgctgcagtacagcgacgagttcgtgcagagcgcctacctgagcagaagactggcctacttctgcgccagaagactgagcctgctgctgagcgacagccccaacctgctggccgcccacagcccccacatgatgatcggccccaacaacagcagcatcggcgcccccagccccggcccccccggccccggcatgagccccgtgcagctggccttcagcgacttcctgagctgcgcccagcacggccccctggtgtacggcctgagctgcatgctgcagaccgtgaccctgtgctgccccagcgccctggtgtggaactacagcaccaacgagaacaagagcgccaaccccggcagccccctggacctgctgcaggtggcccccagcagcctgcccatgcccggcggcaacaccgccttcaaccagcaggtgagagccagaatctacgaggtggagcagcagatcaagcagagaggcagagccgtggaggtgagatggagcttcgacaagtgccaggagagcaccgccggcgtgaccatcagcagagtgctgcacaccctggaggtgctggacagacactgcttcgacagaaccgacagcagcaacagcatggagaccctgtaccacaagatcttctgggccaaccagaacaaggacaaccaggaggtggcccccaacgacgaggccgtggtgaccctgctgtgcgagtgggccgtgagctgcaagagaagcggcaagcacagagccatggccgtggccaagctgctggagaagagacaggccgagatcgaggccgagagatgcggcgagagcgaggtgctggacgagaaggagagcatcagcagcagcagcctggccggcagcagcctgcccgtgttccagaacgtgctgctgagattcctggacacccaggcccccagcctgagcgaccccaacagcgagtgcgagaaggtggagttcgtgaacctggtgctgctgttctgcgagttcatcagacacgacgtgttcagccacgacgcctacatgtgcaccctgatcagcagaggcgacctgagcgtgaccgccagcaccagacccagaagccccgtgggcgagaacgccgacgagcactacagcaaggaccacgacgtgaagatggagatcttcagccccatgcccggcgagagctgcgagaacgccaacaccagcctgggcagaagaatgagcgtgaactgcgagaagctggtgaagagagagaagcccagagagctgatcttccccagcaactacgacctgctgagacacctgcagtacgccacccacttccccatccccctggtgagccactgcttcagctag

SEQ ID NO: 88209 - DNA, 6438 bp, Artificial Sequence
  Description of Artificial Sequence: Synthetic coding sequence
atggccgccttcggcctgctgagctacgagcagagacccctgaagagacccagactgggcccccccgacgtgtacccccaggaccccaagcagaaggaggacgagctgaccgccgtgaacgtgaagcagggcttcaacaaccagcccgccttcaccggcgacgagcacggcagcgccagaaacatcgtgatcaaccccagcaagatcggcgcctacttcagcagcatcctggccgagaagctgaagctgaacaccttccaggacaccggcaagaagaagccccaggtgaacgccaaggacaactactggctggtgaccgccagaagccagagcgccatccacagctggttcagcgacctggccggcaacaagcccctgagcatcctggccaagaaggtgcccatcctgagcaagaaggaggacgtgttcgcctacctggccaagtacagcgtgcccatggtgagagccacctggctgatcaagatgacctgcgcctactacagcgccatcagcgaggccaagatcaagaagagacaggcccccgaccccaacctggagtggacccagatcagcaccagatacctgagagagcagctggccaagatcagcgacttctaccacatggccagcagcaccggcgacggccccgtgcccgtgccccccgaggtggagcaggccatgaagcagtgggagtacaacgagaagctggccttccacatgttccaggagggcatgctggagaagcacgagtacctgacctggatcctggacgtgctggagaagatcagacccatggacgacgacctgctgaagctgctgctgcccctgatgctgcagtacagcgacgagttcgtgcagagcgcctacctgagcagaagactggcctacttctgcgccagaagactgagcctgctgctgagcgacagccccaacctgctggccgcccacagcccccacatgatgatcggccccaacaacagcagcatcggcgcccccagccccggcccccccggccccggcatgagccccgtgcagctggccttcagcgacttcctgagctgcgcccagcacggccccctggtgtacggcctgagctgcatgctgcagaccgtgaccctgtgctgccccagcgccctggtgtggaactacagcaccaacgagaacaagagcgccaaccccggcagccccctggacctgctgcaggtggcccccagcagcctgcccatgcccggcggcaacaccgccttcaaccagcaggtgagagccagaatctacgaggtggagcagcagatcaagcagagaggcagagccgtggaggtgagatggagcttcgacaagtgccaggagagcaccgccggcgtgaccatcagcagagtgctgcacaccctggaggtgctggacagacactgcttcgacagaaccgacagcagcaacagcatggagaccctgtaccacaagatcttctgggccaaccagaacaaggacaaccaggaggtggcccccaacgacgaggccgtggtgaccctgctgtgcgagtgggccgtgagctgcaagagaagcggcaagcacagagccatggccgtggccaagctgctggagaagagacaggccgagatcgaggccgagagatgcggcgagagcgaggtgctggacgagaaggagagcatcagcagcagcagcctggccggcagcagcctgcccgtgttccagaacgtgctgctgagattcctggacacccaggcccccagcctgagcgaccccaacagcgagtgcgagaaggtggagttcgtgaacctggtgctgctgttctgcgagttcatcagacacgacgtgttcagccacgacgcctacatgtgcaccctgatcagcagaggcgacctgagcgtgaccgccagcaccagacccagaagccccgtgggcgagaacgccgacgagcactacagcaaggaccacgacgtgaagatggagatcttcagccccatgcccggcgagagctgcgagaacgccaacaccagcctgggcagaagaatgagcgtgaactgcgagaagctggtgaagagagagaagcccagagagctgatcttccccagcaactacgacctgctgagacacctgcagtacgccacccacttccccatccccctggacgagagcagcagccacgagtgcaaccagagaaccatcctgctgtacggcgtgggcaaggagagagacgaggccagacaccagctgaagaagatcaccaaggacatcctgaagatcctgaacaagaagagcaccaccgagaccggcgtgggcgacgagggccagaaggccagaaagaacaagcaggagaccttccccaccctggagaccgtgttcaccaagctgcagctgctgagctacttcgaccagcaccaggtgaccagccagatcagcaacaacgtgctggagcagatcaccagcttcgccagcggcaccagctaccacctgcccctggcccaccacatccagctgatcttcgacctgatggagcccgccctgaacatcaacggcctgatcgacttcgccatccagctgctgaacgagctgagcgtggtggaggccgagctgctgctgaagagcagcagcctggccggcagctacaccaccggcctgtgcgtgtgcatcgtggccgtgctgagaagataccacagctgcctgatcctgaaccccgaccagaccgcccaggtgttcgagggcctgtgcggcgtggtgaagcacgtggtgaaccccagcgagtgcagcagccccgagagatgcatcctggcctacctgtacgacctgtacgtgagctgcagccacctgagaagcaagttcggcgacctgttcagcagcgcctgcagcaaggtgaagcagaccatctacaacaacgtgatgcccgccaacagcaacctgagatgggaccccgacttcatgatggacttcatcgagaaccccagcgccagaagcatcaactacagcatgctgggcaagatcctgagcgacaacgccgccaacagatacagcttcgtgtgcaacaccctgatgaacgtgtgcatgggccaccaggacgccggcagaatcaacgacatcgccaacttcagcagcgagctgaccgcctgctgcaccgtgctgagcagcgagtggctgggcgtgctgaaggccctgtgctgcagcagcaaccacgtgtggggcttcaacgacgtgctgtgcaccgtggacgtgagcgacctgagcttccacgacagcctggccaccttcatcgccatcctgatcgccagacagtgcttcagcctggaggacgtggtgcagcacgtggccctgcccagcctgctggccgccgcctgcggcgacgccgacgccgagcccggcgccagaatgacctgcagactgctgctgcacctgttcagagccccccaggcctgcttcctgccccaggccaccggcaagcccttccccggcatcagaagcagctgcgacagacacctgctggccgccgcccacaacagcatcgaggtgggcgccgtgttcgccgtgctgaaggccatcatgatgctgggcgacgccaagatcggcaacaacagcgtgagcagcctgaagaacgacgacttcaccatgagaggcctgagatgcgacggcaacgccgacgacatctggaccgccagccagaaccccaagagctgcggcaagagcatcagcatcgagaccgccaacctgagagagtacgccagatacgtgctgagaaccatctgccagcaggagtgggtgggcgagcactgcctgaaggagcccgagagactgtgcaccgacaaggagctgatcctggaccccgtgctgagcaacatgcaggcccagaagctgctgcagctgatctgctacccccacggcatcaaggagtgcaccgagggcgacaacctgcagagacagcacatcaagagaatcctgcagaacctggagcagtggaccctgagacagagctggctggagctgcagctgatgatcaagcagtgcctgaaggaccccggcagcggcagcgtggccgagatgaacaacctgctggacaacatcgccaaggccaccatcgaggtgttccagcagagcgccgacctgaacaacagcagcaacagcggcatgagcctgttcaaccccaacagcatcggcagcgccgacaccagcagcaccagacagaacggcatcaagaccttcctgagcagcagcgagagaagaggcgtgtggctggtggcccccctgatcgccagactgcccaccagcgtgcagggcagagtgctgaaggccgccggcgaggagctggagaagggccagcacctgggcagcagcagcaagaaggagagagacagacagaagcagaagagcatgagcctgctgagccagcagcccttcctgagcctggtgctgacctgcctgaagggccaggacgagcagagagagggcctgctgaccagcctgcagaaccaggtgaaccagatcctgagcaactggagagaggagagataccaggacgacatcaaggccagacagatgatgcacgaggccctgcagctgagactgaacctggtgggcggcatgttcgacaccgtgcagagaagcacccagtggaccaccgactgggccctgctgctgctgcagatcatcaccagcggcaccgtggacatgcacaccaacaacgagctgttcaccaccgtgctggacatgctgggcgtgctgatcaacggcaccctggccagcgacctgagcaacgccagccccggcggcagcgaggagaacaagagagcctacatgaacctggtgaagaagctgaagaaggagctgggcgacaagagaagcgagagcatcgacaaggtgagacagctgctgcccctgcccaagcagacctgcgacgtgatcacctgcgagcccatgggcagcctgatcgacaccaagggcaacaagatcgccggcttcgacagcatcgacaagaagcagggcctgcaggtgagcaccaagcagaaggtgagcccctgggacctgttcgagggccagaagaaccccgcccccctgagctgggcctggttcggcaccgtgagagtggacagaagagtgatcaagtacgaggagcagcaccacctgctgctgtaccacacccaccccatgcccaagcccagaagctactacctgcagcccctgcccctgccccccgaggaggaggaggaggagcccaccagccccgtgagccaggagcccgagagaaagagcgccgagctgagcgaccagggcaagaccaccaccgacgaggagaagaagaccaagggcagaaagagaaagaccaagagcagcagcagagtggacgagtacccccagagcaacatctacagagtgccccccaactacagccccatcagcagccagatgatgcaccacccccagagcaccctgtggggctacaacctggtgggccagccccagcagcccggcttcttcctgcagaaccagagcctgacccccggcggcagcagactggaccccgccggcagcttcgtgcccaccaacaccaagcaggccctgagcaacatgctgcagagaagaagcggcgccatgatgcagccccccagcctgcacgccatcaccagccagcagcagctgatccagatgaagctgctgcagcagcagcagcagcagagactgctgagacaggcccagaccagacccttccagcagggccagcccggcgaccaggccgccctgttcgccgcccaggccagacccagcccccagctgccccagtaccccggcctgcagcaggcccagaccatgccccagggctacaccatgtacggcacccagatgcccctgcagcagaccagccagcagcaggccggcagcgtggtgctgagccccagctacaacagcagagcctaccccgccgcccacagcaaccccgtgctgatggagagactgagacagatccagcagcagcccagcggctacgtgcagcagcaggccagcccctacctgcagcccctgaccggcagccagagactgaaccaccaggccctgcagcagagccccctggtgggcggcggcatcgacgccgtgctgaccagcgcccaccccaacctgcccagcgtgcccctgccccaggaccccatgagacccagacagccccaggtgagacagcagcagagactgctgcagatgcagcagccccagcagccccagccccagcagcccccccagccccagcagagcagccagagccagagccagaccctgggcctgcaggccatgcagccccagcagcccctgttccccagacagggcctgcagcagacccagcagcagcagcagaccgccgccctggtgagacagctgcagaagcagctgagcagcaaccagccccagcagggcgtgaccccctacggccaccccagccacttctag

SEQ ID NO: 88210 - DNA, 6522 bp, Artificial Sequence
  Description of Artificial Sequence: Synthetic coding sequence
atgagcgccagcttcgtgcccaacggcgccagcctggaggactgccactgcaacctgttctgcctggccgacctgaccggcatcaagtggaagaagtacgtgtggcagggccccaccagcgcccccatcctgttccccgtgaccgaggaggaccccatcctgagcagcttcagcagatgcctgaaggccgacgtgctgggcgtgtggagaagagaccagagacccggcagaagagagctgtggatcttctggtggggcgaggaccccgtgctgctgaccctgttcaccatgacctaccagaagaagaagatggagtgcggcagaatggacttccccatgaacgccgtgctgtgcttccaggccgtgcacaacctgctggagagatgcctgatgaacagaaacttcgtgagaatcggcaagtggttcgtgaagccctacgagaaggacgagaagcccatcaacaagagcgagcacctgagctgcagcttcaccttcttcctgcacggcgacagcaacgtgtgcaccagcgtggagatcaaccagcaccagcccgtgtacctgctgagcgaggagcacatcaccctggcccagcagagcaacagccccttccaggtgatcctgtgccccttcggcctgaacggcaccctgaccggccaggccttcaagatgagcgacagcgccaccaagaagctgatcggcgagtggaagcagttctaccccatcagctgctgcctgaaggagatgagcgaggagaagcaggaggacatggactgggaggacgacagcctggccgccgtggaggtgctggtggccggcgtgagaatgatctaccccgcctgcttcgtgctggtgccccagagcgacatccccacccccagccccgtgggcagcacccactgcagcagcagctgcctgggcgtgcaccaggtgcccgccagcaccagagaccccgccatgagcagcgtgaccctgaccccccccaccagccccgaggaggtgcagaccgtggacccccagagcgtgcagaagtgggtgaagttcagcagcgtgagcgacggcttcaacagcgacagcaccagccaccacggcggcaagatccccagaaagctggccaaccacgtggtggacagagtgtggcaggagtgcaacatgaacagagcccagaacaagagaaagtacagcgccagcagcggcggcctgtgcgaggaggccaccgccgccaaggtggccagctgggacttcgtggaggccacccagagaaccaactgcagctgcctgagacacaagaacctgaagagcagaaacgccggccagcagggccaggcccccagcctgggccagcagcagcagatcctgcccaagcacaagaccaacgagaagcaggagaagagcgagaagccccagaagagacccctgacccccttccaccacagagtgagcgtgagcgacgacgtgggcatggacgccgacagcgccagccagagactggtgatcagcgcccccgacagccaggtgagattcagcaacatcagaaccaacgacgtggccaagaccccccagatgcacggcaccgagatggccaacagcccccagcccccccccctgagcccccacccctgcgacgtggtggacgagggcgtgaccaagacccccagcaccccccagagccagcacttctaccagatgcccacccccgaccccctggtgcccagcaagcccatggaggacagaatcgacagcctgagccagagcttccccccccagtaccaggaggccgtggagcccaccgtgtacgtgggcaccgccgtgaacctggaggaggacgaggccaacatcgcctggaagtactacaagttccccaagaagaaggacgtggagttcctgcccccccagctgcccagcgacaagttcaaggacgaccccgtgggccccttcggccaggagagcgtgaccagcgtgaccgagctgatggtgcagtgcaagaagcccctgaaggtgagcgacgagctggtgcagcagtaccagatcaagaaccagtgcctgagcgccatcgccagcgacgccgagcaggagcccaagatcgacccctacgccttcgtggagggcgacgaggagttcctgttccccgacaagaaggacagacagaacagcgagagagaggccggcaagaagcacaaggtggaggacggcaccagcagcgtgaccgtgctgagccacgaggaggacgccatgagcctgttcagccccagcatcaagcaggacgcccccagacccaccagccacgccagaccccccagcaccagcctgatctacgacagcgacctggccgtgagctacaccgacctggacaacctgttcaacagcgacgaggacgagctgacccccggcagcaagaagagcgccaacggcagcgacgacaaggccagctgcaaggagagcaagaccggcaacctggaccccctgagctgcatcagcaccgccgacctgcacaagatgtaccccaccccccccagcctggagcagcacatcatgggcttcagccccatgaacatgaacaacaaggagtacggcagcatggacaccacccccggcggcaccgtgctggagggcaacagcagcagcatcggcgcccagttcaagatcgaggtggacgagggcttctgcagccccaagcccagcgagatcaaggacttcagctacgtgtacaagcccgagaactgccagatcctggtgggctgcagcatgttcgcccccctgaagaccctgcccagccagtacctgccccccatcaagctgcccgaggagtgcatctacagacagagctggaccgtgggcaagctggagctgctgagcagcggccccagcatgcccttcatcaaggagggcgacggcagcaacatggaccaggagtacggcaccgcctacaccccccagacccacaccagcttcggcatgccccccagcagcgccccccccagcaacagcggcgccggcatcctgcccagccccagcacccccagattccccacccccagaacccccagaacccccagaacccccagaggcgccggcggccccgccagcgcccagggcagcgtgaagtacgagaacagcgacctgtacagccccgccagcacccccagcacctgcagacccctgaacagcgtggagcccgccaccgtgcccagcatccccgaggcccacagcctgtacgtgaacctgatcctgagcgagagcgtgatgaacctgttcaaggactgcaacttcgacagctgctgcatctgcgtgtgcaacatgaacatcaagggcgccgacgtgggcgtgtacatccccgaccccacccaggaggcccagtacagatgcacctgcggcttcagcgccgtgatgaacagaaagttcggcaacaacagcggcctgttcctggaggacgagctggacatcatcggcagaaacaccgactgcggcaaggaggccgagaagagattcgaggccctgagagccaccagcgccgagcacgtgaacggcggcctgaaggagagcgagaagctgagcgacgacctgatcctgctgctgcaggaccagtgcaccaacctgttcagccccttcggcgccgccgaccaggaccccttccccaagagcggcgtgatcagcaactgggtgagagtggaggagagagactgctgcaacgactgctacctggccctggagcacggcagacagttcatggacaacatgagcggcggcaaggtggacgaggccctggtgaagagcagctgcctgcacccctggagcaagagaaacgacgtgagcatgcagtgcagccaggacatcctgagaatgctgctgagcctgcagcccgtgctgcaggacgccatccagaagaagagaaccgtgagaccctggggcgtgcagggccccctgacctggcagcagttccacaagatggccggcagaggcagctacggcaccgacgagagccccgagcccctgcccatccccaccttcctgctgggctacgactacgactacctggtgctgagccccttcgccctgccctactgggagagactgatgctggagccctacggcagccagagagacatcgcctacgtggtgctgtgccccgagaacgaggccctgctgaacggcgccaagagcttcttcagagacctgaccgccatctacgagagctgcagactgggccagcacagacccgtgagcagactgctgaccgacggcatcatgagagtgggcagcaccgccagcaagaagctgagcgagaagctggtggccgagtggttcagccaggccgccgacggcaacaacgaggccttcagcaagctgaagctgtacgcccaggtgtgcagatacgacctgggcccctacctggccagcctgcccctggacagcagcctgctgagccagcccaacctggtggcccccaccagccagagcctgatcacccccccccagatgaccaacaccggcaacgccaacacccccagcgccaccctggccagcgccgccagcagcaccatgaccgtgaccagcggcgtggccatcagcaccagcgtggccaccgccaacagcaccctgaccaccgccagcaccagcagcagcagcagcagcaacctgaacagcggcgtgagcagcaacaagctgcccagcttcccccccttcggcagcatgaacagcaacgccgccggcagcatgagcacccaggccaacaccgtgcagagcggccagctgggcggccagcagaccagcgccctgcagaccgccggcatcagcggcgagagcagcagcctgcccacccagccccaccccgacgtgagcgagagcaccatggacagagacaaggtgggcatccccaccgacggcgacagccacgccgtgacctacccccccgccatcgtggtgtacatcatcgaccccttcacctacgagaacaccgacgagagcaccaacagcagcagcgtgtggaccctgggcctgctgagatgcttcctggagatggtgcagaccctgcccccccacatcaagagcaccgtgagcgtgcagatcatcccctgccagtacctgctgcagcccgtgaagcacgaggacagagagatctacccccagcacctgaagagcctggccttcagcgccttcacccagtgcagaagacccctgcccaccagcaccaacgtgaagaccctgaccggcttcggccccggcctggccatggagaccgccctgagaagccccgacagacccgagtgcatcagactgtacgccccccccttcatcctggcccccgtgaaggacaagcagaccgagctgggcgagaccttcggcgaggccggccagaagtacaacgtgctgttcgtgggctactgcctgagccacgaccagagatggatcctggccagctgcaccgacctgtacggcgagctgctggagacctgcatcatcaacatcgacgtgcccaacagagccagaagaaagaagagcagcgccagaaagttcggcctgcagaagctgtgggagtggtgcctgggcctggtgcagatgagcagcctgccctggagagtggtgatcggcagactgggcagaatcggccacggcgagctgaaggactggagctgcctgctgagcagaagaaacctgcagagcctgagcaagagactgaaggacatgtgcagaatgtgcggcatcagcgccgccgacagccccagcatcctgagcgcctgcctggtggccatggagccccagggcagcttcgtgatcatgcccgacagcgtgagcaccggcagcgtgttcggcagaagcaccaccctgaacatgcagaccagccagctgaacaccccccaggacaccagctgcacccacatcctggtgttccccaccagcgccagcgtgcaggtggccagcgccacctacaccaccgagaacctggacctggccttcaaccccaacaacgacggcgccgacggcatgggcatcttcgacctgctggacaccggcgacgacctggaccccgacatcatcaacatcctgcccgccagccccaccggcagccccgtgcacagccccggcagccactacccccacggcggcgacgccggcaagggccagagcaccgacagactgctgagcaccgagccccacgaggaggtgcccaacatcctgcagcagcccctggccctgggctacttcgtgagcaccgccaaggccggccccctgcccgactggttctggagcgcctgcccccaggcccagtaccagtgccccctgttcctgaaggccagcctgcacctgcacgtgcccagcgtgcagagcgacgagctgctgcacagcaagcacagccaccccctggacagcaaccagaccagcgacgtgctgagattcgtgctggagcagtacaacgccctgagctggctgacctgcgaccccgccacccaggacagaagaagctgcctgcccatccacttcgtggtgctgaaccagctgtacaacttcatcatgaacatgctgtag

SEQ ID NO: 88211 - DNA, 6525 bp, Artificial Sequence
  Description of Artificial Sequence: Synthetic coding sequence
atgagcgccagcttcgtgcccaacggcgccagcctggaggactgccactgcaacctgttctgcctggccgacctgaccggcatcaagtggaagaagtacgtgtggcagggccccaccagcgcccccatcctgttccccgtgaccgaggaggaccccatcctgagcagcttcagcagatgcctgaaggccgacgtgctgggcgtgtggagaagagaccagagacccggcagaagagagctgtggatcttctggtggggcgaggaccccagcttcgccgacctgatccaccacgacctgagcgaggaggaggacggcgtgtgggagaacggcctgagctacgagtgcagaaccctgctgttcaaggccgtgcacaacctgctggagagatgcctgatgaacagaaacttcgtgagaatcggcaagtggttcgtgaagccctacgagaaggacgagaagcccatcaacaagagcgagcacctgagctgcagcttcaccttcttcctgcacggcgacagcaacgtgtgcaccagcgtggagatcaaccagcaccagcccgtgtacctgctgagcgaggagcacatcaccctggcccagcagagcaacagccccttccaggtgatcctgtgccccttcggcctgaacggcaccctgaccggccaggccttcaagatgagcgacagcgccaccaagaagctgatcggcgagtggaagcagttctaccccatcagctgctgcctgaaggagatgagcgaggagaagcaggaggacatggactgggaggacgacagcctggccgccgtggaggtgctggtggccggcgtgagaatgatctaccccgcctgcttcgtgctggtgccccagagcgacatccccacccccagccccgtgggcagcacccactgcagcagcagctgcctgggcgtgcaccaggtgcccgccagcaccagagaccccgccatgagcagcgtgaccctgaccccccccaccagccccgaggaggtgcagaccgtggacccccagagcgtgcagaagtgggtgaagttcagcagcgtgagcgacggcttcaacagcgacagcaccagccaccacggcggcaagatccccagaaagctggccaaccacgtggtggacagagtgtggcaggagtgcaacatgaacagagcccagaacaagagaaagtacagcgccagcagcggcggcctgtgcgaggaggccaccgccgccaaggtggccagctgggacttcgtggaggccacccagagaaccaactgcagctgcctgagacacaagaacctgaagagcagaaacgccggccagcagggccaggcccccagcctgggccagcagcagcagatcctgcccaagcacaagaccaacgagaagcaggagaagagcgagaagccccagaagagacccctgacccccttccaccacagagtgagcgtgagcgacgacgtgggcatggacgccgacagcgccagccagagactggtgatcagcgcccccgacagccaggtgagattcagcaacatcagaaccaacgacgtggccaagaccccccagatgcacggcaccgagatggccaacagcccccagcccccccccctgagcccccacccctgcgacgtggtggacgagggcgtgaccaagacccccagcaccccccagagccagcacttctaccagatgcccacccccgaccccctggtgcccagcaagcccatggaggacagaatcgacagcctgagccagagcttccccccccagtaccaggaggccgtggagcccaccgtgtacgtgggcaccgccgtgaacctggaggaggacgaggccaacatcgcctggaagtactacaagttccccaagaagaaggacgtggagttcctgcccccccagctgcccagcgacaagttcaaggacgaccccgtgggccccttcggccaggagagcgtgaccagcgtgaccgagctgatggtgcagtgcaagaagcccctgaaggtgagcgacgagctggtgcagcagtaccagatcaagaaccagtgcctgagcgccatcgccagcgacgccgagcaggagcccaagatcgacccctacgccttcgtggagggcgacgaggagttcctgttccccgacaagaaggacagacagaacagcgagagagaggccggcaagaagcacaaggtggaggacggcaccagcagcgtgaccgtgctgagccacgaggaggacgccatgagcctgttcagccccagcatcaagcaggacgcccccagacccaccagccacgccagaccccccagcaccagcctgatctacgacagcgacctggccgtgagctacaccgacctggacaacctgttcaacagcgacgaggacgagctgacccccggcagcaagaagagcgccaacggcagcgacgacaaggccagctgcaaggagagcaagaccggcaacctggaccccctgagctgcatcagcaccgccgacctgcacaagatgtaccccaccccccccagcctggagcagcacatcatgggcttcagccccatgaacatgaacaacaaggagtacggcagcatggacaccacccccggcggcaccgtgctggagggcaacagcagcagcatcggcgcccagttcaagatcgaggtggacgagggcttctgcagccccaagcccagcgagatcaaggacttcagctacgtgtacaagcccgagaactgccagatcctggtgggctgcagcatgttcgcccccctgaagaccctgcccagccagtacctgccccccatcaagctgcccgaggagtgcatctacagacagagctggaccgtgggcaagctggagctgctgagcagcggccccagcatgcccttcatcaaggagggcgacggcagcaacatggaccaggagtacggcaccgcctacaccccccagacccacaccagcttcggcatgccccccagcagcgccccccccagcaacagcggcgccggcatcctgcccagccccagcacccccagattccccacccccagaacccccagaacccccagaacccccagaggcgccggcggccccgccagcgcccagggcagcgtgaagtacgagaacagcgacctgtacagccccgccagcacccccagcacctgcagacccctgaacagcgtggagcccgccaccgtgcccagcatccccgaggcccacagcctgtacgtgaacctgatcctgagcgagagcgtgatgaacctgttcaaggactgcaacttcgacagctgctgcatctgcgtgtgcaacatgaacatcaagggcgccgacgtgggcgtgtacatccccgaccccacccaggaggcccagtacagatgcacctgcggcttcagcgccgtgatgaacagaaagttcggcaacaacagcggcctgttcctggaggacgagctggacatcatcggcagaaacaccgactgcggcaaggaggccgagaagagattcgaggccctgagagccaccagcgccgagcacgtgaacggcggcctgaaggagagcgagaagctgagcgacgacctgatcctgctgctgcaggaccagtgcaccaacctgttcagccccttcggcgccgccgaccaggaccccttccccaagagcggcgtgatcagcaactgggtgagagtggaggagagagactgctgcaacgactgctacctggccctggagcacggcagacagttcatggacaacatgagcggcggcaaggtggacgaggccctggtgaagagcagctgcctgcacccctggagcaagagaaacgacgtgagcatgcagtgcagccaggacatcctgagaatgctgctgagcctgcagcccgtgctgcaggacgccatccagaagaagagaaccgtgagaccctggggcgtgcagggccccctgacctggcagcagttccacaagatggccggcagaggcagctacggcaccgacgagagccccgagcccctgcccatccccaccttcctgctgggctacgactacgactacctggtgctgagccccttcgccctgccctactgggagagactgatgctggagccctacggcagccagagagacatcgcctacgtggtgctgtgccccgagaacgaggccctgctgaacggcgccaagagcttcttcagagacctgaccgccatctacgagagctgcagactgggccagcacagacccgtgagcagactgctgaccgacggcatcatgagagtgggcagcaccgccagcaagaagctgagcgagaagctggtggccgagtggttcagccaggccgccgacggcaacaacgaggccttcagcaagctgaagctgtacgcccaggtgtgcagatacgacctgggcccctacctggccagcctgcccctggacagcagcctgctgagccagcccaacctggtggcccccaccagccagagcctgatcacccccccccagatgaccaacaccggcaacgccaacacccccagcgccaccctggccagcgccgccagcagcaccatgaccgtgaccagcggcgtggccatcagcaccagcgtggccaccgccaacagcaccctgaccaccgccagcaccagcagcagcagcagcagcaacctgaacagcggcgtgagcagcaacaagctgcccagcttcccccccttcggcagcatgaacagcaacgccgccggcagcatgagcacccaggccaacaccgtgcagagcggccagctgggcggccagcagaccagcgccctgcagaccgccggcatcagcggcgagagcagcagcctgcccacccagccccaccccgacgtgagcgagagcaccatggacagagacaaggtgggcatccccaccgacggcgacagccacgccgtgacctacccccccgccatcgtggtgtacatcatcgaccccttcacctacgagaacaccgacgagagcaccaacagcagcagcgtgtggaccctgggcctgctgagatgcttcctggagatggtgcagaccctgcccccccacatcaagagcaccgtgagcgtgcagatcatcccctgccagtacctgctgcagcccgtgaagcacgaggacagagagatctacccccagcacctgaagagcctggccttcagcgccttcacccagtgcagaagacccctgcccaccagcaccaacgtgaagaccctgaccggcttcggccccggcctggccatggagaccgccctgagaagccccgacagacccgagtgcatcagactgtacgccccccccttcatcctggcccccgtgaaggacaagcagaccgagctgggcgagaccttcggcgaggccggccagaagtacaacgtgctgttcgtgggctactgcctgagccacgaccagagatggatcctggccagctgcaccgacctgtacggcgagctgctggagacctgcatcatcaacatcgacgtgcccaacagagccagaagaaagaagagcagcgccagaaagttcggcctgcagaagctgtgggagtggtgcctgggcctggtgcagatgagcagcctgccctggagagtggtgatcggcagactgggcagaatcggccacggcgagctgaaggactggagctgcctgctgagcagaagaaacctgcagagcctgagcaagagactgaaggacatgtgcagaatgtgcggcatcagcgccgccgacagccccagcatcctgagcgcctgcctggtggccatggagccccagggcagcttcgtgatcatgcccgacagcgtgagcaccggcagcgtgttcggcagaagcaccaccctgaacatgcagaccagccagctgaacaccccccaggacaccagctgcacccacatcctggtgttccccaccagcgccagcgtgcaggtggccagcgccacctacaccaccgagaacctggacctggccttcaaccccaacaacgacggcgccgacggcatgggcatcttcgacctgctggacaccggcgacgacctggaccccgacatcatcaacatcctgcccgccagccccaccggcagccccgtgcacagccccggcagccactacccccacggcggcgacgccggcaagggccagagcaccgacagactgctgagcaccgagccccacgaggaggtgcccaacatcctgcagcagcccctggccctgggctacttcgtgagcaccgccaaggccggccccctgcccgactggttctggagcgcctgcccccaggcccagtaccagtgccccctgttcctgaaggccagcctgcacctgcacgtgcccagcgtgcagagcgacgagctgctgcacagcaagcacagccaccccctggacagcaaccagaccagcgacgtgctgagattcgtgctggagcagtacaacgccctgagctggctgacctgcgaccccgccacccaggacagaagaagctgcctgcccatccacttcgtggtgctgaaccagctgtacaacttcatcatgaacatgctgtag

SEQ ID NO: 88212 - DNA, 6633 bp, Artificial Sequence
  Description of Artificial Sequence: Synthetic coding sequence
atgaccgccgccgccaactgggtggccaacggcgccagcctggaggactgccacagcaacctgttcagcctggccgagctgaccggcatcaagtggagaagatacaacttcggcggccacggcgactgcggccccatcatcagcgcccccgcccaggacgaccccatcctgctgagcttcatcagatgcctgcaggccaacctgctgtgcgtgtggagaagagacgtgaagcccgactgcaaggagctgtggatcttctggtggggcgacgagcccaacctggtgggcgtgatccaccacgagctgcaggtggtggaggagggcctgtgggagaacggcctgagctacgagtgcagaaccctgctgttcaaggccatccacaacctgctggagagatgcctgatggacaagaacttcgtgagaatcggcaagtggttcgtgagaccctacgagaaggacgagaagcccgtgaacaagagcgagcacctgagctgcgccttcaccttcttcctgcacggcgagagcaacgtgtgcaccagcgtggagatcgcccagcaccagcccatctacctgatcaacgaggagcacatccacatggcccagagcagccccgcccccttccaggtgctggtgagcccctacggcctgaacggcaccctgaccggccaggcctacaagatgagcgaccccgccaccagaaagctgatcgaggagtggcagtacttctaccccatggtgctgaagaagaaggaggagagcaaggaggaggacgagctgggctacgacgacgacttccccgtggccgtggaggtgatcgtgggcggcgtgagaatggtgtaccccagcgccttcgtgctgatcagccagaacgacatccccgtgccccagagcgtggccagcgccggcggccacatcgccgtgggccagcagggcctgggcagcgtgaaggaccccagcaactgcggcatgcccctgaccccccccaccagccccgagcaggccatcctgggcgagagcggcggcatgcagagcgccgccagccacctggtgagccaggacggcggcatgatcaccatgcacagccccaagagaagcggcaagatcccccccaagctgcacaaccacatggtgcacagagtgtggaaggagtgcatcctgaacagaacccagagcaagagaagccagatgagcacccccaccctggaggaggagcccgccagcaaccccgccacctgggacttcgtggaccccacccagagagtgagctgcagctgcagcagacacaagctgctgaagagatgcgccgtgggccccaacagaccccccaccgtgagccagcccggcttcagcgccggccccagcagcagcagcagcctgcccccccccgccagcagcaagcacaagaccgccgagagacaggagaagggcgacaagctgcagaagagacccctgatccccttccaccacagacccagcgtggccgaggagctgtgcatggagcaggacacccccggccagaagctgggcctggccggcatcgacagcagcctggaggtgagcagcagcagaaagtacgacaagcagatggccgtgcccagcagaaacaccagcaagcagatgaacctgaaccccatggacagcccccacagccccatcagccccctgccccccaccctgagcccccagcccagaggccaggagaccgagagcctggacccccccagcgtgcccgtgaaccccgccctgtacggcaacggcctggagctgcagcagctgagcaccctggacgacagaaccgtgctggtgggccagagactgcccctgatggccgaggtgagcgagaccgccctgtactgcggcatcagacccagcaaccccgagagcagcgagaagtggtggcacagctacagactgccccccagcgacgacgccgagttcagaccccccgagctgcagggcgagagatgcgacgccaagatggaggtgaacagcgagagcaccgccctgcagagactgctggcccagcccaacaagagattcaagatctggcaggacaagcagccccagctgcagcccctgcacttcctggaccccctgcccctgagccagcagcccggcgacagcctgggcgaggtgaacgacccctacaccttcgaggacggcgacatcaagtacatcttcaccgccaacaagaagtgcaagcagggcaccgagaaggacagcctgaagaagaacaagagcgaggacggcttcggcaccaaggacgtgaccacccccggccacagcacccccgtgcccgacggcaagaacgccatgagcatcttcagcagcgccaccaagaccgacgtgagacaggacaacgccgccggcagagccggcagcagcagcctgacccaggtgaccgacctggcccccagcctgcacgacctggacaacatcttcgacaacagcgacgacgacgagctgggcgccgtgagccccgccctgagaagcagcaagatgcccgccgtgggcaccgaggacagacccctgggcaaggacggcagagccgccgtgccctacccccccaccgtggccgacctgcagagaatgttccccaccccccccagcctggagcagcaccccgccttcagccccgtgatgaactacaaggacggcatcagcagcgagaccgtgaccgccctgggcatgatggagagccccatggtgagcatggtgagcacccagctgaccgagttcaagatggaggtggaggacggcctgggcagccccaagcccgaggagatcaaggacttcagctacgtgcacaaggtgcccagcttccagcccttcgtgggcagcagcatgttcgcccccctgaagatgctgcccagccactgcctgctgcccctgaagatccccgacgcctgcctgttcagacccagctgggccatcccccccaagatcgagcagctgcccatgccccccgccgccaccttcatcagagacggctacaacaacgtgcccagcgtgggcagcctggccgaccccgactacctgaacaccccccagatgaacacccccgtgaccctgaacagcgccgcccccgccagcaacagcggcgccggcgtgctgcccagccccgccacccccagattcagcgtgcccacccccagaacccccagaacccccagaacccccagaggcggcggcaccgccagcggccagggcagcgtgaagtacgacagcaccgaccagggcagccccgccagcacccccagcaccaccagacccctgaacagcgtggagcccgccaccatgcagcccatccccgaggcccacagcctgtacgtgaccctgatcctgagcgacagcgtgatgaacatcttcaaggacagaaacttcgacagctgctgcatctgcgcctgcaacatgaacatcaagggcgccgacgtgggcctgtacatccccgacagcagcaacgaggaccagtacagatgcacctgcggcttcagcgccatcatgaacagaaagctgggctacaacagcggcctgttcctggaggacgagctggacatcttcggcaagaacagcgacatcggccaggccgccgagagaagactgatgatgtgccagagcaccttcctgccccaggtggagggcaccaagaagccccaggagccccccatcagcctgctgctgctgctgcagaaccagcacacccagcccttcgccagcctgaacttcctggactacatcagcagcaacaacagacagaccctgccctgcgtgagctggagctacgacagagtgcaggccgacaacaacgactactggaccgagtgcttcaacgccctggagcagggcagacagtacgtggacaaccccaccggcggcaaggtggacgaggccctggtgagaagcgccaccgtgcacagctggccccacagcaacgtgctggacatcagcatgctgagcagccaggacgtggtgagaatgctgctgagcctgcagcccttcctgcaggacgccatccagaagaagagaaccggcagaacctgggagaacatccagcacgtgcagggccccctgacctggcagcagttccacaagatggccggcagaggcacctacggcagcgaggagagccccgagcccctgcccatccccaccctgctggtgggctacgacaaggacttcctgaccatcagccccttcagcctgcccttctgggagagactgctgctggacccctacggcggccacagagacgtggcctacatcgtggtgtgccccgagaacgaggccctgctggagggcgccaagaccttcttcagagacctgagcgccgtgtacgagatgtgcagactgggccagcacaagcccatctgcaaggtgctgagagacggcatcatgagagtgggcaagaccgtggcccagaagctgaccgacgagctggtgagcgagtggttcaaccagccctggagcggcgaggagaacgacaaccacagcagactgaagctgtacgcccaggtgtgcagacaccacctggccccctacctggccaccctgcagctggacagcagcctgctgatcccccccaagtaccagaccccccccgccgccgcccagggccaggccacccccggcaacgccggccccctggcccccaacggcagcgccgccccccccgccggcagcgccttcaaccccaccagcaacagcagcagcaccaaccccgccgccagcagcagcgccagcggcagcagcgtgccccccgtgagcagcagcgccagcgcccccggcatcagccagatcagcaccaccagcagcagcggcttcagcggcagcgtgggcggccagaaccccagcaccggcggcatcagcgccgacagaacccagggcaacatcggctgcggcggcgacaccgaccccggccagagcagcagccagcccagccaggacggccaggagagcgtgaccgagagagagagaatcggcatccccaccgagcccgacagcgccgacagccacgcccacccccccgccgtggtgatctacatggtggaccccttcacctacgccgccgaggaggacagcaccagcggcaacttctggctgctgagcctgatgagatgctacaccgagatgctggacaacctgcccgagcacatgagaaacagcttcatcctgcagatcgtgccctgccagtacatgctgcagaccatgaaggacgagcaggtgttctacatccagtacctgaagagcatggccttcagcgtgtactgccagtgcagaagacccctgcccacccagatccacatcaagagcctgaccggcttcggccccgccgccagcatcgagatgaccctgaagaaccccgagagacccagccccatccagctgtacagcccccccttcatcctggcccccatcaaggacaagcagaccgagctgggcgagaccttcggcgaggccagccagaagtacaacgtgctgttcgtgggctactgcctgagccacgaccagagatggctgctggccagctgcaccgacctgcacggcgagctgctggagacctgcgtggtgaacatcgccctgcccaacagaagcagaagaagcaaggtgagcgccagaaagatcggcctgcagaagctgtgggagtggtgcatcggcatcgtgcagatgaccagcctgccctggagagtggtgatcggcagactgggcagactgggccacggcgagctgaaggactggagcatcctgctgggcgagtgcagcctgcagaccatcagcaagaagctgaaggacgtgtgcagaatgtgcggcatcagcgccgccgacagccccagcatcctgagcgcctgcctggtggccatggagccccagggcagcttcgtggtgatgcccgacgccgtgaccatgggcagcgtgttcggcagaagcaccgccctgaacatgcagagcagccagctgaacaccccccaggacgccagctgcacccacatcctggtgttccccaccagcagcaccatccaggtggcccccgccaactaccccaacgaggacggcttcagccccaacaacgacgacatgttcgtggacctgcccttccccgacgacatggacaacgacatcggcatcctgatgaccggcaacctgcacagcagccccaacagcagccccgtgcccagccccggcagccccagcggcatcggcgtgggcagccacttccagcacagcagaagccagggcgagagactgctgagcagagaggcccccgaggagctgaagcagcagcccctggccctgggctacttcgtgagcaccgccaaggccgagaacctgccccagtggttctggagcagctgcccccaggcccagaaccagtgccccctgttcctgaaggccagcctgcaccaccacatcagcgtggcccagaccgacgagctgctgcccgccagaaacagccagagagtgccccaccccctggacagcaagaccaccagcgacgtgctgagattcgtgctggagcagtacaacgccctgagctggctgacctgcaaccccgccacccaggacagaaccagctgcctgcccgtgcacttcgtggtgctgacccagctgtacaacgccatcatgaacatcctgtag

SEQ ID NO: 88213 - DNA, 4365 bp, Artificial Sequence
  Description of Artificial Sequence: Synthetic coding sequence
atggcccccgtgcagctggagaaccaccagctggtgccccccggcggcggcggcggcggcagcggcggcccccccagcgcccccgccccccccccccccggcgccgccgtggccgccgccgccgccgccgccgccagccccggctacagactgagcaccctgatcgagttcctgctgcacagagcctacagcgagctgatggtgctgaccgacctgctgcccagaaagagcgacgtggagagaaagatcgagatcgtgcagttcgccagcagaaccagacagctgttcgtgagactgctggccctggtgaagtgggccaacaacgccggcaaggtggagaagtgcgccatgatcagcagcttcctggaccagcaggccatcctgttcgtggacaccgccgacagactggccagcctggccagagacgccctggtgcacgccagactgcccagcttcgccatcccctacgccatcgacgtgctgaccaccggcagctaccccagactgcccacctgcatcagagacaagatcatcccccccgaccccatcaccaagatcgagaagcaggccaccctgcaccagctgaaccagatcctgagacacagactggtgaccaccgacctgcccccccagctggccaacctgaccgtggccaacggcagagtgaagttcagagtggagggcgagttcgaggccaccctgaccgtgatgggcgacgaccccgacgtgccctggagactgctgaagctggagatcctggtggaggacaaggagaccggcgacggcagagccctggtgcacagcatgcagatcagcttcatccaccagctggtgcagagcagactgttcgccgacgagaagcccctgcaggacatgtacaactgcctgcacagcttctgcctgagcctgcagctggaggtgctgcacagccagaccctgatgctgatcagagagagatggggcgacctggtgcaggtggagagataccacgccggcaagtgcctgagcctgagcgtgtggaaccagcaggtgctgggcagaaagaccggcaccgccagcgtgcacaaggtgaccatcaagatcgacgagaacgacgtgagcaagcccctgcagatcttccacgacccccccctgcccgccagcgacagcaagctggtggagagagccatgaagatcgaccacctgagcatcgagaagctgctgatcgacagcgtgcacgccagagcccaccagaagctgcaggagctgaaggccatcctgagaggcttcaacgccaacgagaacagcagcatcgagaccgccctgcccgccctggtggtgcccatcctggagccctgcggcaacagcgagtgcctgcacatcttcgtggacctgcacagcggcatgttccagctgatgctgtacggcctggaccaggccaccctggacgacatggagaagagcgtgaacgacgacatgaagagaatcatcccctggatccagcagctgaagttctggctgggccagcagagatgcaagcagagcatcaagcacctgcccaccatcagcagcgagaccctgcagctgagcaactacagcacccaccccatcggcaacctgagcaagaacaagctgttcatcaagctgaccagactgccccagtactacatcgtggtggagatgctggaggtgcccaacaagcccacccagctgagctacaagtactacttcatgagcgtgaacgccgccgacagagaggacagccccgccatggccctgctgctgcagcagttcaaggagaacatccaggacctggtgttcagaaccaagaccggcaagcagaccagaaccaacgccaagagaaagctgagcgacgacccctgccccgtggagagcaagaagaccaagagagccggcgagatgtgcgccttcaacaaggtgctggcccacttcgtggccatgtgcgacaccaacatgcccttcgtgggcctgagactggagctgagcaacctggagatcccccaccagggcgtgcaggtggagggcgacggcttcagccacgccatcagactgctgaagatccccccctgcaagggcatcaccgaggagacccagaaggccctggacagaagcctgctggactgcaccttcagactgcagggcagaaacaacagaacctgggtggccgagctggtgttcgccaactgccccctgaacggcaccagcaccagagagcagggccccagcagacacgtgtacctgacctacgagaacctgctgagcgagcccgtgggcggcagaaaggtggtggagatgttcctgaacgactggaacagcatcgccagactgtacgagtgcgtgctggagttcgccagaagcctgcccgacatccccgcccacctgaacatcttcagcgaggtgagagtgtacaactacagaaagctgatcctgtgctacggcaccaccaagggcagcagcatcagcatccagtggaacagcatccaccagaagttccacatcagcctgggcaccgtgggccccaacagcggctgcagcaactgccacaacaccatcctgcaccagctgcaggagatgttcaacaagacccccaacgtggtgcagctgctgcaggtgctgttcgacacccaggcccccctgaacgccatcaacaagctgcccaccgtgcccatgctgggcctgacccagagaaccaacaccgcctaccagtgcttcagcatcctgccccagagcagcacccacatcagactggccttcagaaacatgtactgcatcgacatctactgcagaagcagaggcgtggtggccatcagagacggcgcctacagcctgttcgacaacagcaagctggtggagggcttctaccccgcccccggcctgaagaccttcctgaacatgttcgtggacagcaaccaggacgccagaagaagaagcgtgaacgaggacgacaacccccccagccccatcggcggcgacatgatggacagcctgatcagccagctgcagccccccccccagcagcagcccttccccaagcagcccggcaccagcggcgcctaccccctgaccagcccccccaccagctaccacagcaccgtgaaccagagccccagcatgatgcacacccagagccccggcaacctgcacgccgccagcagccccagcggcgccctgagagcccccagccccgccagcttcgtgcccacccccccccccagcagccacggcatcagcatcggccccggcgccagcttcgccagcccccacggcaccctggaccccagcagcccctacaccatggtgagccccagcggcagagccggcaactggcccggcagcccccaggtgagcggccccagccccgccgccagaatgcccggcatgagccccgccaaccccagcctgcacagccccgtgcccgacgccagccacagccccagagccggcaccagcagccagaccatgcccaccaacatgcccccccccagaaagctgccccagagaagctgggccgccagcatccccaccatcctgacccacagcgccctgaacatcctgctgctgcccagccccacccccggcctggtgcccggcctggccggcagctacctgtgcagccccctggagagattcctgggcagcgtgatcatgagaagacacctgcagagaatcatccagcaggagaccctgcagctgatcaacagcaacgagcccggcgtgatcatgttcaagaccgacgccctgaagtgcagagtggccctgagccccaagaccaaccagaccctgcagctgaaggtgacccccgagaacgccggccagtggaagcccgacgagctgcaggtgctggagaagttcttcgagaccagagtggccggcccccccttcaaggccaacaccctgatcgccttcaccaagctgctgggcgcccccacccacatcctgagagactgcgtgcacatcatgaagctggagctgttccccgaccaggccacccagctgaagtggaacgtgcagttctgcctgaccatcccccccagcgccccccccatcgccccccccggcacccccgccgtggtgctgaagagcaagatgctgttcttcctgcagctgacccagaagaccagcgtgcccccccaggagcccgtgagcatcatcgtgcccatcatctacgacatggccagcggcaccacccagcaggccgacatccccagacagcagaacagcagcgtggccgcccccatgatggtgagcaacatcctgaagagattcgccgagatgaacccccccagacagggcgagtgcaccatcttcgccgccgtgagagacctgatggccaacctgaccctgccccccggcggcagaccctag

SEQ ID NO: 88214 - DNA, 468 bp, Artificial Sequence
  Description of Artificial Sequence: Synthetic coding sequence
gtggccggcccccccttcaaggccaacaccctgatcgccttcaccaagctgctgggcgcccccacccacatcctgagagactgcgtgcacatcatgaagctggagctgttccccgaccaggccacccagctgaagtggaacgtgcagttctgcctgaccatcccccccagcgccccccccatcgccccccccggcacccccgccgtggtgctgaagagcaagatgctgttcttcctgcagctgacccagaagaccagcgtgcccccccaggagcccgtgagcatcatcgtgcccatcatctacgacatggccagcggcaccacccagcaggccgacatccccagacagcagaacagcagcgtggccgcccccatgatggtgagcaacatcctgaagagattcgccgagatgaacccccccagacagggcagcatcaagggcaccggctgccccagcgacttcctgtag

SEQ ID NO: 88215 - DNA, 996 bp, Artificial Sequence
  Description of Artificial Sequence: Synthetic coding sequence
cccagcggcagagccggcaactggcccggcagcccccaggtgagcggccccagccccgccgccagaatgcccggcatgagccccgccaaccccagcctgcacagccccgtgcccgacgccagccacagccccagagccggcaccagcagccagaccatgcccaccaacatgcccccccccagaaagctgccccagagaagctgggccgccagcatccccaccatcctgacccacagcgccctgaacatcctgctgctgcccagccccacccccggcctggtgcccggcctggccggcagctacctgtgcagccccctggagagattcctgggcagcgtgatcatgagaagacacctgcagagaatcatccagcaggagaccctgcagctgatcaacagcaacgagcccggcgtgatcatgttcaagaccgacgccctgaagtgcagagtggccctgagccccaagaccaaccagaccctgcagctgaaggtgacccccgagaacgccggccagtggaagcccgacgagctgcaggtgctggagaagttcttcgagaccagagtggccggcccccccttcaaggccaacaccctgatcgccttcaccaagctgctgggcgcccccacccacatcctgagagactgcgtgcacatcatgaagctggagctgttccccgaccaggccacccagctgaagtggaacgtgcagttctgcctgaccatcccccccagcgccccccccatcgccccccccggcacccccgccgtggtgctgaagagcaagatgctgttcttcctgcagctgacccagaagaccagcgtgcccccccaggagcccgtgagcatcatcgtgcccatcatctacgacatggccagcggcaccacccagcaggccgacatccccagacagcagaacagcagcgtggccgcccccatgatggtgagcaacatcctgaagagattcgccgagatgaacccccccagacagggcacctag

SEQ ID NO: 88216 - DNA, 2367 bp, Artificial Sequence
  Description of Artificial Sequence: Synthetic coding sequence
atggacgtgagcggccaggagaccgactggagaagcaccgccttcagacagaagctggtgagccagatcgaggacgccatgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcagatgatcaccgaggccctggcccagggcggcatgcacatcagagccagattcccccccaccaccgccgtgagcgccatccccagcagcagcatccccctgggcagacagcccatggcccaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88217 - DNA, 2247 bp, Artificial Sequence
  Description of Artificial Sequence: Synthetic coding sequence
atggacgtgagcggccaggagaccgactggagaagcaccgccttcagacagaagctggtgagccagatcgaggacgccatgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88218 - DNA, 2034 bp, Artificial Sequence
  Description of Artificial Sequence: Synthetic coding sequence
atggacgtgagcggccaggagaccgactggagaagcaccgccttcagacagaagctggtgagccagatcgaggacgccatgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgcccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88219 - DNA, 2169 bp, Artificial Sequence
  Description of Artificial Sequence: Synthetic coding sequence
atgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88220 - DNA, 1914 bp, Artificial Sequence
  Description of Artificial Sequence: Synthetic coding sequence
atggagagccacgtgttcctgaaggccaagaccagagacgagtacctgagcctggtggccagactgatcatccacttcagagacatccacaacaagaagagccaggccagcgtgagcgcccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88221 - DNA, 2169 bp, Artificial Sequence; identical to SEQ ID NO: 88219
  Description of Artificial Sequence: Synthetic coding sequence

SEQ ID NO: 88222 - DNA, 2157 bp, Artificial Sequence
  Description of Artificial Sequence: Synthetic coding sequence
atgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcagatgatcaccgaggccctggcccagggcggcatgcacatcagagccagattcccccccaccaccgccgtgagcgccatccccagcagcagcatccccctgggcagacagcccatggcccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88223 - DNA, 570 bp, Artificial Sequence
  Description of Artificial Sequence: Synthetic coding sequence
atgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcagtag

SEQ ID NO: 88224 - DNA, 1956 bp, Artificial Sequence
  Description of Artificial Sequence: Synthetic coding sequence
atgagcggcgtgagagccgtgagaatcagcatcgagagcgcctgcgagaagcaggtgcacgaggtgggcctggacggcaccgagacctacctgccccccctgagcatgagccagaacctggccagactggcccagagaatcgacttcagccagggcagcggcagcgaggaggaggaggccgccggcaccgagggcgacgcccaggagtggcccggcgccggcagcagcgccgaccaggacgacgaggagggcgtggtgaagttccagcccagcctgtggccctgggacagcgtgagaaacaacctgagaagcgccctgaccgagatgtgcgtgctgtacgacgtgctgagcatcgtgagagacaagaagttcatgaccctggaccccgtgagccaggacgccctgccccccaagcagaacccccagaccctgcagctgatcagcaagaagaagagcctggccggcgccgcccagatcctgctgaagggcgccgagagactgaccaagagcgtgaccgagaaccaggagaacaagctgcagagagacttcaacagcgagctgctgagactgagacagcactggaagctgagaaaggtgggcgacaagatcctgggcgacctgagctacagaagcgccggcagcctgttcccccaccacggcaccttcgaggtgatcaagaacaccgacctggacctggacaagaagatccccgaggactactgccccctggacgtgcagatccccagcgacctggagggcagcgcctacatcaaggtgagcatccagaagcaggcccccgacatcggcgacctgggcaccgtgaacctgttcaagagacccctgcccaagagcaagcccggcagcccccactggcagaccaagctggaggccgcccagaacgtgctgctgtgcaaggagatcttcgcccagctgagcagagaggccgtgcagatcaagagccaggtgccccacatcgtggtgaagaaccagatcatcagccagcccttccccagcctgcagctgagcatcagcctgtgccacagcagcaacgacaagaagagccagaagttcgccaccgagaagcagtgccccgaggaccacctgtacgtgctggagcacaacctgcacctgctgatcagagagttccacaagcagaccctgagcagcatcatgatgccccaccccgccagcgcccccttcggccacaagagaatgagactgagcggcccccaggccttcgacaagaacgagatcaacagcctgcagagcagcgagggcctgctggagaagatcatcaagcaggccaagcacatcttcctgagaagcagagccgccgccaccatcgacagcctggccagcagaatcgaggacccccagatccaggcccactggagcaacatcaacgacgtgtacgagagcagcgtgaaggtgctgatcaccagccagggctacgagcagatctgcaagagcatccagctgcagctgaacatcggcgtggagcagatcagagtggtgcacagagacggcagagtgatcaccctgagctaccaggagcaggagctgcaggacttcctgctgagccagatgagccagcaccaggtgcacgccgtgcagcagctggccaaggtgatgggctggcaggtgctgagcttcagcaaccacgtgggcctgggccccatcgagagcatcggcaacgccagcgccatcaccgtggccagccccagcggcgactacgccatcagcgtgagaaacggccccgagagcggcagcaagatcatggtgcagttccccagaaaccagtgcaaggacctgcccaagagcgacgtgctgcaggacaacaagtggagccacctgagaggccccttcaaggaggtgcagtggaacaagatggagggcagaaacttcgtgtacaagatggagctgctgatgagcgccctgagcccctgcctgctgtag

SEQ ID NO: 88225 - DNA, 1866 bp, Artificial Sequence
  Description of Artificial Sequence: Synthetic coding sequence
atgagcggcgtgagagccgtgagaatcagcatcgagagcgcctgcgagaagcaggtgcacgaggtgggcctggacggcaccgagacctacctgccccccctgagcatgagccaggagtggcccggcgccggcagcagcgccgaccaggacgacgaggagggcgtggtgaagttccagcccagcctgtggccctgggacagcgtgagaaacaacctgagaagcgccctgaccgagatgtgcgtgctgtacgacgtgctgagcatcgtgagagacaagaagttcatgaccctggaccccgtgagccaggacgccctgccccccaagcagaacccccagaccctgcagctgatcagcaagaagaagagcctggccggcgccgcccagatcctgctgaagggcgccgagagactgaccaagagcgtgaccgagaaccaggagaacaagctgcagagagacttcaacagcgagctgctgagactgagacagcactggaagctgagaaaggtgggcgacaagatcctgggcgacctgagctacagaagcgccggcagcctgttcccccaccacggcaccttcgaggtgatcaagaacaccgacctggacctggacaagaagatccccgaggactactgccccctggacgtgcagatccccagcgacctggagggcagcgcctacatcaaggtgagcatccagaagcaggcccccgacatcggcgacctgggcaccgtgaacctgttcaagagacccctgcccaagagcaagcccggcagcccccactggcagaccaagctggaggccgcccagaacgtgctgctgtgcaaggagatcttcgcccagctgagcagagaggccgtgcagatcaagagccaggtgccccacatcgtggtgaagaaccagatcatcagccagcccttccccagcctgcagctgagcatcagcctgtgccacagcagcaacgacaagaagagccagaagttcgccaccgagaagcagtgccccgaggaccacctgtacgtgctggagcacaacctgcacctgctgatcagagagttccacaagcagaccctgagcagcatcatgatgccccaccccgccagcgcccccttcggccacaagagaatgagactgagcggcccccaggccttcgacaagaacgagatcaacagcctgcagagcagcgagggcctgctggagaagatcatcaagcaggccaagcacatcttcctgagaagcagagccgccgccaccatcgacagcctggccagcagaatcgaggacccccagatccaggcccactggagcaacatcaacgacgtgtacgagagcagcgtgaaggtgctgatcaccagccagggctacgagcagatctgcaagagcatccagctgcagctgaacatcggcgtggagcagatcagagtggtgcacagagacggcagagtgatcaccctgagctaccaggagcaggagctgcaggacttcctgctgagccagatgagccagcaccaggtgcacgccgtgcagcagctggccaaggtgatgggctggcaggtgctgagcttcagcaaccacgtgggcctgggccccatcgagagcatcggcaacgccagcgccatcaccgtggccagccccagcggcgactacgccatcagcgtgagaaacggccccgagagcggcagcaagatcatggtgcagttccccagaaaccagtgcaaggacctgcccaagagcgacgtgctgcaggacaacaagtggagccacctgagaggccccttcaaggaggtgcagtggaacaagatggagggcagaaacttcgtgtacaagatggagctgctgatgagcgccctgagcccctgcctgctgtag

SEQ ID NO: 88226 - DNA, 438 bp, Artificial Sequence
  Description of Artificial Sequence: Synthetic coding sequence
atgagcggcgtgagagccgtgagaatcagcatcgagagcgcctgcgagaagcaggtgcacgaggtgggcctggacggcaccgagacctacctgccccccctgagcatgagccagaacctggccagactggcccagagaatcgacttcagccagggcagcggcagcgaggaggaggaggccgccggcaccgagggcgacgcccaggagtggcccggcgccggcagcagcgccgaccaggacgacgaggagggcgtggtgaagttccagcccagcctgtggccctgggacagcgtgagaaacaacctgagaagcgccctgaccgagatgtgcgtgctgtacgacgtgctgagcatcgtgagagacaagaagttcatgaccctggaccccgtgagccaggacgccctgccccccaagcaggtgttcgtggacttcaactag

SEQ ID NO: 88227 - DNA, 627 bp, Artificial Sequence
  Description of Artificial Sequence: Synthetic coding sequence
atggaggccccccccgtgaccatgatgcccgtgaccggcggcaccatcaacatgatggagtacctgctgcagggcagcgtgctggaccacagcctggagagcctgatccacagactgagaggcctgtgcgacaacatggagcccgagaccttcctggaccacgagatggtgttcctgctgaagggccagcaggccagccccttcgtgctgagagccagaagaagcatggacagagccggcgccccctggcacctgagatacctgggccagcccgagatgggcgacaagaacagacacgccctggtgagaaactgcgtggacatcgccaccagcgagaacctgaccgacttcctgatggagatgggcttcagaatggaccacgagttcgtggccaagggccacctgttcagaaagggcatcatgaagatcatggtgtacaagatcttcagaatcctggtgcccggcaacaccgacagcaccgaggccctgagcctgagctacctggtggagctgagcgtggtggcccccgccggccaggacatggtgagcgacgacatgaagaacttcgccgagcagctgaagcccctggtgcacctggagaagatcgaccccaagagactgatgtag

SEQ ID NO: 88228 - DNA, 627 bp, Artificial Sequence; identical to SEQ ID NO: 88227
  Description of Artificial Sequence: Synthetic coding sequence

SEQ ID NO: 88229 - DNA, 585 bp, Artificial Sequence
  Description of Artificial Sequence: Synthetic coding sequence
atggagaacttcaccgccctgttcggcgcccaggccgaccccccccccccccccaccgccctgggcttcggccccggcaagccccccccccccccccccccccccgccggcggcggccccggcaccgcccccccccccaccgccgccaccgccccccccggcgccgacaagagcggcgccggctgcggccccttctacctgatgagagagctgcccggcagcaccgagctgaccggcagcaccaacctgatcacccactacaacctggagcaggcctacaacaagttctgcggcaagaaggtgaaggagaagctgagcaacttcctgcccgacctgcccggcatgatcgacctgcccggcagccacgacaacagcagcctgagaagcctgatcgagaagccccccatcctgagcagcagcttcaaccccatcaccggcaccatgctggccggcttcagactgcacaccggccccctgcccgagcagtgcagactgatgcacatccagccccccaagaagaagaacaagcacaagcacaagcagagcagaacccaggaccccgtgccccccggcaagcccagctag

SEQ ID NO: 88230 - DNA, 735 bp, Artificial Sequence
  Description of Artificial Sequence: Synthetic coding sequence
atggagaacttcaccgccctgttcggcgcccaggccgaccccccccccccccccaccgccctgggcttcggccccggcaagccccccccccccccccccccccccgccggcggcggccccggcaccgcccccccccccaccgccgccaccgccccccccggcgccgacaagagcggcgccggctgcggccccttctacctgatgagagagctgcccggcagcaccgagctgaccggcagcaccaacctgatcacccactacaacctggagcaggcctacaacaagttctgcggcaagaaggtgaaggagaagctgagcaacttcctgcccgacctgcccggcatgatcgacctgcccggcagccacgacaacagcagcctgagaagcctgatcgagaagccccccatcctgagcagcagcttcaaccccatcaccggcaccatgctggccggcttcagactgcacaccggccccctgcccgagcagtgcagactgatgcacatccagccccccaagaagaagaacaagcacaagcacaagcagagcagaacccaggaccccgtgccccccgagacccccagcgacagcgaccacaagaagaagaagaagaagaaggaggaggaccccgagagaaagagaaagaagaaggagaagaagaagaagaagaacagacacagccccgaccaccccggcatgggcagcagccaggccagcagcagcagcagcctgagatag

SEQ ID NO: 88231 - DNA, 639 bp, Artificial Sequence
  Description of Artificial Sequence: Synthetic coding sequence
atgggcgtgacctgcgtgagccagatgcccgtggccgagggcaagagcgtgcagcagaccgtggagctgctgaccagaaagctggagatgctgggcgccgagaagcagggcaccttctgcgtggactgcgagacctaccacaccgccgccagcaccctgggcagccagggccagaccggcaagctgatgtacgtgatgcacaacagcgagtaccccctgagctgcttcgccctgttcgagaacggcccctgcctgatcgccgacaccaacttcgacgtgctgatggtgaagctgaagggcttcttccagagcgccaaggccagcaagatcgagaccagaggcaccagataccagtactgcgacttcctggtgaaggtgggcaccgtgaccatgggccccagcgccagaggcatcagcgtggaggtggagtacggcccctgcgtggtggccagcgactgctggagcctgctgctggagttcctgcagagcttcctgggcagccacacccccggcgcccccgccgtgttcggcaacagacacgacgccgtgtacggccccgccgacaccatggtgcagtacatggagctgttcaacaagatcagaaagcagcagcaggtgcccgtggccggcatcagatag

SEQ ID NO: 88232 - DNA, 423 bp, Artificial Sequence
  Description of Artificial Sequence: Synthetic coding sequence
atgcccgtggccgagggcaagagcgtgcagcagaccgtggagctgctgaccagaaagctggagatgctgggcgccgagaagcagggcaccttctgcgtggactgcgagacctaccacaccgccgccagcaccctgggcagccagggccagaccggcaagctgatgtacgtgatgcacaacagcgagtaccccctgagctgcttcgccctgttcgagaacggcccctgcctgatcgccgacaccaacttcgacgtgctgatggtgaagctgaagggcttcttccagagcgccaaggccagcaagatcgagaccagaggcaccagataccagtactgcgacttcctggtgaaggtgggcaccgtgaccatgggccccagcgccagaggcatcagcgtggaggtggagtacggcccctgcgtgtag

SEQ ID NO: 88233 - DNA, 438 bp, Artificial Sequence
  Description of Artificial Sequence: Synthetic coding sequence
atgggcgtgacctgcgtgagccagatgcccgtggccgagggcaagagcgtgcagcagaccgtggagctgctgaccagaaagctggagatgctgggcgccgagaagcagggcaccttctgcgtggactgcgagacctaccacaccgccgccagcaccctgggcagccagggccagaccggcaagctgatgtacgtgatgcacaacagcgagtaccccctgagctgcttcgccctgttcgagaacggcccctgcctgatcgccgacaccaacttcgacgtgctgatggtgaagctgaagggcttcttccagagcgccaaggccagcaagatcgagaccagaggcaccagataccagtactgcgacttcctggtgaaggtgggcaccgtgaccatgggccccagcgccagaggcatcagcgtggaggtgagaccctggtag

SEQ ID NO: 88234 - DNA, 372 bp, Artificial Sequence
  Description of Artificial Sequence: Synthetic coding sequence
atgggcgtgacctgcgtgagccagatgcccgtggccgagggcaagagcgtgcagcagaccgtggagctgctgaccagaaagctggagatgctgggcgccgagaagcagggcaccttctgcgtggactgcgagacctaccacaccgccgccagcaccctgggcagccagggccagaccggcaagctgatgtacgtgatgcacaacagcgagtaccccctgagctgcttcgccctgttcgagaacggcccctgcctgatcgccgacaccaacttcgacgtgctgatggtgaagctgaagggcttcttccagagcgccaaggccagcaagatcgagaccagaggcaccagatggagcatggcccccgtgtggtag

SEQ ID NO: 88235 - DNA, 435 bp, Artificial Sequence
  Description of Artificial Sequence: Synthetic coding sequence
atggccgacagactgacccagctgcaggacgccgtgaacagcctggccgaccagttctgcaacgccatcggcgtgctgcagcagtgcggcccccccgccagcttcaacaacatccagaccgccatcaacaaggaccagcccgccaaccccaccgaggagtacgcccagctgttcgccgccctgatcgccagaaccgccaaggacatcgacgtgctgatcgacagcctgcccagcgaggagagcaccgccgccctgcaggccgccagcctgtacaagctggaggaggagaaccacgaggccgccacctgcctggaggacgtggtgtacagaggcgacatgctgctggagaagatccagagcgccctggccgacatcgcccagagccagctgaagaccagaagcggcacccacagccagagcctgcccgacagctag

SEQ ID NO: 88236 - DNA, 4098 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagaccctgaacatcgcccagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggccatgagaagccacgagggcaacgaggcccaggtgtgctacttcatcatccagctgctgctgctgaagcccaacgacttcagaaacagagtgagcgacttcgtgaaggagaacagccccgagcactggctgcagaacgactggcacaccaagcacatgaactaccacaagaagtaccccgagaagctgtacttcgagggcctggccgagcaggtggacccccccgtgcagatccagagcccctacctgcccatctacttcggcaacgtgtgcctgagattcctgcccgtgttcgacatcgtgatccacagattcctggagctgctgcccgtgagcaagagcctggagaccctgctggaccacctgggcggcctgtacaagttccacgacagacccgtgacctacctgtacaacaccctgcactactacgagatgcacctgagagacagagccttcctgaagagaaagctggtgcacgccatcatcggcagcctgaaggacaacagaccccagggctggtgcctgagcgacacctacctgaagtgcgccatgaacgccagagaggagaacccctgggtgcccgacgacacctactactgcagactgatcggcagactggtggacaccatggccggcaagagccccggccccttccccaactgcgactggagattcaacgagttccccaaccccgccgcccacgccctgcacgtgacctgcgtggagctgatggccctggccgtgagcggcaaggaggtgggcaacgccctgctgaacgtggtgctgaagagccagcccctggtgcccagagagaacatcaccgcctggatgaacgccatcggcctgatcatcaccgccctgcccgagccctactggatcgtgctgcacgacagaatcgtgagcgtgatcagcagccccagcctgaccagcgagaccgagtgggtgggctaccccttcagactgttcgacttcaccgcctgccaccagagctacagcgagatgagctgcagctacaccctggccctggcccacgccgtgtggcaccacagcagcatcggccagctgagcctgatccccaagttcctgaccgaggtgctgctgcccatcgtgaagaccgagttccagctgctgtacgtgtaccacctggtgggccccttcctgcagagattccagcaggagagaaccagatgcatgatcgagatcggcgtggccttctacgacatgctgctgaacgtggaccagtgcagcacccacctgaactacatggaccccatctgcgacttcctgtaccacatgaagtacatgttcaccggcgacagcgtgaaggagcaggtggagaagatcatctgcaacctgaagcccgccctgaagctgagactgagattcatcacccacatcagcaagatggagcccgccgccgtgcccccccaggccatgaacagcggcagccccgccccccagagcaaccagtag

SEQ ID NO: 88237 - DNA, 2661 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagaccctgaacatcgcccagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggtgagaatcaacaccttcctgagcctgttcagctag

SEQ ID NO: 88238 - DNA, 4125 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagaccctgaacatcgcccagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggccatgagaagccacgagggcaacgaggcccaggtgtgctacttcatcatccagctgctgctgctgaagcccaacgacttcagaaacagagtgagcgacttcgtgaaggagaacagccccgagcactggctgcagaacgactggcacaccaagcacatgaactaccacaagaagtaccccgagaagctgtacttcgagggcctggccgagcaggtggacccccccgtgcagatccagagcccctacctgcccatctacttcggcaacgtgtgcctgagattcctgcccgtgttcgacatcgtgatccacagattcctggagctgctgcccgtgagcaagagcctggagaccctgctggaccacctgggcggcctgtacaagttccacgacagacccgtgacctacctgtacaacaccctgcactactacgagatgcacctgagagacagagccttcctgaagagaaagctggtgcacgccatcatcggcagcctgaaggacaacagaccccagggctggtgcctgagcgacacctacctgaagtgcgccatgaacgccagagaggagaacccctgggtgcccgacgacacctactactgcagactgatcggcagactggtggacaccatggccggcaagagccccggccccttccccaactgcgactggagattcaacgagttccccaaccccgccgcccacgccctgcacgtgacctgcgtggagctgatggccctggccgtgagcggcaaggaggtgggcaacgccctgctgaacgtggtgctgaagagccagcccctggtgcccagagagaacatcaccgcctggatgaacgccatcggcctgatcatcaccgccctgcccgagccctactggatcgtgctgcacgacagaatcgtgagcgtgatcagcagccccagcctgaccagcgagaccgagtgggtgggctaccccttcagactgttcgacttcaccgcctgccaccagagctacagcgagatgagctgcagctacaccctggccctggcccacgccgtgtggcaccacagcagcatcggccagctgagcctgatccccaagttcctgaccgaggtgctgctgcccatcgtgaagaccgagttccagctgctgtacgtgtaccacctggtgggccccttcctgcagagattccagcaggagagaaccagatgcatgatcgagatcggcgtggccttctacgacatgctgctgaacgtggaccagtgcagcacccacctgaactacatggaccccatctgcgacttcctgtaccacatgaagtacatgttcaccggcgacagcgtgaaggagcaggtgaagaagatcatctgcaacctgaagcccgccctgaagctgagactgagattcatcacccacatcagcaagatggagcccgccgccgtgcccccccaggccatgaacagcggcagccccgccccccagagcaaccaggtgcccgtgagcctgcccgtgacccagtag

SEQ ID NO: 88239 - DNA, 4095 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggccatgagaagccacgagggcaacgaggcccaggtgtgctacttcatcatccagctgctgctgctgaagcccaacgacttcagaaacagagtgagcgacttcgtgaaggagaacagccccgagcactggctgcagaacgactggcacaccaagcacatgaactaccacaagaagtaccccgagaagctgtacttcgagggcctggccgagcaggtggacccccccgtgcagatccagagcccctacctgcccatctacttcggcaacgtgtgcctgagattcctgcccgtgttcgacatcgtgatccacagattcctggagctgctgcccgtgagcaagagcctggagaccctgctggaccacctgggcggcctgtacaagttccacgacagacccgtgacctacctgtacaacaccctgcactactacgagatgcacctgagagacagagccttcctgaagagaaagctggtgcacgccatcatcggcagcctgaaggacaacagaccccagggctggtgcctgagcgacacctacctgaagtgcgccatgaacgccagagaggagaacccctgggtgcccgacgacacctactactgcagactgatcggcagactggtggacaccatggccggcaagagccccggccccttccccaactgcgactggagattcaacgagttccccaaccccgccgcccacgccctgcacgtgacctgcgtggagctgatggccctggccgtgagcggcaaggaggtgggcaacgccctgctgaacgtggtgctgaagagccagcccctggtgcccagagagaacatcaccgcctggatgaacgccatcggcctgatcatcaccgccctgcccgagccctactggatcgtgctgcacgacagaatcgtgagcgtgatcagcagccccagcctgaccagcgagaccgagtgggtgggctaccccttcagactgttcgacttcaccgcctgccaccagagctacagcgagatgagctgcagctacaccctggccctggcccacgccgtgtggcaccacagcagcatcggccagctgagcctgatccccaagttcctgaccgaggtgctgctgcccatcgtgaagaccgagttccagctgctgtacgtgtaccacctggtgggccccttcctgcagagattccagcaggagagaaccagatgcatgatcgagatcggcgtggccttctacgacatgctgctgaacgtggaccagtgcagcacccacctgaactacatggaccccatctgcgacttcctgtaccacatgaagtacatgttcaccggcgacagcgtgaaggagcaggtggagaagatcatctgcaacctgaagcccgccctgaagctgagactgagattcatcacccacatcagcaagatggagcccgccgccgtgcccccccaggccatgaacagcggcagccccgccccccagagcaaccaggtggacaccctgacctag

SEQ ID NO: 88240 - DNA, 4107 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggccatgagaagccacgagggcaacgaggcccaggtgtgctacttcatcatccagctgctgctgctgaagcccaacgacttcagaaacagagtgagcgacttcgtgaaggagaacagccccgagcactggctgcagaacgactggcacaccaagcacatgaactaccacaagaagtaccccgagaagctgtacttcgagggcctggccgagcaggtggacccccccgtgcagatccagagcccctacctgcccatctacttcggcaacgtgtgcctgagattcctgcccgtgttcgacatcgtgatccacagattcctggagctgctgcccgtgagcaagagcctggagaccctgctggaccacctgggcggcctgtacaagttccacgacagacccgtgacctacctgtacaacaccctgcactactacgagatgcacctgagagacagagccttcctgaagagaaagctggtgcacgccatcatcggcagcctgaaggacaacagaccccagggctggtgcctgagcgacacctacctgaagtgcgccatgaacgccagagaggagaacccctgggtgcccgacgacacctactactgcagactgatcggcagactggtggacaccatggccggcaagagccccggccccttccccaactgcgactggagattcaacgagttccccaaccccgccgcccacgccctgcacgtgacctgcgtggagctgatggccctggccgtgagcggcaaggaggtgggcaacgccctgctgaacgtggtgctgaagagccagcccctggtgcccagagagaacatcaccgcctggatgaacgccatcggcctgatcatcaccgccctgcccgagccctactggatcgtgctgcacgacagaatcgtgagcgtgatcagcagccccagcctgaccagcgagaccgagtgggtgggctaccccttcagactgttcgacttcaccgcctgccaccagagctacagcgagatgagctgcagctacaccctggccctggcccacgccgtgtggcaccacagcagcatcggccagctgagcctgatccccaagttcctgaccgaggtgctgctgcccatcgtgaagaccgagttccagctgctgtacgtgtaccacctggtgggccccttcctgcagagattccagcaggagagaaccagatgcatgatcgagatcggcgtggccttctacgacatgctgctgaacgtggaccagtgcagcacccacctgaactacatggaccccatctgcgacttcctgtaccacatgaagtacatgttcaccggcgacagcgtgaaggagcaggtggagaagatcatctgcaacctgaagcccgccctgaagctgagactgagattcatcacccacatcagcaagatggagcccgccgccgtgcccccccaggccatgaacagcggcagccccgccccccagagcaaccaggtgcccgtgagcctgcccgtgacccagtag

SEQ ID NO: 88241 - DNA, 4125 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagctgatcagcgccctgcagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggccatgagaagccacgagggcaacgaggcccaggtgtgctacttcatcatccagctgctgctgctgaagcccaacgacttcagaaacagagtgagcgacttcgtgaaggagaacagccccgagcactggctgcagaacgactggcacaccaagcacatgaactaccacaagaagtaccccgagaagctgtacttcgagggcctggccgagcaggtggacccccccgtgcagatccagagcccctacctgcccatctacttcggcaacgtgtgcctgagattcctgcccgtgttcgacatcgtgatccacagattcctggagctgctgcccgtgagcaagagcctggagaccctgctggaccacctgggcggcctgtacaagttccacgacagacccgtgacctacctgtacaacaccctgcactactacgagatgcacctgagagacagagccttcctgaagagaaagctggtgcacgccatcatcggcagcctgaaggacaacagaccccagggctggtgcctgagcgacacctacctgaagtgcgccatgaacgccagagaggagaacccctgggtgcccgacgacacctactactgcagactgatcggcagactggtggacaccatggccggcaagagccccggccccttccccaactgcgactggagattcaacgagttccccaaccccgccgcccacgccctgcacgtgacctgcgtggagctgatggccctggccgtgagcggcaaggaggtgggcaacgccctgctgaacgtggtgctgaagagccagcccctggtgcccagagagaacatcaccgcctggatgaacgccatcggcctgatcatcaccgccctgcccgagccctactggatcgtgctgcacgacagaatcgtgagcgtgatcagcagccccagcctgaccagcgagaccgagtgggtgggctaccccttcagactgttcgacttcaccgcctgccaccagagctacagcgagatgagctgcagctacaccctggccctggcccacgccgtgtggcaccacagcagcatcggccagctgagcctgatccccaagttcctgaccgaggtgctgctgcccatcgtgaagaccgagttccagctgctgtacgtgtaccacctggtgggccccttcctgcagagattccagcaggagagaaccagatgcatgatcgagatcggcgtggccttctacgacatgctgctgaacgtggaccagtgcagcacccacctgaactacatggaccccatctgcgacttcctgtaccacatgaagtacatgttcaccggcgacagcgtgaaggagcaggtggagaagatcatctgcaacctgaagcccgccctgaagctgagactgagattcatcacccacatcagcaagatggagcccgccgccgtgcccccccaggccatgaacagcggcagccccgccccccagagcaaccaggtgcccgtgagcctgcccgtgacccagtag

SEQ ID NO: 88242 - DNA, 114 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagagcagcaagtag

SEQ ID NO: 88243 - DNA, 132 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgttcatggagatggagctgtag

SEQ ID NO: 88244 - DNA, 1428 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagagcgccttcgccaactgcttccagatcacctgcatgggcgacctgacccacaccccctag

SEQ ID NO: 88245 - DNA, 429 bp, Artificial Sequence
  Description of Artificial Sequence: Synthetic coding sequence
atgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcagaccctgctgatcctgggcgagctggccctgagaaagacctag

SEQ ID NO: 88246 - DNA, 2661 bp, Artificial Sequence
  Description of Artificial Sequence: Synthetic coding sequence
atggagacccagctgcagagcatcttcgaggaggtggtgaagaccgaggtgatcgaggaggccttccccggcatgttcatggacacccccgaggacgagaagaccaagctgatcagctgcctgggcgccttcagacagttctggggcggcctgagccaggagagccacgagcagtgcatccagtggatcgtgaagttcatccacggccagcacagccccaagagaatcagcttcctgtacgactgcctggccatggccgtggagaccggcctgctgccccccagactggtgtgcgagagcctgatcaacagcgacaccctggagtgggagagaacccagctgtgggccctgaccttcaagctggtgagaaagatcatcggcggcgtggactacaagggcgtgagagacctgctgaaggtgatcctggagaagatcctgaccatccccaacaccgtgagcagcgccgtggtgcagcagctgctggccgccagagaggtgatcgcctacatcctggagagaaacgcctgcctgctgcccgcctacttcgccgtgaccgagatcagaaagctgtaccccgagggcaagctgccccactggctgctgggcaacctggtgagcgacttcgtggacaccttcagacccaccgccagaatcaacagcatctgcggcagatgcagcctgctgcccgtggtgaacaacagcggcgccatctgcaacagctggaagctggaccccgccaccctgagattccccctgaagggcctgctgccctacgacaaggacctgttcgagccccagaccgccctgctgagatacgtgctggagcagccctacagcagagacatggtgtgcaacatgctgggcctgaacaagcaggtgctgaagatcttcaagcacaagcagagatgccccgtgctggaggaccagctggtggacctggtggtgtacgccatggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagctggccggcagaggcctgatcaagggcagagaccacctgatgtgggtgctgctgcagttcatcagcggcagcatccagaagaacgccctggccgacttcctgcccgtgatgaagctgttcgacctgctgtaccccgagaaggagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggtgagaatcaacaccttcctgagcctgttcagctag

SEQ ID NO: 88247 - DNA, 3030 bp, Artificial Sequence
  Description of Artificial Sequence: Synthetic coding sequence
atggagagaagcgagaccgaggagaagttcgacgacggcggcaccagccagctgctgtggcagcacctgagcagccagctgatcttcttcgtgctgttccagttcgccagcttcccccacatggtgctgagcctgcaccagaagtacatccccgtgcccgacatcaacaagccccagagcacccacgccttcgccatgacctgcatctggatccacctgaacagaaaggcccagaacgacaacagcaagctgcagatccccatcccccacagcctgagactgcaccacgagttcctgcagcagagcctgagaaacaagagcctgcagatgaacgactacaagatcgccctgctgtgcaacgcctacagcaccaacagcgagtgcttcaccctgcccatgggcgccctggtggagaccatctacggcaacggcatcatgagaatccccctgcccggcaccaactgcatggccagcggcagcatcacccccctgcccatgaacctgctggacagcctgaccgtgcacgccaagatgagcctgatccacagcatcgccaccagagtgatcaagctggcccacgccaagagcagcgtggccctggcccccgccctggtggagacctacagcagactgctggtgtacatggagatcgagagcctgggcatcaagggcttcatcagccagctgctgcccaccgtgttcaagagccacgcctggggcatcctgcacaccctgctggagatgttcagctacagaatgcaccacatccagccccactacagagtgcagctgctgagccacctgcacaccctggccgccgtggcccagaccaaccagaaccagctgcacctgtgcgtggagagcaccgccctgagactgatcaccgccctgggcagcagcgaggtgcagccccagttcaccagattcctgagcgaccccaagaccgtgctgagcgccgagagcgaggagctgaacagagccctgatcctgaccctggccagagccacccacgtgaccgacttcttcaccggcagcgacagcatccagggcacctggtgcaaggacatcctgcagaccatcatgagcttcaccccccacaactgggccagccacaccctgagctgcttccccggccccctgcaggccttcttcaagcagaacaacgtgccccaggagagcagattcaacctgaagaagaacgtggaggaggagtacagaaagtggaagagcatgagcaacgagaacgacatcatcacccacttcagcatgcagggcagcccccccctgttcctgtgcctgctgtggaagatgctgctggagaccgaccacatcaaccagatcggctacagagtgctggagagaatcggcgccagagccctggtggcccacgtgagaaccttcgccgacttcctggtgtacgagttcagcaccagcgccggcggccagcagctgaacaagtgcatcgagatcctgaacgacatggtgtggaagtacaacatcgtgaccctggacagactgatcctgtgcctggccatgagaagccacgagggcaacgaggcccaggtgtgctacttcatcatccagctgctgctgctgaagcccaacgacttcagaaacagagtgagcgacttcgtgaaggagaacagccccgagcactggctgcagaacgactggcacaccaagcacatgaactaccacaagaagtaccccgagaagctgtacttcgagggcctggccgagcaggtggacccccccgtgcagatccagagcccctacctgcccatctacttcggcaacgtgtgcctgagattcctgcccgtgttcgacatcgtgatccacagattcctggagctgctgcccgtgagcaagagcctggagaccctgctggaccacctgggcggcctgtacaagttccacgacagacccgtgacctacctgtacaacaccctgcactactacgagatgcacctgagagacagagccttcctgaagagaaagctggtgcacgccatcatcggcagcctgaaggacaacagaccccagggctggtgcctgagcgacacctacctgaagtgcgccatgaacgccagagaggagaacccctgggtgcccgacgacacctactactgcagactgatcggcagactggtggacaccatggccggcaagagccccggccccttccccaactgcgactggagattcaacgagttccccaaccccgccgcccacgccctgcacgtgacctgcgtggagctgatggccctggccgtgagcggcaaggaggtgggcaacgccctgctgaacgtggtgctgaagagccagcccctggtgcccagagagaacatcaccgcctggatgaacgccatcggcctgatcatcaccgccctgcccgagccctactggatcgtgctgcacgacagaatcgtgagcgtgatcagcagccccagcctgaccagcgagaccgagtgggtgggctaccccttcagactgttcgacttcaccgcctgccaccagagctacagcgagatgagctgcagctacaccctggccctggcccacgccgtgtggcaccacagcagcatcggccagctgagcctgatccccaagttcctgaccgaggtgctgctgcccatcgtgaagaccgagttccagctgctgtacgtgtaccacctggtgggccccttcctgcagagattccagcaggagagaaccagatgcatgatcgagatcggcgtggccttctacgacatgctgctgaacgtggaccagtgcagcacccacctgaactacatggaccccatctgcgacttcctgtaccacatgaagtacatgttcaccggcgacagcgtgaaggagcaggtggagaagatcatctgcaacctgaagcccgccctgaagctgagactgagattcatcacccacatcagcaagatggagcccgccgccgtgcccccccaggccatgaacagcggcagccccgccccccagagcaaccaggtgcccgtgagcctgcccgtgacccagtag

SEQ ID NO: 88248 - DNA, 2970 bp, Artificial Sequence
  Description of Artificial Sequence: Synthetic coding sequence
atgaaggtggtgaacctgaagcaggccatcctgcaggcctggaaggagagatggagcgactaccagtgggccatcaacatgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcagcaagttcgacgacttcagcagagacctgtgcgtgcaggccctgctggacatcatggacatgttctgcgacagactgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcgtgctggagatctggaaggcctgcttcgtgggcctgatcgagagccccgagggcaccgaggagctgaagtggaccgccttcaccttcctgaagatcccccaggtgctggtgaagctgaagaagtacagccacggcgacaaggacttcaccgaggacgtgaactgcgccttcgagttcctgctgaagctgacccccctgctggacaaggccgaccagagatgcaactgcgactgcaccaacttcctgctgcaggagtgcggcaagcagggcctgctgagcgaggccagcgtgaacaacctgatggccaagagaaaggccgacagagagcacgccccccagcagaagagcggcgagaacgccaacatccagcccaacatccagctgatcctgagagccgagcccaccgtgaccaacatcctgaagaccatggacgccgaccacagcaagagccccgagggcctgctgggcgtgctgggccacatgctgagcggcaagagcctggacctgctgctggccgccgccgccgccaccggcaagctgaagagcttcgccagaaagttcatcaacctgaacgagttcaccacctacggcagcgaggagagcaccaagcccgccagcgtgagagccctgctgttcgacatcagcttcctgatgctgtgccacgtggcccagacctacggcagcgaggtgatcctgagcgagagcagaaccggcgccgaggtgcccttcttcgagacctggatgcagacctgcatgcccgaggagggcaagatcctgaaccccgaccacccctgcttcagacccgacagcaccaaggtggagagcctggtggccctgctgaacaacagcagcgagatgaagctggtgcagatgaagtggcacgaggcctgcctgagcatcagcgccgccatcctggagatcctgaacgcctgggagaacggcgtgctggccttcgagagcatccagaagatcaccgacaacatcaagggcaaggtgtgcagcctggccgtgtgcgccgtggcctggctggtggcccacgtgagaatgctgggcctggacgagagagagaagagcctgcagatgatcagacagctggccggccccctgttcagcgagaacaccctgcagttctacaacgagagagtggtgatcatgaacagcatcctggagagaatgtgcgccgacgtgctgcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgaccctggtgctgctgggccacatcctgcccggcctgctgaccgacagcagcaagtggcacagcctgatggacccccccggcaccgccctggccaagctggccgtgtggtgcgccctgagcagctacagcagccacaagggccaggccagcaccagacagaagaagagacacagagaggacatcgaggactacatcagcctgttccccctggacgacgtgcagcccagcaagctgatgagactgctgagcagcaacgaggacgacgccaacatcctgagcagccccaccgacagaagcatgagcagcagcctgagcgccagccagctgcacaccgtgaacatgagagaccccctgaacagagtgctggccaacctgttcctgctgatcagcagcatcctgggcagcagaaccgccggcccccacacccagttcgtgcagtggttcatggaggagtgcgtggactgcctggagcagggcggcagaggcagcgtgctgcagttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88249 - DNA, 2970 bp, Artificial Sequence; identical to SEQ ID NO: 88248
  Description of Artificial Sequence: Synthetic coding sequence

SEQ ID NO: 88250 - DNA, 2931 bp, Artificial Sequence
  Description of Artificial Sequence: Synthetic coding sequence
atgaaggtggtgaacctgaagcaggccatcctgcaggcctggaaggagagatggagcgactaccagtgggccatcaacatgaagaagttcttccccaagggcgccacctgggacatcctgaacctggccgacgccctgctggagcaggccatgatcggccccagccccaaccccctgatcctgagctacctgaagtacgccatcagcagccagttcgacgacttcagcagagacctgtgcgtgcaggccctgctggacatcatggacatgttctgcgacagactgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcgtgctggagatctggaaggcctgcttcgtgggcctgatcgagagccccgagggcaccgaggagctgaagtggaccgccttcaccttcctgaagatcccccaggtgctggtgaagctgaagaagtacagccacggcgacaaggacttcaccgaggacgtgaactgcgccttcgagttcctgctgaagctgacccccctgctggacaaggccgaccagagatgcaactgcgactgcaccaacttcctgctgcaggagtgcggcaagcagggcctgctgagcgaggccagcgtgaacaacctgatggccaagagaaaggccgacagagagcacgccccccagcagaagagcggcgagaacgccaacatccagcccaacatccagctgatcctgagagccgagcccaccgtgaccaacatcctgaagaccatggacgccgaccacagcaagagccccgagggcctgctgggcgtgctgggccacatgctgagcggcaagagcctggacctgctgctggccgccgccgccgccaccggcaagctgaagagcttcgccagaaagttcatcaacctgaacgagttcaccacctacggcagcgaggagagcaccaagcccgccagcgtgagagccctgctgttcgacatcagcttcctgatgctgtgccacgtggcccagacctacggcagcgaggtgatcctgagcgagagcagaaccggcgccgaggtgcccttcttcgagacctggatgcagacctgcatgcccgaggagggcaagatcctgaaccccgaccacccctgcttcagacccgacagcaccaaggtggagagcctggtggccctgctgaacaacagcagcgagatgaagctggtgcagatgaagtggcacgaggcctgcctgagcatcagcgccgccatcctggagatcctgaacgcctgggagaacggcgtgctggccttcgagagcatccagaagatcaccgacaacatcaagggcaaggtgtgcagcctggccgtgtgcgccgtggcctggctggtggcccacgtgagaatgctgggcctggacgagagagagaagagcctgcagatgatcagacagctggccggccccctgttcagcgagaacaccctgcagttctacaacgagagagtggtgatcatgaacagcatcctggagagaatgtgcgccgacgtgctgcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgaccctggtgctgctgggccacatcctgcccggcctgctgaccgacagcagcaagtggcacagcctgatggacccccccggcaccgccctggccaagctggccgtgtggtgcgccctgagcagctacagcagccacaagggccaggccagcaccagacagaagaagagacacagagaggacatcgaggactacatcagcctgttccccctggacgacgtgcagcccagcaagctgatgagactgctgagcagcaacgaggacgacgccaacatcctgagcagccccaccgacagaagcatgagcagcagcctgagcgccagccagctgcacaccgtgaacatgagagaccccctgaacagagtgctggccaacctgttcctgctgatcagcagcatcctgggcagcagaaccgccggcccccacacccagttcgtgcagtggttcatggaggagtgcgtggactgcctggagcagggcggcagaggcagcgtgctgcagttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88251 - DNA, 2970 bp, Artificial Sequence; identical to SEQ ID NO: 88248
  Description of Artificial Sequence: Synthetic coding sequence

SEQ ID NO: 88252 - DNA, 864 bp, Artificial Sequence
  Description of Artificial Sequence: Synthetic coding sequence
tgaaacctgatcaaggagctgctgaaggagaccagaaaggagcacaccctgagagccgtggagctgctgtacagcatcttctgcctggacatgcagcaggtgaccctggtgctgctgggccacatcctgcccggcctgctgaccgacagcagcaagtggcacagcctgatggacccccccggcaccgccctggccaagctggccgtgtggtgcgccctgagcagctacagcagccacaagggccaggccagcaccagacagaagaagagacacagagaggacatcgaggactacatcagcctgttccccctggacgacgtgcagcccagcaagctgatgagactgctgagcagcaacgaggacgacgccaacatcctgagcagccccagaagcagcctgggcagcccctgcaccagctacctgagatgggtgaaggtgggcctgggccaccccagaggcgcccccctgctgcacagcgccggctgcttccccgccctgcacctgctgagacccaccgccgacagaagcatgagcagcagcctgagcgccagccagctgcacaccgtgaacatgagagaccccctgaacagagtgctggccaacctgttcctgctgatcagcagcatcctgggcagcagaaccgccggcccccacacccagttcgtgcagtggttcatggaggagtgcgtggactgcctggagcagggcggcagaggcagcgtgctgcagttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88253 - DNA, 906 bp, Artificial Sequence
  Description of Artificial Sequence: Synthetic coding sequence
atgaaggtggtgaacctgaagcaggccatcctgcaggcctggaaggagagatggagcgactaccagtgggccatcaacatgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcagcaagttcgacgacttcagcagagacctgtgcgtgcaggccctgctggacatcatggacatgttctgcgacagactgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcctgcacaccagccagggcctgggccagggcggcaccagagccaaccagcccaccgccagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcgtgtag

SEQ ID NO: 88254 - DNA, 2700 bp, Artificial Sequence
  Description of Artificial Sequence: Synthetic coding sequence
atgcccctggtgcccagatggtgccccaccctgctgagcagccagcccagcgtgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcgtgctggagatctggaaggcctgcttcgtgggcctgatcgagagccccgagggcaccgaggagctgaagtggaccgccttcaccttcctgaagatcccccaggtgctggtgaagctgaagaagtacagccacggcgacaaggacttcaccgaggacgtgaactgcgccttcgagttcctgctgaagctgacccccctgctggacaaggccgaccagagatgcaactgcgactgcaccaacttcctgctgcaggagtgcggcaagcagggcctgctgagcgaggccagcgtgaacaacctgatggccaagagaaaggccgacagagagcacgccccccagcagaagagcggcgagaacgccaacatccagcccaacatccagctgatcctgagagccgagcccaccgtgaccaacatcctgaagaccatggacgccgaccacagcaagagccccgagggcctgctgggcgtgctgggccacatgctgagcggcaagagcctggacctgctgctggccgccgccgccgccaccggcaagctgaagagcttcgccagaaagttcatcaacctgaacgagttcaccacctacggcagcgaggagagcaccaagcccgccagcgtgagagccctgctgttcgacatcagcttcctgatgctgtgccacgtggcccagacctacggcagcgaggtgatcctgagcgagagcagaaccggcgccgaggtgcccttcttcgagacctggatgcagacctgcatgcccgaggagggcaagatcctgaaccccgaccacccctgcttcagacccgacagcaccaaggtggagagcctggtggccctgctgaacaacagcagcgagatgaagctggtgcagatgaagtggcacgaggcctgcctgagcatcagcgccgccatcctggagatcctgaacgcctgggagaacggcgtgctggccttcgagagcatccagaagatcaccgacaacatcaagggcaaggtgtgcagcctggccgtgtgcgccgtggcctggctggtggcccacgtgagaatgctgggcctggacgagagagagaagagcctgcagatgatcagacagctggccggccccctgttcagcgagaacaccctgcagttctacaacgagagagtggtgatcatgaacagcatcctggagagaatgtgcgccgacgtgctgcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgaccctggtgctgctgggccacatcctgcccggcctgctgaccgacagcagcaagtggcacagcctgatggacccccccggcaccgccctggccaagctggccgtgtggtgcgccctgagcagctacagcagccacaagggccaggccagcaccagacagaagaagagacacagagaggacatcgaggactacatcagcctgttccccctggacgacgtgcagcccagcaagctgatgagactgctgagcagcaacgaggacgacgccaacatcctgagcagccccaccgacagaagcatgagcagcagcctgagcgccagccagctgcacaccgtgaacatgagagaccccctgaacagagtgctggccaacctgttcctgctgatcagcagcatcctgggcagcagaaccgccggcccccacacccagttcgtgcagtggttcatggaggagtgcgtggactgcctggagcagggcggcagaggcagcgtgctgcagttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88255 - DNA, 756 bp, Artificial Sequence
  Description of Artificial Sequence: Synthetic coding sequence
atgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcatggagatcctgaacgcctgggagaacggcgtgctggccttcgagagcatccagaagatcaccgacaacatcaagggcaaggtgtgcagcctggccgtgtgcgccgtggcctggctggtggcccacgtgagaatgctgggcctggacgagagagagaagagcctgcagatgatcagacagctggccggccccctgttcagcgagaacaccctgcagttctacaacgagagagtggtgatcatgaacagcatcctggagagaatgtgcgccgacgtgctgcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgacctag

SEQ ID NO: 88256 - DNA, 2466 bp, Artificial Sequence
  Description of Artificial Sequence: Synthetic coding sequence
atgatcggccccagccccaaccccctgatcctgagctacctgaagtacgccatcagcagccagatggtgagctacagcagcgtgctgaccgccatcagcaagttcgacgacttcagcagagacctgtgcgtgcaggccctgctggacatcatggacatgttctgcgacagactgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcgtgctggagatctggaaggcctgcttcgtgggcctgatcgagagccccgagggcaccgaggagctgaagtggaccgccttcaccttcctgaagatcccccaggtgctggtgaagctgaagaagtacagccacggcgacaaggacttcaccgaggacgtgaactgcgccttcgagttcctgctgaagctgacccccctgctggacaaggccgaccagagatgcaactgcgactgcaccaacttcctgctgcaggagtgcggcaagcagggcctgctgagcgaggccagcgtgaacaacctgatggccaagagaaaggccgacagagagcacgccccccagcagaagagcggcgagaacgccaacatccagcccaacatccagctgatcctgagagccgagcccaccgtgaccaacatcctgaagaccatggacgccgaccacagcaagagccccgagggcctgctgggcgtgctgggccacatgctgagcggcaagagcctggacctgctgctggccgccgccgccgccaccggcaagctgaagagcttcgccagaaagttcatcaacctgaacgagttcaccacctacggcagcgaggagagcaccaagcccgccagcgtgagagccctgctgttcgacatcagcttcctgatgctgtgccacgtggcccagacctacggcagcgaggtgatcctgagcgagagcagaaccggcgccgaggtgcccttcttcgagacctggatgcagacctgcatgcccgaggagggcaagatcctgaaccccgaccacccctgcttcagacccgacagcaccaaggtggagagcctggtggccctgctgaacaacagcagcgagatgaagctggtgcagatgaagtggcacgaggcctgcctgagcatcagcgccgccatcctggagatcctgaacgcctgggagaacggcgtgctggccttcgagagcatccagaagatcaccgacaacatcaagggcaaggtgtgcagcctggccgtgtgcgccgtggcctggctggtggcccacgtgagaatgctgggcctggacgagagagagaagagcctgcagatgatcagacagctggccggccccctgttcagcgagaacaccctgcagttctacaacgagagagtggtgatcatgaacagcatcctggagagaatgtgcgccgacgtgctgcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgaccctggtgctgctgggccacatcctgcccggcctgctgaccgacagcagcaagtggcacagcctgatggacccccccggcaccgccctggccaagctggccgtgtggtgcgccctgagcagctacagcagccacaagggccaggccagcaccagacagaagaagagacacagagaggacatcgaggactacatcagccccaaggtggtgctggccatcaccgacctgagcctgcccctgggcagacaggtggccgccaaggccatcgccgccctgtag

SEQ ID NO: 88257 - DNA, 1026 bp, Artificial Sequence
  Description of Artificial Sequence: Synthetic coding sequence
atgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcagcaagttcgacgacttcagcagagacctgtgcgtgcaggccctgctggacatcatggacatgttctgcgacagactgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgacctag

SEQ ID NO: 88258 - DNA, 2796 bp, Artificial Sequence
  Description of Artificial Sequence: Synthetic coding sequence
atgaaggtggtgaacctgaagcaggccatcctgcaggcctggaaggagagatggagcgactaccagtgggccatcaacatgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcatgtgcctgcagagactggagaagaccctgagcagcaccaagaacagagccctgctgcacatcgccaagctggaggaggccagcctgcacaccagccagggcctgggccagggcggcaccagagccaaccagcccaccgccagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcgtgctggagatctggaaggcctgcttcgtgggcctgatcgagagccccgagggcaccgaggagctgaagtggaccgccttcaccttcctgaagatcccccaggtgctggtgaagctgaagaagtacagccacggcgacaaggacttcaccgaggacgtgaactgcgccttcgagttcctgctgaagctgacccccctgctggacaaggccgaccagagatgcaactgcgactgcaccaacttcctgctgcaggagtgcggcaagcagggcctgctgagcgaggccagcgtgaacaacctgatggccaagagaaaggccgacagagagcacgccccccagcagaagagcggcgagaacgccaacatccagcccaacatccagctgatcctgagagccgagcccaccgtgaccaacatcctgaagaccatggacgccgaccacagcaagagccccgagggcctgctgggcgtgctgggccacatgctgagcggcaagagcctggacctgctgctggccgccgccgccgccaccggcaagctgaagagcttcgccagaaagttcatcaacctgaacgagttcaccacctacggcagcgaggagagcaccaagcccgccagcgtgagagccctgctgttcgacatcagcttcctgatgctgtgccacgtggcccagacctacggcagcgaggtgatcctgagcgagagcagaaccggcgccgaggtgcccttcttcgagacctggatgcagacctgcatgcccgaggagggcaagatcctgaaccccgaccacccctgcttcagacccgacagcaccaaggtggagagcctggtggccctgctgaacaacagcagcgagatgaagctggtgcagatgaagtggcacgaggcctgcctgagcatcagcgccgccatcctggagatcctgaacgcctgggagaacggcgtgctggccttcgagagcatccagaagatcaccgacaacatcaagggcaaggtgtgcagcctggccgtgtgcgccgtggcctggctggtggcccacgtgagaatgctgggcctggacgagagagagaagagcctgcagatgatcagacagctggccggccccctgttcagcgagaacaccctgcagttctacaacgagagagtggtgatcatgaacagcatcctggagagaatgtgcgccgacgtgctgcagcagaccgccacccagatcaagttccccagcaccggcgtggacaccatgccctactggaacctgctgccccccaagagacccatcaaggaggtgctgaccgacatcttcgccaaggtgctggagaagggctgggtggacagcagaagcatccacatcttcgacaccctgctgcacatgggcggcgtgtactggttctgcaacaacctgatcaaggagctgctgaaggagaccagaaaggagcacaccctgagagccgtggagctgctgtacagcatcttctgcctggacatgcagcaggtgaccctggtgctgctgggccacatcctgcccggcctgctgaccgacagcagcaagtggcacagcctgatggacccccccggcaccgccctggccaagctggccgtgtggtgcgccctgagcagctacagcagccacaagggccaggccagcaccagacagaagaagagacacagagaggacatcgaggactacatcagcctgttccccctggacgacgtgcagcccagcaagctgatgagactgctgagcagcaacgaggacgacgccaacatcctgagcagccccaccgacagaagcatgagcagcagcctgagcgccagccagctgcacaccgtgaacatgagagaccccctgaacagagtgctggccaacctgttcctgctgatcagcagcatcctgggcagcagaaccgccggcccccacacccagttcgtgcagtggttcatggaggagtgcgtggactgcctggagcagggcggcagaggcagcgtgctgcagttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88259 - DNA, 444 bp, Artificial Sequence
  Description of Artificial Sequence: Synthetic coding sequence
atgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcagcaagttcgacgacttcagcagagacctgtgcgtgcaggccctgctggacatcatggacatgttctgcgacagactgagctgccacggcaaggccgaggagtgcatcggcctgtgcagagccctgctgagcgccctgcacttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88260 - DNA, 921 bp, Artificial Sequence
  Description of Artificial Sequence: Synthetic coding sequence
atgaagaagttcttccccaagggcgccacctgggacatcctgaacctggccgacgccctgctggagcaggccatgatcggccccagccccaaccccctgatcctgagctacctgaagtacgccatcagcagccagatggtgagctacagcagcgtgctgaccgccatcagcaagttcgacgacttcagcagagacctgtgcgtgcaggccctgctggacatcatggacatgttctgcgacagactgagctgccacggcaaggccgaggagtgcatcggcctgtgcagagccctgctgagcgccctgcactggctgctgagatgcaccgccgccagcgccgagagactgagagagggcctggaggccggcacccccgccgccggcgagaagcagctggccatgtgcctgcagagactggagaagaccctgagcagcaccaagaacagagccctgctgcacatcgccaagctggaggaggccagcagctggaccgccatcgagcacagcctgctgaagctgggcgagatcctggccaacctgagcaacccccagctgagaagccaggccgagcagtgcggcaccctgatcagaagcatccccaccatgctgagcgtgcacgccgagcagatgcacaagaccggcttccccaccgtgcacgccgtgatcctgctggagggcaccatgaacctgaccggcgagacccagagcctggtggagcagctgaccatggtgaagagaatgcagcacatccccacccccctgttcggcagaggcagcgtgctgcagttcatgcccttcaccaccgtgagcgagctggtgaaggtgagcgccatgagcagccccaaggtggtgctggccatcaccgacctgagcctgcccctgggcagacaggtggccgccaaggccatcgccgccctgtag

SEQ ID NO: 88261 - DNA, 2244 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgccccccccgccctgctggagcccctgcagccccccaccgacgtgagccaggaccccagacacatggtgctggtgagaggcctggtgctgcccgtgggcggcggcagcgcccccggccccctgcagagcaagcagcccgtgcccctgccccccgccgcccccagcggcgccaccctgagcgccgccccccagcagcccctgccccccgtgcccccccagtaccaggtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccacctgcagccccccggcgcccccgccctgctgccccccccccaccagggcctgggccagccccagctgggcccccccctgctgcaccccccccccgcccagagctggcccgcccagctgccccccagagcccccctgcccggccagatgctgctgagcggcggccccagaggccccgtgccccagcccggcctgcagcccagcgtgatggaggacgacatcctgatggacctgatctag

SEQ ID NO: 88262 - DNA, 2268 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgccccccccgccctgctggagcccctgcagccccccaccgacgtgagccaggaccccagacacatggtgctggtgagaggcctggtgctgcccgtgggcggcggcagcgcccccggccccctgcagagcaagcagcccgtgcccctgccccccgccgcccccagcggcgccaccctgagcgccgccccccagcagcccctgccccccgtgcccccccagtaccaggtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccaccacctgcccagccccggcccccacaacttccccctgggcctgcactgccaggtgagaggccccggcggcggccagagaagcggcctgagcgtgcccgccgcccccggcctggagcaccaggacagagtgctgctgggcagcaaggacatcggcagcaagaacgagggcagccccatcagagcctgcagccccgccagctggagaaccaccagcagctggatcagcagcgagagccccacccccaacaaggtgcccttctag

SEQ ID NO: 88263 - DNA, 2349 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgccccccccgccctgctggagcccctgcagccccccaccgacgtgagccaggaccccagacacatggtgctggtgagaggcctggtgctgcccgtgggcggcggcagcgcccccggccccctgcagagcaagcagcccgtgcccctgccccccgccgcccccagcggcgccaccctgagcgccgccccccagcagcccctgccccccgtgcccccccagtaccaggtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccacctgcagccccccggcgcccccgccctgctgccccccccccaccagggcctgggccagccccagctgggcccccccctgctgcaccccccccccgcccagagctggcccgcccagctgccccccagagcccccctgcccgccgccaagagaaagagagagggcgagggcagagtgttcagagagaagtgggagagagcctacttcttcgtggaggtgaagagcatgcccatgtgcctgatctgcaagcagatcgtgagcgtgctgaaggagtacaacctgaagagacactacgagagcaagcacagcaagagctacgaccagtacaccgagcagaccagatag

SEQ ID NO: 88264 - DNA, 1449 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgcccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccacctgcagccccccggcgcccccgccctgctgccccccccccaccagggcctgggccagccccagctgggcccccccctgctgcaccccccccccgcccagagctggcccgcccagctgccccccagagcccccctgcccggccagatgctgctgagcggcggccccagaggccccgtgccccagcccggcctgcagcccagcgtgatggaggacgacatcctgatggacctgatctag

SEQ ID NO: 88265 - DNA, 2385 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgccccccccgccctgctggagcccctgcagccccccaccgacgtgagccaggaccccagacacatggtgctggtgagaggcctggtgctgcccgtgggcggcggcagcgcccccggccccctgcagagcaagcagcccgtgcccctgccccccgccgcccccagcggcgccaccctgagcgccgccccccagcagcccctgccccccgtgcccccccagtaccaggtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccacctgcagccccccggcgcccccgccctgctgccccccccccaccagggcctgggccagccccagctgggcccccccctgctgcaccccccccccgacggcgccagaagaagcgacgccgccgagagaggcagccccggccccggcagaagcccccagagcccccccctgcccctgggcttccccgtgagacagagagtgaccgccttccacgtgagcatcaccagcggcaagaccaaggagagaagaagaggcccctgcgtgagcagaaagatgggcgccagcctgttcctgtgcggcagcgaggagcacgcctacgtgttcaacatgcagaccaacagagtgtgcgtggagagaatccagcccgagacccccctgtag

SEQ ID NO: 88266 - DNA, 2175 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgccccccccgccctgctggagcccctgcagccccccaccgacgtgagccaggaccccagacacatggtgctggtgagaggcctggtgctgcccgtgggcggcggcagcgcccccggccccctgcagagcaagcagcccgtgcccctgccccccgccgcccccagcggcgccaccctgagcgccgccccccagcagcccctgccccccgtgcccccccagtaccaggtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccacctgcagccccccggcgcccccgccctgctgccccccccccaccagggcctgggccagccccagctgggcccccccctgctgcaccccccccccgcccagagctggcccgcccagctgccccccagagcccccctgcccggcaagggcaccagaggcagagccgaggtgtggaccgagtgccccagcagcagctgggccagagcccccagacccagcgcccccggcaagtag

SEQ ID NO: 88267 - DNA, 753 bp, Artificial Sequence
  Description of Artificial Sequence: Synthetic coding sequence
atgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcttcggccccagaaccctgggccccaccctgagctgcgaggccagcagcagcacccaccacagaagaagactgggctgcccccaccccagaccccccagcaccaccagcagccaccagggcctgctgagatgctgcctgagaagacagggcctgggccagccccagctgggcccccacagctgcatccaccacctgcccagccccggcccccacaacttccccctgggcctgcactgccaggtgagaggccccggcggcggccagagaagcggcctgagcgtgcccgccgcccccggcctggagcaccaggacagagtgctgctgggcagcaaggacatcggcagcaagaacgagggcagccccatggccttcgccgagctgtag

SEQ ID NO: 88268 - DNA, 1605 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgacgtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgccccccagctgccccccggcccccccggcgcccccaagcccccccccgccagccagcccagcctggtgagcaccgtggcccccggcagcggcctggcccccaccgcccagcccggcgcccccagcatggccggcaccgtggcccccggcggcgtgagcggccccagccccgcccagctgggcgcccccgccctgggcggccagcagagcgtgagcaacaagctgctggcctggagcggcgtgctggagtggcaggagaagcccaagcccgccagcgtggacgccaacaccaagctgaccagaagcctgccctgccaggtgtacgtgaaccacggcgagaacctgaagaccgagcagtggccccagaagctgatcatgcagctgatcccccagcagctgctgaccaccctgggccccctgttcagaaacagcagaatggtgcagttccacttcaccaacaaggacctggagagcctgaagggcctgtacagaatcatgggcaacggcttcgccggctgcgtgcacttcccccacaccgccccctgcgaggtgagagtgctgatgctgctgtacagcagcaagaagaagatcttcatgggcctgatcccctacgaccagagcggcttcgtgaacggcatcagacaggtgatcaccaaccacaagcaggtgcagcagcagaagctggagcagcagcagagaggcatgggcggccagcaggccccccccggcctgggccccatcctggaggaccaggccagacccagccagaacctgctgcagctgagacccccccagccccagccccagggcaccgtgggcgccagcggcgccaccggccagccccagccccagggcaccgcccagcccccccccggcgccccccagggcccccccggcgccgccagcggcccccccccccccggccccatcctgagaccccagaaccccggcgccaacccccagctgagaagcctgctgctgaaccccccccccccccagaccggcgtgccccccccccaggccagcctgcaccacctgcagccccccggcgcccccgccctgctgccccccccccaccagggcctgggccagccccagctgggcccccccctgctgcaccccccccccgcccagagctggcccgcccagctgccccccagagcccccctgcccggccagatgctgctgagcggcggccccagaggccccgtgccccagcccggcctgcagcccagcgtgatggaggacgacatcctgatggacctgatctag

SEQ ID NO: 88269 - DNA, 1194 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgccccccccgccctgctggagcccctgcagccccccaccgacgtgagccaggaccccagacacatggtgctggtgagaggcctggtgctgcccgtgggcggcggcagcgcccccggccccctgcagagcaagcagcccgtgcccctgccccccgccgcccccagcggcgccaccctgagcgccgccccccagcagcccctgccccccgtgcccccccagtaccaggtgcccggcaacctgagcgccgcccaggtggccgcccagaacgccgtggaggccgccaagaaccagaaggccggcctgggccccagattcagccccatcacccccctgcagcaggccgcccccggcgtgggcccccccttcagccaggcccccgcccccgccctgctgccccccccccaccagggcctgggccagccccagctgggcccccccctgctgcaccccccccccgcccagagctggcccgcccagctgccccccagagcccccctgcccggccagatgctgctgagcggcggccccagaggccccgtgccccagcccggcctgcagcccagcgtgatggaggacgacatcctgatggacctgatctag

SEQ ID NO: 88270 - DNA, 780 bp, Artificial Sequence
  Description of Artificial Sequence: Synthetic coding sequence
atggtgcccggcagcgagggccccgccagagccggcagcgtggtggccgacgtggtgttcgtgatcgagggcaccgccaacctgggcccctacttcgagggcctgagaaagcactacctgctgcccgccatcgagtacttcaacggcggcccccccgccgagaccgacttcggcggcgactacggcggcacccagtacagcctggtggtgttcaacaccgtggactgcgcccccgagagctacgtgcagtgccacgcccccaccagcagcgcctacgagttcgtgacctggctggacggcatcaagttcatgggcggcggcggcgagagctgcagcctgatcgccgagggcctgagcaccgccctgcagctgttcgacgacttcaagaagatgagagagcagatcggccagacccacagagtgtgcctgctgatctgcaacagccccccctacctgctgcccgccgtggagagcaccacctacagcggctgcaccaccgagaacctggtgcagcagatcggcgagagaggcatccacttcagcatcgtgagccccagaaagctgcccgccctgagactgctgttcgagaaggccgcccccggcctggccggcgccgccgccgccagcgacagatgcgagcccggccccgaggcccacggcgccggcagcggcaccagagccgcctgctggggctggctgagccccagacccccccccgtgaaggccgccagcccccccgccagcagaagaaccctgagatgccaggtgagatgctgctag

SEQ ID NO: 88271 - DNA, 1803 bp, Artificial Sequence
  Description of Artificial Sequence: Synthetic coding sequence
atgaccgccgcccccgccagcccccagcagatcagagacagactgctgcaggccatcgacccccagagcaacatcagaaacatggtggccgtgctggaggtgatcagcagcctggagaagtaccccatcaccaaggaggccctggaggagaccagactgggcaagctgatcaacgacgtgagaaagaagaccaagaacgaggagctggccaagagagccaagaagctgctgagaagctggcagaagctgatcgagcccgcccaccagcacgaggccgccctgagaggcctggccggcgccaccggcagcgccaacggcggcgcccacaactgcagacccgaggtgggcgccgccggcccccccagaagcatccacgacctgaagagcagaaacgacctgcagagactgcccggccagagactggacagactgggcagcagaaagagaagaggcgaccagagagacctgggccaccccggccccccccccaaggtgagcaaggccagccacgaccccctggtgcccaacagcagccccctgcccaccaacggcatcagcggcagccccgagagcttcgccagcagcctggacggcagcggccacgccggccccgagggcagcagactggagagagacgagaacgacaagcacagcggcaagatccccgtgaacgccgtgagaccccacaccagcagccccggcctgggcaagccccccggcccctgcctgcagcccaaggccagcgtgctgcagcagctggacagagtggacgagacccccggccccccccaccccaagggcccccccagatgcagcttcagccccagaaacagcagacacgagggcagcttcgccagacagcagagcctgtacgcccccaagggcagcgtgcccagccccagccccagaccccaggccctggacgccacccaggtgcccagccccctgcccctggcccagcccagcaccccccccgtgagaagactggagctgctgcccagcgccgagagccccgtgtgctggctggagcagcccgagagccaccagagactggccggccccggctgcaaggccggcctgagccccgccgagcccctgctgagcagagccggcttcagccccgacagcagcaaggccgacagcgacgccgccagcagcggcggcagcgacagcaagaagaagaagagatacagacccagagactacaccgtgaacctggacggccaggtggccgaggccggcgtgaagcccgtgagactgaaggagagaaagctgaccttcgaccccatgaccagacagatcaagcccctgacccagaaggagcccgtgagagccgacagccccgtgcacatggagcagcagagcagaaccgagctggacaagcaggaggccaaggccagcctgcagagccccttcgagcagaccaactggaaggagctgagcagaaacgagatcatccagagctacctgagcagacagagcagcctgctgagcagcagcggcgcccagacccccggcgcccaccacttcatgagcgagtacctgaagcaggaggagagcaccagacagggcgccagacagctgcacgtgctggtgccccagagcccccccaccgacctgcccggcctgaccagagaggtgacccaggacgacctggacagaatccaggccagccagtggcccggcgtgaacggctgccaggacacccagggcaactggtacgactggacccagtgcatcagcctggacccccacggcgacgacggcagactgaacatcctgccctacgtgtgcctggactag

SEQ ID NO: 88272 - DNA, 282 bp, Artificial Sequence
  Description of Artificial Sequence: Synthetic coding sequence
atgaccgccgcccccgccagcccccagcagatcagagacagactgctgcaggccatcgacccccagagcaacatcagaaacatggtggccgtgctggaggtgatcagcagcctggagaagtaccccatcaccaaggaggccctggaggagaccagactgggcaagctgatcaacgacgtgagaaagaagaccaagaacgaggagctggccaagagagccaagaagctgctgcccggctggcagtgggcctgcagacccagaggccagccccccggcgcctag

SEQ ID NO: 88273 - DNA, 936 bp, Artificial Sequence
  Description of Artificial Sequence: Synthetic coding sequence
atggccgacgtgatcaacgtgagcgtgaacctggaggccttcagccaggccatcagcgccatccaggccctgagaagcagcgtgagcagagtgttcgactgcctgaaggacggcatgagaaacaaggagaccctggagggcagagagaaggccttcatcgcccacttccaggacaacctgcacagcgtgaacagagacctgaacgagctggagagactgagcaacctggtgggcaagcccagcgagaaccaccccctgcacaacagcggcctgctgagcctggaccccgtgcaggacaagacccccctgtacagccagctgctgcaggcctacaagtggagcaacaagctgcagtaccacgccggcctggccagcggcctgctgaaccagcagagcctgaagagaagcgccaaccagatgggcgtgagcgccaagagaagacccaaggcccagcccaccaccctggtgctgcccccccagtacgtggacgacgtgatcagcagaatcgacagaatgttccccgagatgagcatccacctgagcagacccaacggcaccagcgccatgctgctggtgaccctgggcaaggtgctgaaggtgatcgtggtgatgagaagcctgttcatcgacagaaccatcgtgaagggctacaacgagaacgtgtacaccgaggacggcaagctggacatctggagcaagagcaactaccaggtgttccagaaggtgaccgaccacgccaccaccgccctgctgcactaccagctgccccagatgcccgacgtggtggtgagaagcttcatgacctggctgagaagctacatcaagctgttccaggccccctgccagagatgcggcaagttcctgcaggacggcctgccccccacctggagagacttcagaaccctggaggccttccacgacacctgcagacagtag

SEQ ID NO: 88274 - DNA, 714 bp, Artificial Sequence
  Description of Artificial Sequence: Synthetic coding sequence
atgagaaacaaggagaccctggagggcagagagaaggccttcatcgcccacttccaggacaacctgcacagcgtgaacagagacctgaacgagctggagagactgagcaacctggtgggcaagcccagcgagaaccaccccctgcacaacagcggcctgctgagcctggaccccgtgcaggacaagacccccctgtacagccagctgctgcaggcctacaagtggagcaacaagctgcagtaccacgccggcctggccagcggcctgctgaaccagcagagcctgaagagaagcgccaaccagatgggcgtgagcgccaagagaagacccaaggcccagcccaccaccctggtgctgcccccccagtacgtggacgacgtgatcagcagaatcgacagaatgttccccgagatgagcatccacctgagcagacccaacggcaccagcgccatgctgctgctggacatctggagcaagagcaactaccaggtgttccagaaggtgaccgaccacgccaccaccgccctgctgcactaccagctgccccagatgcccgacgtggtggtgagaagcttcatgacctggctgagaagctacatcaagctgttccaggccccctgccagagatgcggcaagttcctgcaggacggcctgccccccacctggagagacttcagaaccctggaggccttccacgacacctgcagacagtag

SEQ ID NO: 88275 - DNA, 828 bp, Artificial Sequence
  Description of Artificial Sequence: Synthetic coding sequence
atggccgacgtgatcaacgtgagcgtgaacctggaggccttcagccaggccatcagcgccatccaggccctgagaagcagcgtgagcagagtgttcgactgcctgaaggacggcatgagaaacaaggagaccctggagggcagagagaaggccttcatcgcccacttccaggacaacctgcacagcgtgaacagagacctgaacgagctggagagactgagcaacctggtgggcaagcccagcgagaaccaccccctgcacaacagcggcctgctgagcctggaccccgtgcaggacaagacccccctgtacagccagctgctgcaggcctacaagtggagcaacaagctgcagtaccacgccggcctggccagcggcctgctgaaccagcagagcctgaagagaagcgccaaccagatgggcgtgagcgccaagagaagacccaaggcccagcccaccaccctggtgctgcccccccagtacgtggacgacgtgatcagcagaatcgacagaatgttccccgagatgagcatccacctgagcagacccaacggcaccagcgccatgctgctgctggacatctggagcaagagcaactaccaggtgttccagaaggtgaccgaccacgccaccaccgccctgctgcactaccagctgccccagatgcccgacgtggtggtgagaagcttcatgacctggctgagaagctacatcaagctgttccaggccccctgccagagatgcggcaagttcctgcaggacggcctgccccccacctggagagacttcagaaccctggaggccttccacgacacctgcagacagtag

SEQ ID NO: 88276 - DNA, 666 bp, Artificial Sequence
  Description of Artificial Sequence: Synthetic coding sequence
atgctgaagagcaacggcgagagaagaagcagaaacgccctgcccgccgtgtacgccagaaagatggccgccagccagcagcaggccagcgccgccagcagcgccgccggcgtgagcggccccagcagcgccggcggccccggcccccagcagcagccccagccccccgcccagctggtgggccccgcccagagcggcctgctgcagcagcagcagcaggacttcgaccccgtgcagagatacaagatgctgatcccccagctgaaggagagcctgcagaccctgatgaaggtggccgcccagaacctgatccagaacaccaacatcgacaacggccagaagagcagcgacggccccatccagagattcgacaagtgcctggaggagttctacgccctgtgcgaccagctggagctgtgcctgagactggcccacgagtgcctgagccagagctgcgacagcgccaagcacagccccaccctggtgcccaccgccaccaagcccgacgccgtgcagcccgacagcctgccctacccccagtacctggccgtgatcaaggcccagatcagctgcgccaaggacatccacaccgccctgctggactgcgccaacaaggtgaccggcaagacccccgccccccccgccggccccggcggcaccctgtag

SEQ ID NO: 88277 - DNA, 420 bp, Artificial Sequence
  Description of Artificial Sequence: Synthetic coding sequence
atgctgatcccccagctgaaggagagcctgcagaccctgatgaaggtggccgcccagaacctgatccagaacaccaacatcgacaacggccagaagagcagcgacggccccatccagagattcgacaagtgcctggaggagttctacgccctgtgcgaccagctggagctgtgcctgagactggcccacgagtgcctgagccagagctgcgacagcgccaagcacagccccaccctggtgcccaccgccaccaagcccgacgccgtgcagcccgacagcctgccctacccccagtacctggccgtgatcaaggcccagatcagctgcgccaaggacatccacaccgccctgctggactgcgccaacaaggtgaccggcaagacccccgccccccccgccggccccggcggcaccctgtag

SEQ ID NO: 88278 - DNA, 537 bp, Artificial Sequence
  Description of Artificial Sequence: Synthetic coding sequence
atgagcaccccccccctggccgccagcggcatggcccccggccccttcgccggcccccaggcccagcaggccgccagagaggtgaacaccgccagcctgtgcagaatcggccaggagaccgtgcaggacatcgtgtacagaaccatggagatcttccagctgctgagaaacatgcagctgcccaacggcgtgacctaccacaccggcacctaccaggacagactgaccaagctgcaggacaacctgagacagctgagcgtgctgttcagaaagctgagactggtgtacgacaagtgcaacgagaactgcggcggcatggaccccatccccgtggagcagctgatcccctacgtggaggaggacggcagcaagaacgacgacagagccggcccccccagattcgccagcgaggagagaagagagatcgccgaggtgaacaagaagctgaagcagaagaaccagcagctgaagcagatcatggaccagctgagaaacctgatctgggacatcaacgccatgctggccatgagaaactag

SEQ ID NO: 88279 - DNA, 813 bp, Artificial Sequence
  Description of Artificial Sequence: Synthetic coding sequence
atggccgccagcagcagcggcgagaaggagaaggagagactgggcggcggcctgggcgtggccggcggcaacagcaccagagagagactgctgagcgccctggaggacctggaggtgctgagcagagagctgatcgagatgctggccatcagcagaaaccagaagctgctgcaggccggcgaggagaaccaggtgctggagctgctgatccacagagacggcgagttccaggagctgatgaagctggccctgaaccagggcaagatccaccacgagatgcaggtgctggagaaggaggtggagaagagagacagcgacatccagcagctgcagaagcagctgaaggaggccgagcagatcctggccaccgccgtgtaccaggccaaggagaagctgaagagcatcgagaaggccagaaagggcgccatcagcagcgaggagatcatcaagtacgcccacagaatcagcgccagcaacgccgtgtgcgcccccctgacctgggtgcccggcgaccccagaagaccctaccccaccgacctggagatgagaagcggcctgctgggccagatgaacaaccccagcaccaacggcgtgaacggccacctgcccggcgacgccctggccgccggcagactgcccgacgtgctggccccccagtacccctggcagagcaacgacatgagcatgaacatgctgccccccaaccacagcagcgacttcctgctggagccccccggccacaacaaggagaacgaggacgacgtggagatcatgagcaccgacagcagcagcagcagcagcgagagcgactag

SEQ ID NO: 88280 - DNA, 675 bp, Artificial Sequence
  Description of Artificial Sequence: Synthetic coding sequence
atgctggccatcagcagaaaccagaagctgctgcaggccggcgaggagaaccaggtgctggagctgctgatccacagagacggcgagttccaggagctgatgaagctggccctgaaccagggcaagatccaccacgagatgcaggtgctggagaaggaggtggagaagagagacagcgacatccagcagctgcagaagcagctgaaggaggccgagcagatcctggccaccgccgtgtaccaggccaaggagaagctgaagagcatcgagaaggccagaaagggcgccatcagcagcgaggagatcatcaagtacgcccacagaatcagcgccagcaacgccgtgtgcgcccccctgacctgggtgcccggcgaccccagaagaccctaccccaccgacctggagatgagaagcggcctgctgggccagatgaacaaccccagcaccaacggcgtgaacggccacctgcccggcgacgccctggccgccggcagactgcccgacgtgctggccccccagtacccctggcagagcaacgacatgagcatgaacatgctgccccccaaccacagcagcgacttcctgctggagccccccggccacaacaaggagaacgaggacgacgtggagatcatgagcaccgacagcagcagcagcagcagcgagagcgactag

SEQ ID NO: 88281 - DNA, 747 bp, Artificial Sequence
  Description of Artificial Sequence: Synthetic coding sequence
atgaagctgctgtggtggtgcgactggctgcccgagagaagccacgtgttcacccagagagagctgatcgagatgctggccatcagcagaaaccagaagctgctgcaggccggcgaggagaaccaggtgctggagctgctgatccacagagacggcgagttccaggagctgatgaagctggccctgaaccagggcaagatccaccacgagatgcaggtgctggagaaggaggtggagaagagagacagcgacatccagcagctgcagaagcagctgaaggaggccgagcagatcctggccaccgccgtgtaccaggccaaggagaagctgaagagcatcgagaaggccagaaagggcgccatcagcagcgaggagatcatcaagtacgcccacagaatcagcgccagcaacgccgtgtgcgcccccctgacctgggtgcccggcgaccccagaagaccctaccccaccgacctggagatgagaagcggcctgctgggccagatgaacaaccccagcaccaacggcgtgaacggccacctgcccggcgacgccctggccgccggcagactgcccgacgtgctggccccccagtacccctggcagagcaacgacatgagcatgaacatgctgccccccaaccacagcagcgacttcctgctggagccccccggccacaacaaggagaacgaggacgacgtggagatcatgagcaccgacagcagcagcagcagcagcgagagcgactag

SEQ ID NO: 88282 - DNA, 717 bp, Artificial Sequence
  Description of Artificial Sequence: Synthetic coding sequence
atgaagctgctgtggtggtgcgactggctgcccgagagaagccacgtgttcacccagagagagctgatcgagatgctggccatcagcagaaaccagaagctgctgcaggccggcgaggagaaccaggtgctggagctgctgatccacagagacggcgagttccaggagctgatgaagctggccctgaaccagggcaagatccaccacgagatgcaggtgctggagaaggaggtggagaagagagacagcgacatccagcagctgcagaagcagctgaaggaggccgagcagatcctggccaccgccgtgtaccaggccaaggagaagctgaagagcatcgagaaggccagaaagggcgccatcagcagcgaggagatcatcaagtacgcccacagaatcagcgccagcaacgccgtgtgcgcccccctgacctgggtgcccggcgaccccagaagaccctaccccaccgacctggagatgagaagcggcctgctgggccagatgaacaaccccagcaccaacggcgtgaacggccacctgcccggcgacgccctggccgccggcagactgcccgacgtgctggccccccagtacccctggcagagcaacgacatgagcatgaacatgctgccccccaaccacagcagcgacttcctgctggagccccccggccacaacaaggagaacgaggacgacgtggagatcatgagcacctag

SEQ ID NO: 88283 - DNA, 702 bp, Artificial Sequence
  Description of Artificial Sequence: Synthetic coding sequence
atgggcgagccccagcaggtgagcgccctgccccccccccccatgcagtacatcaaggagtacaccgacgagaacatccaggagggcctggcccccaagccccccccccccatcaaggacagctacatgatgttcggcaaccagttccagtgcgacgacctgatcatcagacccctggagagccagggcatcgagagactgcaccccatgcagttcgaccacaagaaggagctgagaaagctgaacatgagcatcctgatcaacttcctggacctgctggacatcctgatcagaagccccggcagcatcaagagagaggagaagctggaggacctgaagctgctgttcgtgcacgtgcaccacctgatcaacgagtacagaccccaccaggccagagagaccctgagagtgatgatggaggtgcagaagagacagagactggagaccgccgagagattccagaagcacctggagagagtgatcgagatgatccagaactgcctggccagcctgcccgacgacctgccccacagcgaggccggcatgagagtgaagaccgagcccatggacgccgacgacagcaacaactgcaccggccagaacgagcaccagagagagaacagcggccacagaagagaccagatcatcgagaaggacgccgccctgtgcgtgctgatcgacgagatgaacgagagaccctag

SEQ ID NO: 88284 - DNA, 702 bp, Artificial Sequence; identical to SEQ ID NO: 88283
  Description of Artificial Sequence: Synthetic coding sequence

SEQ ID NO: 88285 - DNA, 588 bp, Artificial Sequence
  Description of Artificial Sequence: Synthetic coding sequence
atgggcgagccccagcaggtgagcgccctgccccccccccccatgcagtacatcaaggagtacaccgacgagaacatccaggagggcctggcccccaagccccccccccccatcaaggacagctacatgatgttcggcaaccagttccagtgcgacgacctgatcatcagacccctggagagccagggcatcgagagactgcaccccatgcagttcgaccacaagaaggagctgagaaagctgaacatgagcatcctgatcaacttcctggacctgctggacatcctgatcagaagccccggcagcatcaagagagaggagaagctggaggacctgaagctgctgttcgtgcacgtgcaccacctgatcaacgagtacagaccccaccaggccagagagaccctgagagtgatgatggaggtgcagaagagacagagactggagaccgccgagagattccagaagcacctggagagagtgatcgagatgatccagaactgcctggccagcctgcccgacgacctgccccacagcgaggccggcatgagagtgaagaccgagcccatggacgccgacgacagcaactag

SEQ ID NO: 88286 - DNA, 441 bp, Artificial Sequence
  Description of Artificial Sequence: Synthetic coding sequence
atggccagcgccggcgtggccgccggcagacaggccgaggacgtgctgccccccaccagcgaccagcccctgcccgacaccaagcccctgccccccccccagcccccccccgtgcccgccccccagccccagcagagccccgcccccagaccccagagccccgccagagccagagaggaggagaactacagcttcctgcccctggtgcacaacatcatcaagtgcatggacaaggacagccccgaggtgcaccaggacctgaacgccctgaagagcaagttccaggagatgagaaagctgatcagcaccatgcccggcatccacctgagccccgagcagcagcagcagcagctgcagagcctgagagagcaggtgagaaccaagaacgagctgctgcagaagtacaagagcctgtgcatgttcgagatccccaaggagtag

SEQ ID NO: 88287 - DNA, 894 bp, Artificial Sequence
  Description of Artificial Sequence: Synthetic coding sequence
atgagcaacagagtggtgtgcagagaggccagccacgccggcagctggtacaccgccagcggcccccagctgaacgcccagctggagggctggctgagccaggtgcagagcaccaagagacccgccagagccatcatcgccccccacgccggctacacctactgcggcagctgcgccgcccacgcctacaagcaggtggaccccagcatcaccagaagaatcttcatcctgggccccagccaccacgtgcccctgagcagatgcgccctgagcagcgtggacatctacagaacccccctgtacgacctgagaatcgaccagaagatctacggcgagctgtggaagaccggcatgttcgagagaatgagcctgcagaccgacgaggacgagcacagcatcgagatgcacctgccctacaccgccaaggccatggagagccacaaggacgagttcaccatcatccccgtgctggtgggcgccctgagcgagagcaaggagcaggagttcggcaagctgttcagcaagtacctggccgaccccagcaacctgttcgtggtgagcagcgacttctgccactggggccagagattcagatacagctactacgacgagagccagggcgagatctacagaagcatcgagcacctggacaagatgggcatgagcatcatcgagcagctggaccccgtgagcttcagcaactacctgaagaagtaccacaacaccatctgcggcagacaccccatcggcgtgctgctgaacgccatcaccgagctgcagaagaacggcatgaacatgagcttcagcttcctgaactacgcccagagcagccagtgcagaaactggcaggacagcagcgtgagctacgccgccggcgccctgaccgtgcactag

SEQ ID NO: 88288 - DNA, 903 bp, Artificial Sequence
  Description of Artificial Sequence: Synthetic coding sequence
atgcccctgtggagagccgacaagtgccaggacgtgcagagcgccagctggagacccagaagagccgacggcccccagctgaacgcccagctggagggctggctgagccaggtgcagagcaccaagagacccgccagagccatcatcgccccccacgccggctacacctactgcggcagctgcgccgcccacgcctacaagcaggtggaccccagcatcaccagaagaatcttcatcctgggccccagccaccacgtgcccctgagcagatgcgccctgagcagcgtggacatctacagaacccccctgtacgacctgagaatcgaccagaagatctacggcgagctgtggaagaccggcatgttcgagagaatgagcctgcagaccgacgaggacgagcacagcatcgagatgcacctgccctacaccgccaaggccatggagagccacaaggacgagttcaccatcatccccgtgctggtgggcgccctgagcgagagcaaggagcaggagttcggcaagctgttcagcaagtacctggccgaccccagcaacctgttcgtggtgagcagcgacttctgccactggggccagagattcagatacagctactacgacgagagccagggcgagatctacagaagcatcgagcacctggacaagatgggcatgagcatcatcgagcagctggaccccgtgagcttcagcaactacctgaagaagtaccacaacaccatctgcggcagacaccccatcggcgtgctgctgaacgccatcaccgagctgcagaagaacggcatgaacatgagcttcagcttcctgaactacgcccagagcagccagtgcagaaactggcaggacagcagcgtgagctacgccgccggcgccctgaccgtgcactag

SEQ ID NO: 88289 - DNA, 894 bp, Artificial Sequence; identical to SEQ ID NO: 88287
  Description of Artificial Sequence: Synthetic coding sequence

SEQ ID NO: 88290 - DNA, 825 bp, Artificial Sequence
  Description of Artificial Sequence: Synthetic coding sequence
atgagcaacagagtggtgtgcagagaggccagccacgccggcagctggtacaccgccagcggcccccagctgaacgcccagctggagggctggctgagccaggtgcagagcaccaagagacccgccagagccatcatcgcccccagaagaatcttcatcctgggccccagccaccacgtgcccctgagcagatgcgccctgagcagcgtggacatctacagaacccccctgtacgacctgagaatcgaccagaagatctacggcgagctgtggaagaccggcatgttcgagagaatgagcctgcagaccgacgaggacgagcacagcatcgagatgcacctgccctacaccgccaaggccatggagagccacaaggacgagttcaccatcatccccgtgctggtgggcgccctgagcgagagcaaggagcaggagttcggcaagctgttcagcaagtacctggccgaccccagcaacctgttcgtggtgagcagcgacttctgccactggggccagagattcagatacagctactacgacgagagccagggcgagatctacagaagcatcgagcacctggacaagatgggcatgagcatcatcgagcagctggaccccgtgagcttcagcaactacctgaagaagtaccacaacaccatctgcggcagacaccccatcggcgtgctgctgaacgccatcaccgagctgcagaagaacggcatgaacatgagcttcagcttcctgaactacgcccagagcagccagtgcagaaactggcaggacagcagcgtgagctacgccgccggcgccctgaccgtgcactag

SEQ ID NO: 88291 - DNA, 63 bp, Artificial Sequence
  Description of Artificial Sequence: Synthetic coding sequence
atgagcaacagagtggtgtgcagagaggccagccacgccggcagctggtacaccgccagctag

SEQ ID NO: 88292 - DNA, 5478 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagacccccgagaccgtggtgcccaccgcccccgagctgcagatcagcaccagcaccgaccagcccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88293 - DNA, 6270 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcaccctggacgagccctgggaggtgctggccacccagcccttctgcctgagagagagcgaggacagcgagacccagcccttcgacacccacctggaggcctacggcccctgcctgagcccccccagagccatccccggcgaccagcaccccgagagccccgtgcacaccgagcccatgggcatccagggcagaggcagacagaccgtggacaaggtgatgggcatccccaaggagaccgccgagagagtgggccccgagagaggccccctggagagagagaccgagaagctgctgcccgagagacagaccgacgtgaccggcgaggaggagctgaccaagggcaagcaggacagagagcagaagcagctgctggccagagacacccagagacaggagagcgacaagaacggcgagagcgccagccccgagagagacagagagagcctgaaggtggagatcgagaccagcgaggagatccaggagaagcaggtgcagaagcagaccctgcccagcaaggccttcgagagagaggtggagagacccgtggccaacagagagtgcgaccccgccgagctggaggagaaggtgcccaaggtgatcctggagagagacacccagagaggcgagcccgagggcggcagccaggaccagaagggccaggccagcagccccacccccgagcccggcgtgggcgccggcgacctgcccggccccaccagcgcccccgtgcccagcggcagccagagcggcggcagaggcagccccgtgagccccagaagacaccagaagggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagacccccgagaccgtggtgcccaccgcccccgagctgcagatcagcaccagcaccgaccagcccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88294 - DNA, 489 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgtag

SEQ ID NO: 88295 - DNA, 342 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccactag

SEQ ID NO: 88296 - DNA, 384 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtag

SEQ ID NO: 88297 - DNA, 489 bp, Artificial Sequence; identical to SEQ ID NO: 88294
  Description of Artificial Sequence: Synthetic coding sequence

SEQ ID NO: 88298 - DNA, 921 bp, Artificial Sequence
  Description of Artificial Sequence: Synthetic coding sequence
tgacacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgccctag

SEQ ID NO: 88299 - DNA, 384 bp, Artificial Sequence; identical to SEQ ID NO: 88296
  Description of Artificial Sequence: Synthetic coding sequence

SEQ ID NO: 88300 - DNA, 921 bp, Artificial Sequence; identical to SEQ ID NO: 88298
  Description of Artificial Sequence: Synthetic coding sequence

SEQ ID NO: 88301 - DNA, 921 bp, Artificial Sequence; identical to SEQ ID NO: 88298
  Description of Artificial Sequence: Synthetic coding sequence

SEQ ID NO: 88302 - DNA, 6270 bp, Artificial Sequence; identical to SEQ ID NO: 88293
  Description of Artificial Sequence: Synthetic coding sequence

SEQ ID NO: 88303 - DNA, 6270 bp, Artificial Sequence; identical to SEQ ID NO: 88293
  Description of Artificial Sequence: Synthetic coding sequence

SEQ ID NO: 88304 - DNA, 4968 bp, Artificial Sequence
  Description of Artificial Sequence: Synthetic coding sequence
atgtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88305 - DNA, 489 bp, Artificial Sequence; identical to SEQ ID NO: 88294
  Description of Artificial Sequence: Synthetic coding sequence

SEQ ID NO: 88306 - DNA, 342 bp, Artificial Sequence; identical to SEQ ID NO: 88295
  Description of Artificial Sequence: Synthetic coding sequence

SEQ ID NO: 88307 - DNA, 342 bp, Artificial Sequence; identical to SEQ ID NO: 88295
  Description of Artificial Sequence: Synthetic coding sequence

SEQ ID NO: 88308 - DNA, 384 bp, Artificial Sequence; identical to SEQ ID NO: 88296
  Description of Artificial Sequence: Synthetic coding sequence

SEQ ID NO: 88309 - DNA, 489 bp, Artificial Sequence; identical to SEQ ID NO: 88294
  Description of Artificial Sequence: Synthetic coding sequence

SEQ ID NO: 88310 - DNA, 342 bp, Artificial Sequence; identical to SEQ ID NO: 88295
  Description of Artificial Sequence: Synthetic coding sequence

SEQ ID NO: 88311 - DNA, 489 bp, Artificial Sequence; identical to SEQ ID NO: 88294
  Description of Artificial Sequence: Synthetic coding sequence

SEQ ID NO: 88312 - DNA, 384 bp, Artificial Sequence; identical to SEQ ID NO: 88296
  Description of Artificial Sequence: Synthetic coding sequence

SEQ ID NO: 88313 - DNA, 921 bp, Artificial Sequence; identical to SEQ ID NO: 88298
  Description of Artificial Sequence: Synthetic coding sequence

SEQ ID NO: 88314 - DNA, 6270 bp, Artificial Sequence; identical to SEQ ID NO: 88293
  Description of Artificial Sequence: Synthetic coding sequence

SEQ ID NO: 88315 - DNA, 5409 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcaccctggacgagccctgggaggtgctggccacccagcccttctgcctgagagagagcgaggacagcgagacccagcccttcgacacccacctggaggcctacggcccctgcctgagcccccccagagccatccccggcgaccagcaccccgagagccccgtgcacaccgagcccatgggcatccagggcagaggcagacagaccgtggacaaggtgatgggcatccccaaggagaccgccgagagagtgggccccgagagaggccccctggagagagagaccgagaagctgctgcccgagagacagaccgacgtgaccggcgaggaggagctgaccaagggcaagcaggacagagagcagaagcagctgctggccagagacacccagagacaggagagcgacaagaacggcgagagcgccagccccgagagagacagagagagcctgaaggtggagatcgagaccagcgaggagatccaggagaagcaggtgcagaagcagaccctgcccagcaaggccttcgagagagaggtggagagacccgtggccaacagagagtgcgaccccgccgagctggaggagaaggtgcccaaggtgatcctggagagagacacccagagaggcgagcccgagggcggcagccaggaccagaagggccaggccagcagccccacccccgagcccggcgtgggcgccggcgacctgcccggccccaccagcgcccccgtgcccagcggcagccagagcggcggcagaggcagccccgtgagccccagaagacaccagaagggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88316 - DNA, 342 bp, Artificial Sequence; identical to SEQ ID NO: 88295
  Description of Artificial Sequence: Synthetic coding sequence

SEQ ID NO: 88317 - DNA, 6270 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcaccctggacgagccctgggaggtgctggccacccagcccttctgcctgagagagagcgaggacagcgagacccagcccttcgacacccacctggaggcctacggcccctgcctgagcccccccagagccatccccggcgaccagcaccccgagagccccgtgcacaccgagcccatgggcatccagggcagaggcagacagaccgtggacaaggtgatgggcatccccaaggagaccgccgagagagtgggccccgagagaggccccctggagagagagaccgagaagctgctgcccgagagacagaccgacgtgaccggcgaggaggagctgaccaagggcaagcaggacagagagcagaagcagctgctggccagagacacccagagacaggagagcgacaagaacggcgagagcgccagccccgagagagacagagagagcctgaaggtggagatcgagaccagcgaggagatccaggagaagcaggtgcagaagcagaccctgcccagcaaggccttcgagagagaggtggagagacccgtggccaacagagagtgcgaccccgccgagctggaggagaaggtgcccaaggtgatcctggagagagacacccagagaggcgagcccgagggcggcagccaggaccagaagggccaggccagcagccccacccccgagcccggcgtgggcgccggcgacctgcccggccccaccagcgcccccgtgcccagcggcagccagagcggcggcagaggcagccccgtgagccccagaagacaccagaagggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagacccccgagaccgtggtgcccaccgcccccgagctgcagatcagcaccagcaccgaccagcccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgccctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88318 - DNA, 738 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggcctag

SEQ ID NO: 88319 - DNA, 342 bp, Artificial Sequence; identical to SEQ ID NO: 88295
  Description of Artificial Sequence: Synthetic coding sequence

SEQ ID NO: 88320 - DNA, 384 bp, Artificial Sequence; identical to SEQ ID NO: 88296
  Description of Artificial Sequence: Synthetic coding sequence

SEQ ID NO: 88321 - DNA, 6270 bp, Artificial Sequence; identical to SEQ ID NO: 88293
  Description of Artificial Sequence: Synthetic coding sequence

SEQ ID NO: 88322 - DNA, 489 bp, Artificial Sequence; identical to SEQ ID NO: 88294
  Description of Artificial Sequence: Synthetic coding sequence

SEQ ID NO: 88323 - DNA, 921 bp, Artificial Sequence; identical to SEQ ID NO: 88298
  Description of Artificial Sequence: Synthetic coding sequence

SEQ ID NO: 88324 - DNA, 921 bp, Artificial Sequence; identical to SEQ ID NO: 88298
  Description of Artificial Sequence: Synthetic coding sequence

SEQ ID NO: 88325 - DNA, 384 bp, Artificial Sequence; identical to SEQ ID NO: 88296
  Description of Artificial Sequence: Synthetic coding sequence

SEQ ID NO: 88326 - DNA, 921 bp, Artificial Sequence; identical to SEQ ID NO: 88298
  Description of Artificial Sequence: Synthetic coding sequence

SEQ ID NO: 88327 - DNA, 489 bp, Artificial Sequence; identical to SEQ ID NO: 88294
  Description of Artificial Sequence: Synthetic coding sequence

SEQ ID NO: 88328 - DNA, 6270 bp, Artificial Sequence; identical to SEQ ID NO: 88293
  Description of Artificial Sequence: Synthetic coding sequence

SEQ ID NO: 88329 - DNA, 735 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagccccacagaggcggcctgctgagctgccagaagagatgccactgcagaggctag

SEQ ID NO: 88330 - DNA, 384 bp, Artificial Sequence; identical to SEQ ID NO: 88296
  Description of Artificial Sequence: Synthetic coding sequence

SEQ ID NO: 88331 - DNA, 342 bp, Artificial Sequence; identical to SEQ ID NO: 88295
  Description of Artificial Sequence: Synthetic coding sequence

SEQ ID NO: 88332 - DNA, 5409 bp, Artificial Sequence; identical to SEQ ID NO: 88315
  Description of Artificial Sequence: Synthetic coding sequence

SEQ ID NO: 88333 - DNA, 735 bp, Artificial Sequence; identical to SEQ ID NO: 88329
  Description of Artificial Sequence: Synthetic coding sequence

SEQ ID NO: 88334 - DNA, 5409 bp, Artificial Sequence; identical to SEQ ID NO: 88315
  Description of Artificial Sequence: Synthetic coding sequence

SEQ ID NO: 88335 - DNA, 735 bp, Artificial Sequence; identical to SEQ ID NO: 88329
  Description of Artificial Sequence: Synthetic coding sequence

SEQ ID NO: 88336 - DNA, 735 bp, Artificial Sequence; identical to SEQ ID NO: 88329
  Description of Artificial Sequence: Synthetic coding sequence

SEQ ID NO: 88337 - DNA, 738 bp, Artificial Sequence; identical to SEQ ID NO: 88318
  Description of Artificial Sequence: Synthetic coding sequence

SEQ ID NO: 88338 - DNA, 5478 bp, Artificial Sequence; identical to SEQ ID NO: 88292
  Description of Artificial Sequence: Synthetic coding sequence

SEQ ID NO: 88339 - DNA, 738 bp, Artificial Sequence; identical to SEQ ID NO: 88318
  Description of Artificial Sequence: Synthetic coding sequence

SEQ ID NO: 88340 - DNA, 5409 bp, Artificial Sequence; identical to SEQ ID NO: 88315
  Description of Artificial Sequence: Synthetic coding sequence

SEQ ID NO: 88341 - DNA, 738 bp, Artificial Sequence; identical to SEQ ID NO: 88318
  Description of Artificial Sequence: Synthetic coding sequence

SEQ ID NO: 88342 - DNA, 5409 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcaccctggacgagccctgggaggtgctggccacccagcccttctgcctgagagagagcgaggacagcgagacccagcccttcgacacccacctggaggcctacggcccctgcctgagcccccccagagccatccccggcgaccagcaccccgagagccccgtgcacaccgagcccatgggcatccagggcagaggcagacagaccgtggacaaggtgatgggcatccccaaggagaccgccgagagagtgggccccgagagaggccccctggagagagagaccgagaagctgctgcccgagagacagaccgacgtgaccggcgaggaggagctgaccaagggcaagcaggacagagagcagaagcagctgctggccagagacacccagagacaggagagcgacaagaacggcgagagcgccagccccgagagagacagagagagcctgaaggtggagatcgagaccagcgaggagatccaggagaagcaggtgcagaagcagaccctgcccagcaaggccttcgagagagaggtggagagacccgtggccaacagagagtgcgaccccgccgagctggaggagaaggtgcccaaggtgatcctggagagagacacccagagaggcgagcccgagggcggcagccaggaccagaagggccaggccagcagccccacccccgagcccggcgtgggcgccggcgacctgcccggccccaccagcgcccccgtgcccagcggcagccagagcggcggcagaggcagccccgtgagccccagaagacaccagaagggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgccctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88343 - DNA, 5478 bp, Artificial Sequence; identical to SEQ ID NO: 88292
  Description of Artificial Sequence: Synthetic coding sequence

SEQ ID NO: 88344 - DNA, 4968 bp, Artificial Sequence; identical to SEQ ID NO: 88304
  Description of Artificial Sequence: Synthetic coding sequence

SEQ ID NO: 88345 - DNA, 4968 bp, Artificial Sequence
  Description of Artificial Sequence: Synthetic coding sequence
atgtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagagagacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgccctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 88346 - DNA, 666 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagcagcagcctgccccccccccagaccagcctgctgcccctgagcctgagactgagactgctgggcgaggagcagatcgaccccctgagcagactgctgaagcagctgagcccccagcccctgagctacagactgccccccccccagaccagcctgagccccctgagcccccacctgggccccctgggcgaggagaagatcggccccctgagcagacccctgaagcagctgtgcccccagcccctgagcagcagcctgccccccccccagaccaacctgagccccctgagcccccacctgggccccctgggcgccggccagatcggccccctgagcagacccctgaaccagctgagcctgtag

SEQ ID NO: 88347 - DNA, 666 bp, Artificial Sequence; identical to SEQ ID NO: 88346
  Description of Artificial Sequence: Synthetic coding sequence

SEQ ID NO: 88348 - DNA, 738 bp, Artificial Sequence; identical to SEQ ID NO: 88318
  Description of Artificial Sequence: Synthetic coding sequence

SEQ ID NO: 88349 - DNA, 4968 bp, Artificial Sequence; identical to SEQ ID NO: 88304
  Description of Artificial Sequence: Synthetic coding sequence

SEQ ID NO: 88350 - DNA, 5478 bp, Artificial Sequence; identical to SEQ ID NO: 88292
  Description of Artificial Sequence: Synthetic coding sequence

SEQ ID NO: 88351 - DNA, 4968 bp, Artificial Sequence; identical to SEQ ID NO: 88304
  Description of Artificial Sequence: Synthetic coding sequence

SEQ ID NO: 88352 - DNA, 4968 bp, Artificial Sequence; identical to SEQ ID NO: 88304
  Description of Artificial Sequence: Synthetic coding sequence

SEQ ID NO: 88353 - DNA, 735 bp, Artificial Sequence; identical to SEQ ID NO: 88329
  Description of Artificial Sequence: Synthetic coding sequence

SEQ ID NO: 88354 - DNA, 5409 bp, Artificial Sequence; identical to SEQ ID NO: 88315
  Description of Artificial Sequence: Synthetic coding sequence

SEQ ID NO: 88355 - DNA, 4968 bp, Artificial Sequence; identical to SEQ ID NO: 88304
  Description of Artificial Sequence: Synthetic coding sequence

SEQ ID NO: 88356 - DNA, 5409 bp, Artificial Sequence; identical to SEQ ID NO: 88315
  Description of Artificial Sequence: Synthetic coding sequence

SEQ ID NO: 88357 - DNA, 666 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagcagcagcctgccccccccccagaccagcctgctgcccctgagcctgagactgagactgctgggcgaggagcagatcgaccccctgagcagactgctgaagcagctgagcccccagcccctgagctacagactgccccccccccagaccagcctgagccccctgagcccccacctgggccccctgggcgaggagaagatcggccccctgagcagacccctgaagcagctgtgcccccagcccctgagaagcagcctgccccccccccagaccaacctgagccccctgagcccccacctgggccccctgggcgccggccagatcggccccctgagcagacccctgaaccagctgagcctgtag

SEQ ID NO: 88358 - DNA, 666 bp, Artificial Sequence; identical to SEQ ID NO: 88346
  Description of Artificial Sequence: Synthetic coding sequence

SEQ ID NO: 88359 - DNA, 738 bp, Artificial Sequence; identical to SEQ ID NO: 88318
  Description of Artificial Sequence: Synthetic coding sequence

SEQ ID NO: 88360 - DNA, 5478 bp, Artificial Sequence; identical to SEQ ID NO: 88292
  Description of Artificial Sequence: Synthetic coding sequence

SEQ ID NO: 88361 - DNA, 735 bp, Artificial Sequence; identical to SEQ ID NO: 88329
  Description of Artificial Sequence: Synthetic coding sequence

SEQ ID NO: 88362 - DNA, 735 bp, Artificial Sequence; identical to SEQ ID NO: 88329
  Description of Artificial Sequence: Synthetic coding sequence

SEQ ID NO: 88363 - DNA, 666 bp, Artificial Sequence; identical to SEQ ID NO: 88346
  Description of Artificial Sequence: Synthetic coding sequence

SEQ ID NO: 88364 - DNA, 666 bp, Artificial Sequence; identical to SEQ ID NO: 88346
  Description of Artificial Sequence: Synthetic coding sequence

SEQ ID NO: 88365 - DNA, 5478 bp, Artificial Sequence; identical to SEQ ID NO: 88292
  Description of Artificial Sequence: Synthetic coding sequence

SEQ ID NO: 88366 - DNA, 738 bp, Artificial Sequence; identical to SEQ ID NO: 88318
  Description of Artificial Sequence: Synthetic coding sequence

SEQ ID NO: 88367 - DNA, 2238 bp, Artificial Sequence
  Description of Artificial Sequence: Synthetic coding sequence
atggcctgcagacagagaggcggcagctggagccccagcggctggttcaacgccggctggagcacctacagaagcatcagcctgttcttcgccctggtgaccagcggcaacagcatcgacgtgagccagctggtgaaccccgccttccccggcaccgtgacctgcgacgagagagagatcaccgtggagttccccagcagccccggcaccaagaagtggcacgccagcgtggtggaccccctgggcctggacatgcccaactgcacctacatcctggaccccgagaagctgaccctgagagccacctacgacaactgcaccagaagagtgcacggcggccaccagatgaccatcagagtgatgaacaacagcgccgccctgagacacggcgccgtgatgtaccagttcttctgccccgccatgcaggtggaggagacccagggcctgagcgccagcaccatctgccagaaggacttcatgagcttcagcctgcccagagtgttcagcggcctggccgacgacagcaagggcaccaaggtgcagatgggctggagcatcgaggtgggcgacggcgccagagccaagaccctgaccctgcccgaggccatgaaggagggcttcagcctgctgatcgacaaccacagaatgaccttccacgtgcccttcaacgccaccggcgtgacccactacgtgcagggcaacagccacctgtacatggtgagcctgaagctgaccttcatcagccccggccagaaggtgatcttcagcagccaggccatctgcgcccccgaccccgtgacctgcaacgccacccacatgaccctgaccatccccgagttccccggcaagctgaagagcgtgagcttcgagaaccagaacatcgacgtgagccagctgcacgacaacggcatcgacctggaggccaccaacggcatgaagctgcacttcagcaagaccctgctgaagaccaagctgagcgagaagtgcctgctgcaccagttctacctggccagcctgaagctgaccttcctgctgagacccgagaccgtgagcatggtgatctaccccgagtgcctgtgcgagagccccgtgagcatcgtgaccggcgagctgtgcacccaggacggcttcatggacgtggaggtgtacagctaccagacccagcccgccctggacctgggcaccctgagagtgggcaacagcagctgccagcccgtgttcgaggcccagagccagggcctggtgagattccacatccccctgaacggctgcggcaccagatacaagttcgaggacgacaaggtggtgtacgagaacgagatccacgccctgtggaccgacttcccccccagcaagatcagcagagacagcgagttcagaatgaccgtgaagtgcagctacagcagaaacgacatgctgctgaacatcaacgtggagagcctgaccccccccgtggccagcgtgaagctgggccccttcaccctgatcctgcagagctaccccgacaacagctaccagcagccctacggcgagaacgagtaccccctggtgagattcctgagacagcccatctacatggaggtgagagtgctgaacagagacgaccccaacatcaagctggtgctggacgactgctgggccaccagcaccatggaccccgacagcttcccccagtggaacgtggtggtggacggctgcgcctacgacctggacaactaccagaccaccttccaccccgtgggcagcagcgtgacccaccccgaccactaccagagattcgacatgaaggccttcgccttcgtgagcgaggcccacgtgctgagcagcctggtgtacttccactgcagcgccctgatctgcaacagactgagccccgacagccccctgtgcagcgtgacctgccccgtgagcagcagacacagaagagccaccggcgccaccgaggccgagaagatgaccgtgagcctgcccggccccatcctgctgctgagcgacgacagcagcttcagaggcgtgggcagcagcgacctgaaggccagcggcagcagcggcgagaagagcagaagcgagaccggcgaggaggtgggcagcagaggcgccatggacaccaagggccacaagaccgccggcgacgtgggcagcaaggccgtggccgccgtggccgccttcgccggcgtggtggccaccctgggcttcatctactacctgtacgagaagagaaccgtgagcaaccactag

SEQ ID NO: 88368 - DNA, 1806 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccaggacatgggcagctgctacgtggcccaggtgggcctggagctgctgatcagcaacaacccccccatcttcgccagcgagaccgccggcatcaccggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacgtgcccgagctgatcggcgcccaggcccacgccgtgaacgtgatcctggacgccgagaccgcctaccccaacctgatcttcagcgacgacctgaagagcgtgagactgggcaacaagtgggagagactgcccgacggcccccagagattcgacagctgcatcatcgtgctgggcagccccagcttcctgagcggcagaagatactgggaggtggaggtgggcgacaagaccgcctggatcctgggcgcctgcaagaccagcatcagcagaaagggcaacatgaccctgagccccgagaacggctactgggtggtgatcatgatgaaggagaacgagtaccaggccagcagcgtgccccccaccagactgctgatcaaggagccccccaagagagtgggcatcttcgtggactacagagtgggcagcatcagcttctacaacgtgaccgccagaagccacatctacaccttcgccagctgcagcttcagcggccccctgcagcccatcttcagccccggcaccagagacggcggcaagaacaccgcccccctgaccatctgccccgtgggcggccagggccccgactag

SEQ ID NO: 88369 - DNA, 1239 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccagggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacgaccacagcccccagcacggcctgggcagctgggaggagagagactacacccagcacagcatgcagggccccaagcagggcgtgccctgcttcctggtggtgagaaccgtgtag

SEQ ID NO: 88370 - DNA, 1713 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccagggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacgtgcccgagctgatcggcgcccaggcccacgccgtgaacgtgatcctggacgccgagaccgcctaccccaacctgatcttcagcgacgacctgaagagcgtgagactgggcaacaagtgggagagactgcccgacggcccccagagattcgacagctgcatcatcgtgctgggcagccccagcttcctgagcggcagaagatactgggaggtggaggtgggcgacaagaccgcctggatcctgggcgcctgcaagaccagcatcagcagaaagggcaacatgaccctgagccccgagaacggctactgggtggtgatcatgatgaaggagaacgagtaccaggccagcagcgtgccccccaccagactgctgatcaaggagccccccaagagagtgggcatcttcgtggactacagagtgggcagcatcagcttctacaacgtgaccgccagaagccacatctacaccttcgccagctgcagcttcagcggccccctgcagcccatcttcagccccggcaccagagacggcggcaagaacaccgcccccctgaccatctgccccgtgggcggccagggccccgactag

SEQ ID NO: 88371 - DNA, 1209 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccagggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacggcgagagcagcggcaacggcgtgtgctggcccggcgtggtggccgtgttcccctgcgccgtggacctgagaggccccatctag

SEQ ID NO: 88372 - DNA, 1338 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccagggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacgaccacagcccccagcacggcctgggcagctgggaggagagagactacacccagcacagcatgcagggccccaagcagggcgtgccctgcctgagcctgctgagcggccagtgcaacctggcccccctgaacgccaacgcccaggacttcttcccctacctgatcttcctgagaagcagcggcgccgactggagaagcggcacctgctgctag

SEQ ID NO: 88373 - DNA, 2067 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccaggagtacagcacccaggagaacggcaccgacgacagcgccgccagcagcagcctgggcgagaacaagcccagaagcctgaagacccccgaccaccccgagggcaacgagggcaacggccccagaccctacggcggcggcgccgccagcctgagatgcagccagcccgaggccggcagaggcctgagcagaaagcccctgagcaagagaagagagaaggccagcgagggcctggacgcccagggcaagcccagaaccagaagccccgccctgcccggcggcagaagccccggcccctgcagagccctggagggcggccaggccgaggtgagactgagaagaaacgccagcagcgccggcagactgcagggcctggccggcggcgcccccggccagaaggagtgcagacccttcgaggtgtacctgcccagcggcaagatgagacccagaagcctggaggtgaccatcagcaccggcgagaaggcccccgccaaccccgagatcctgctgaccctggaggagaagaccgccgccaacctggacagcgccaccgagcccagagccagacccacccccgacggcggcgccagcgccgacctgaaggagggccccggcaaccccgagcacagcgtgaccggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacgtgcccgagctgatcggcgcccaggcccacgccgtgaacgtgatcctggacgccgagaccgcctaccccaacctgatcttcagcgacgacctgaagagcgtgagactgggcaacaagtgggagagactgcccgacggcccccagagattcgacagctgcatcatcgtgctgggcagccccagcttcctgagcggcagaagatactgggaggtggaggtgggcgacaagagattcagctgcctgagcctgagaagcagctgggactacagaagaccccccccctgccccgccaacttcctgcacttctag

SEQ ID NO: 88374 - DNA, 2796 bp, Artificial Sequence
  Description of Artificial Sequence: Synthetic coding sequence
atgccccccctgaagagccccgccgccttccacgagcagagaagaagcctggagagagccagaaccgaggactacctgaagagaaagatcagaagcagacccgagagaagcgagctggtgagaatgcacatcctggaggagaccagcgccgagcccagcctgcaggccaagcagctgaagctgaagagagccagactggccgacgacctgaacgagaagatcgcccagagacccggccccatggagctggtggagaagaacatcctgcccgtggagagcagcctgaaggaggccatcatcgtgggccaggtgaactaccccaaggtggccgacagcagcagcttcgacgaggacagcagcgacgccctgagccccgagcagcccgccagccacgagagccagggcagcgtgcccagccccctggaggccagagtgagcgagcccctgctgagcgccaccagcgccagccccacccaggtggtgagccagctgcccatgggcagagacagcagagagatgctgttcctggccgagcagccccccctgccccccccccccctgctgccccccagcctgaccaacggcaccaccatccccaccgccaagagcacccccaccctgatcaagcagagccagcccaagagcgccagcgagaagagccagagaagcaagaaggccaaggagctgaagcccaaggtgaagaagctgaagtaccaccagtacatcccccccgaccagaagcaggacagaggcgccccccccatggacagcagctacgccaagatcctgcagcagcagcagctgttcctgcagctgcagatcctgaaccagcagcagcagcagcaccacaactaccaggccatcctgcccgccccccccaagagcgccggcgaggccctgggcagcagcggcaccccccccgtgagaagcctgagcaccaccaacagcagcagcagcagcggcgcccccggcccctgcggcctggccagacagaacagcaccagcctgaccggcaagcccggcgccctgcccgccaacctggacgacatgaaggtggccgagctgaagcaggagctgaagctgagaagcctgcccgtgagcggcaccaagaccgagctgatcgagagactgagagcctaccaggaccagatcagccccgtgcccggcgcccccaaggcccccgccgccaccagcatcctgcacaaggccggcgaggtggtggtggccttccccgccgccagactgagcaccggccccgccctggtggccgccggcctggcccccgccgaggtggtggtggccaccgtggccagcagcggcgtggtgaagttcggcagcaccggcagcaccccccccgtgagccccacccccagcgagagaagcctgctgagcaccggcgacgagaacagcacccccggcgacaccttcggcgagatggtgaccagccccctgacccagctgaccctgcaggccagccccctgcagatcctggtgaaggaggagggccccagagccggcagctgctgcctgagccccggcggcagagccgagctggagggcagagacaaggaccagatgctgcaggagaaggacaagcagatcgaggccctgaccagaatgctgagacagaagcagcagctggtggagagactgaagctgcagctggagcaggagaagagagcccagcagcccgcccccgcccccgcccccctgggcacccccgtgaagcaggagaacagcttcagcagctgccagctgagccagcagcccctgggccccgcccaccccttcaaccccagcctggccgcccccgccaccaaccacatcgacccctgcgccgtggcccccggcccccccagcgtggtggtgaagcaggaggccctgcagcccgagcccgagcccgtgcccgccccccagctgctgctgggcccccagggccccagcctgatcaagggcgtggccccccccaccctgatcaccgacagcaccggcacccacctggtgctgaccgtgaccaacaagaacgccgacagccccggcctgagcagcggcagcccccagcagcccagcagccagcccggcagccccgcccccgcccccagcgcccagatggacctggagcaccccctgcagcccctgttcggcacccccaccagcctgctgaagaaggagccccccggctacgaggaggccatgagccagcagcccaagcagcaggagaacggcagcagcagccagcagatggacgacctgttcgacatcctgatccagagcggcgagatcagcgccgacttcaaggagccccccagcctgcccggcaaggagaagcccagccccaagaccgtgtgcggcagccccctggccgcccagcccagccccagcgccgagctgccccaggccgccccccccccccccggcagccccagcctgcccggcagactggaggacttcctggagagcagcaccggcctgcccctgctgaccagcggccacgacggccccgagcccctgagcctgatcgacgacctgcacagccagatgctgagcagcaccgccatcctggaccacccccccagccccatggacaccagcgagctgcacttcgtgcccgagcccagcagcaccatgggcctggacctggccgacggccacctggacagcatggactggctggagctgagcagcggcggccccgtgctgagcctggcccccctgagcaccaccgcccccagcctgttcagcaccgacttcctggacggccacgacctgcagctgcactgggacagctgcctgtag

SEQ ID NO: 88375 - DNA, 2397 bp, Artificial Sequence
  Description of Artificial Sequence: Synthetic coding sequence
atgccccccctgaagagccccgccgccttccacgagcagagaagaagcctggagagagccagaaccgaggactacctgaagagaaagatcagaagcagacccgagagaagcgagctggtgagaatgcacatcctggaggagaccagcgccgagcccagcctgcaggccaagcagctgaagctgaagagagccagactggccgacgacctgaacgagaagatcgcccagagacccggccccatggagctggtggagaagaacatcctgcccgtggagagcagcctgaaggaggccatcatcgtgggccaggtgaactaccccaaggtggccgacagcagcagcttcgacgaggacagcagcgacgccctgagccccgagcagcccgccagccacgagagccagggcagcgtgcccagccccctggaggccagagtgagcgagcccctgctgagcgccaccagcgccagccccacccaggtggtgagccagctgcccatgggcagagacagcagagagatgctgttcctggccgagcagccccccctgccccccccccccctgctgccccccagcctgaccaacggcaccaccatccccaccgccaagagcacccccaccctgatcaagcagagccagcccaagagcgccagcgagaagagccagagaagcaagaaggccaaggagctgaagcccaaggtgaagaagctgaagtaccaccagtacatcccccccgaccagaagcaggacagaggcgccccccccatggacagcagctacgccaagatcctgcagcagcagcagctgttcctgcagctgcagatcctgaaccagcagcagcagcagcaccacaactaccaggccatcctgcccgccccccccaagagcgccggcgaggccctgggcagcagcggcaccccccccgtgagaagcctgagcaccaccaacagcagcagcagcagcggcgcccccggcccctgcggcctggccagacagaacagcaccagcctgaccggcaagcccggcgccctgcccgccaacctggacgacatgaaggtggccgagctgaagcaggagctgaagctgagaagcctgcccgtgagcggcaccaagaccgagctgatcgagagactgagagcctaccaggaccagatcagccccgtgcccggcgcccccaaggcccccgccgccaccagcatcctgcacaaggccggcgaggtggtggtggccttccccgccgccagactgagcaccggccccgccctggtggccgccggcctggcccccgccgaggtggtggtggccaccgtggccagcagcggcgtggtgaagttcggcagcaccggcagcaccccccccgtgagccccacccccagcgagagaagcctgctgagcaccggcgacgagaacagcacccccggcgacaccttcggcgagatggtgaccagccccctgacccagctgaccctgcaggccagccccctgcagatcctggtgaaggaggagggccccagagccggcagctgctgcctgagccccggcggcagagccgagctggagggcagagacaaggaccagatgctgcaggagaaggacaagcagatcgaggccctgaccagaatgctgagacagaagcagcagctggtggagagactgaagctgcagctggagcaggagaagagagcccagcagcccgcccccgcccccgcccccctgggcacccccgtgaagcaggagaacagcttcagcagctgccagctgagccagcagcccctgggccccgcccaccccttcaaccccagcctggccgcccccgccaccaaccacatcgacccctgcgccgtggcccccggcccccccagcgtggtggtgaagcaggaggccctgcagcccgagcccgagcccgtgcccgccccccagctgctgctgggcccccagggccccagcctgatcaagggcgtggccccccccaccctgatcaccgacagcaccggcacccacctggtgctgaccgtgaccaacaagaacgccgacagccccggcctgagcagcggcagcccccagcagcccagcagccagcccggcagccccgcccccgcccccagcgcccagatggacctggagcaccccctgcagcccctgttcggcacccccaccagcctgctgaagaaggagccccccggctacgaggaggccatgagccagcagcccaagcagcaggagaacggcagcagcagccagcagatggacgacctgttcgacatcctgatccagagcggcggcaaccccagaaacttcagcagattccagggcgccgccatccccgccagagagggcgaggccatccccgaggacagcctgtgggtgccccccggcagcaccgccatcaccttctgctag

SEQ ID NO: 88376 - DNA, 2646 bp, Artificial Sequence
  Description of Artificial Sequence: Synthetic coding sequence
atgccccccctgaagagccccgccgccttccacgagcagagaagaagcctggagagagccagaaccgaggactacctgaagagaaagatcagaagcagacccgagagaagcgagctggtgagaatgcacatcctggaggagaccagcgccgagcccagcctgcaggccaagcagctgaagctgaagagagccagactggccgacgacctgaacgagaagatcgcccagagacccggccccatggagctggtggagaagaacatcctgcccgtggagagcagcctgaaggaggccatcatcgtgggccaggtgaactaccccaaggtggccgacagcagcagcttcgacgaggacagcagcgacgccctgagccccgagcagcccgccagccacgagagccagggcagcgtgcccagccccctggaggccagagtgagcgagcccctgctgagcgccaccagcgccagccccacccagcagagccagcccaagagcgccagcgagaagagccagagaagcaagaaggccaaggagctgaagcccaaggtgaagaagctgaagtaccaccagtacatcccccccgaccagaagcaggacagaggcgccccccccatggacagcagctacgccaagatcctgcagcagcagcagctgttcctgcagctgcagatcctgaaccagcagcagcagcagcaccacaactaccaggccatcctgcccgccccccccaagagcgccggcgaggccctgggcagcagcggcaccccccccgtgagaagcctgagcaccaccaacagcagcagcagcagcggcgcccccggcccctgcggcctggccagacagaacagcaccagcctgaccggcaagcccggcgccctgcccgccaacctggacgacatgaaggtggccgagctgaagcaggagctgaagctgagaagcctgcccgtgagcggcaccaagaccgagctgatcgagagactgagagcctaccaggaccagatcagccccgtgcccggcgcccccaaggcccccgccgccaccagcatcctgcacaaggccggcgaggtggtggtggccttccccgccgccagactgagcaccggccccgccctggtggccgccggcctggcccccgccgaggtggtggtggccaccgtggccagcagcggcgtggtgaagttcggcagcaccggcagcaccccccccgtgagccccacccccagcgagagaagcctgctgagcaccggcgacgagaacagcacccccggcgacaccttcggcgagatggtgaccagccccctgacccagctgaccctgcaggccagccccctgcagatcctggtgaaggaggagggccccagagccggcagctgctgcctgagccccggcggcagagccgagctggagggcagagacaaggaccagatgctgcaggagaaggacaagcagatcgaggccctgaccagaatgctgagacagaagcagcagctggtggagagactgaagctgcagctggagcaggagaagagagcccagcagcccgcccccgcccccgcccccctgggcacccccgtgaagcaggagaacagcttcagcagctgccagctgagccagcagcccctgggccccgcccaccccttcaaccccagcctggccgcccccgccaccaaccacatcgacccctgcgccgtggcccccggcccccccagcgtggtggtgaagcaggaggccctgcagcccgagcccgagcccgtgcccgccccccagctgctgctgggcccccagggccccagcctgatcaagggcgtggccccccccaccctgatcaccgacagcaccggcacccacctggtgctgaccgtgaccaacaagaacgccgacagccccggcctgagcagcggcagcccccagcagcccagcagccagcccggcagccccgcccccgcccccagcgcccagatggacctggagcaccccctgcagcccctgttcggcacccccaccagcctgctgaagaaggagccccccggctacgaggaggccatgagccagcagcccaagcagcaggagaacggcagcagcagccagcagatggacgacctgttcgacatcctgatccagagcggcgagatcagcgccgacttcaaggagccccccagcctgcccggcaaggagaagcccagccccaagaccgtgtgcggcagccccctggccgcccagcccagccccagcgccgagctgccccaggccgccccccccccccccggcagccccagcctgcccggcagactggaggacttcctggagagcagcaccggcctgcccctgctgaccagcggccacgacggccccgagcccctgagcctgatcgacgacctgcacagccagatgctgagcagcaccgccatcctggaccacccccccagccccatggacaccagcgagctgcacttcgtgcccgagcccagcagcaccatgggcctggacctggccgacggccacctggacagcatggactggctggagctgagcagcggcggccccgtgctgagcctggcccccctgagcaccaccgcccccagcctgttcagcaccgacttcctggacggccacgacctgcagctgcactgggacagctgcctgtag

SEQ ID NO: 88377 - DNA, 2796 bp, Artificial Sequence; identical to SEQ ID NO: 88374
  Description of Artificial Sequence: Synthetic coding sequence

SEQ ID NO: 88378 - DNA, 258 bp, Artificial Sequence
  Description of Artificial Sequence: Synthetic coding sequence
atgctgagcagcaccgccatcctggaccacccccccagccccatggacaccagcgagctgcacttcgtgcccgagcccagcagcaccatgggcctggacctggccgacggccacctggacagcatggactggctggagctgagcagcggcggccccgtgctgagcctggcccccctgagcaccaccgcccccagcctgttcagcaccgacttcctggacggccacgacctgcagctgcactgggacagctgcctgtag

SEQ ID NO: 88379 - DNA, 1524 bp, Artificial Sequence
  Description of Artificial Sequence: Synthetic coding sequence
atggccggcagaggcagcctggtgagctggagagccttccacggctgcgacagcgccgaggagctgcccagagtgagccccagattcctgagagcctggcaccccccccccgtgagcgccagaatgcccaccagaagatgggcccccggcacccagtgcatcaccaagtgcgagcacaccagacccaagcccggcgagctggccttcagaaagggcgacgtggtgaccatcctggaggcctgcgagaacaagagctggtacagagtgaagcaccacaccagcggccaggagggcctgctggccgccggcgccctgagagagagagaggccctgagcgccgaccccaagctgagcctgatgccctggttccacggcaagatcagcggccaggaggccgtgcagcagctgcagccccccgaggacggcctgttcctggtgagagagagcgccagacaccccggcgactacgtgctgtgcgtgagcttcggcagagacgtgatccactacagagtgctgcacagagacggccacctgaccatcgacgaggccgtgttcttctgcaacctgatggacatggtggagcactacagcaaggacaagggcgccatctgcaccaagctggtgagacccaagagaaagcacggcaccaagagcgccgaggaggagctggccagagccggctggctgctgaacctgcagcacctgaccctgggcgcccagatcggcgagggcgagttcggcgccgtgctgcagggcgagtacctgggccagaaggtggccgtgaagaacatcaagtgcgacgtgaccgcccaggccttcctggacgagaccgccgtgatgaccaagatgcagcacgagaacctggtgagactgctgggcgtgatcctgcaccagggcctgtacatcgtgatggagcacgtgagcaagggcaacctggtgaacttcctgagaaccagaggcagagccctggtgaacaccgcccagctgctgcagttcagcctgcacgtggccgagggcatggagtacctggagagcaagaagctggtgcacagagacctggccgccagaaacatcctggtgagcgaggacctggtggccaaggtgagcgacttcggcctggccaaggccgagagaaagggcctggacagcagcagactgcccgtgaagtggaccgcccccgaggccctgaagcacggcaagttcaccagcaagagcgacgtgtggagcttcggcgtgctgctgtgggaggtgttcagctacggcagagccccctaccccaagatgagcctgaaggaggtgagcgaggccgtggagaagggctacagaatggagccccccgagggctgccccggccccgtgcacgtgctgatgagcagctgctgggaggccgagcccgccagaagaccccccttcagaaagctggccgagaagctggccagagagctgagaagcgccggcgcccccgccagcgtgagcggccaggacgccgacggcagcaccagccccagaagccaggagccctag

SEQ ID NO: 88380 - DNA, 1401 bp, Artificial Sequence
  Description of Artificial Sequence: Synthetic coding sequence
atgcccaccagaagatgggcccccggcacccagtgcatcaccaagtgcgagcacaccagacccaagcccggcgagctggccttcagaaagggcgacgtggtgaccatcctggaggcctgcgagaacaagagctggtacagagtgaagcaccacaccagcggccaggagggcctgctggccgccggcgccctgagagagagagaggccctgagcgccgaccccaagctgagcctgatgccctggttccacggcaagatcagcggccaggaggccgtgcagcagctgcagccccccgaggacggcctgttcctggtgagagagagcgccagacaccccggcgactacgtgctgtgcgtgagcttcggcagagacgtgatccactacagagtgctgcacagagacggccacctgaccatcgacgaggccgtgttcttctgcaacctgatggacatggtggagcactacagcaaggacaagggcgccatctgcaccaagctggtgagacccaagagaaagcacggcaccaagagcgccgaggaggagctggccagagccggctggctgctgaacctgcagcacctgaccctgggcgcccagatcggcgagggcgagttcggcgccgtgctgcagggcgagtacctgggccagaaggtggccgtgaagaacatcaagtgcgacgtgaccgcccaggccttcctggacgagaccgccgtgatgaccaagatgcagcacgagaacctggtgagactgctgggcgtgatcctgcaccagggcctgtacatcgtgatggagcacgtgagcaagggcaacctggtgaacttcctgagaaccagaggcagagccctggtgaacaccgcccagctgctgcagttcagcctgcacgtggccgagggcatggagtacctggagagcaagaagctggtgcacagagacctggccgccagaaacatcctggtgagcgaggacctggtggccaaggtgagcgacttcggcctggccaaggccgagagaaagggcctggacagcagcagactgcccgtgaagtggaccgcccccgaggccctgaagcacggcaagttcaccagcaagagcgacgtgtggagcttcggcgtgctgctgtgggaggtgttcagctacggcagagccccctaccccaagatgagcctgaaggaggtgagcgaggccgtggagaagggctacagaatggagccccccgagggctgccccggccccgtgcacgtgctgatgagcagctgctgggaggccgagcccgccagaagaccccccttcagaaagctggccgagaagctggccagagagctgagaagcgccggcgcccccgccagcgtgagcggccaggacgccgacggcagcaccagccccagaagccaggagccctag

SEQ ID NO: 88381 - DNA, 1527 bp, Artificial Sequence
  Description of Artificial Sequence: Synthetic coding sequence
atgcagggccacttccccgccgagagaagagagggcagacccagaagaggcaccagaggccagcagcagctgctggtgagccccagattcctgagagcctggcaccccccccccgtgagcgccagaatgcccaccagaagatgggcccccggcacccagtgcatcaccaagtgcgagcacaccagacccaagcccggcgagctggccttcagaaagggcgacgtggtgaccatcctggaggcctgcgagaacaagagctggtacagagtgaagcaccacaccagcggccaggagggcctgctggccgccggcgccctgagagagagagaggccctgagcgccgaccccaagctgagcctgatgccctggttccacggcaagatcagcggccaggaggccgtgcagcagctgcagccccccgaggacggcctgttcctggtgagagagagcgccagacaccccggcgactacgtgctgtgcgtgagcttcggcagagacgtgatccactacagagtgctgcacagagacggccacctgaccatcgacgaggccgtgttcttctgcaacctgatggacatggtggagcactacagcaaggacaagggcgccatctgcaccaagctggtgagacccaagagaaagcacggcaccaagagcgccgaggaggagctggccagagccggctggctgctgaacctgcagcacctgaccctgggcgcccagatcggcgagggcgagttcggcgccgtgctgcagggcgagtacctgggccagaaggtggccgtgaagaacatcaagtgcgacgtgaccgcccaggccttcctggacgagaccgccgtgatgaccaagatgcagcacgagaacctggtgagactgctgggcgtgatcctgcaccagggcctgtacatcgtgatggagcacgtgagcaagggcaacctggtgaacttcctgagaaccagaggcagagccctggtgaacaccgcccagctgctgcagttcagcctgcacgtggccgagggcatggagtacctggagagcaagaagctggtgcacagagacctggccgccagaaacatcctggtgagcgaggacctggtggccaaggtgagcgacttcggcctggccaaggccgagagaaagggcctggacagcagcagactgcccgtgaagtggaccgcccccgaggccctgaagcacggcaagttcaccagcaagagcgacgtgtggagcttcggcgtgctgctgtgggaggtgttcagctacggcagagccccctaccccaagatgagcctgaaggaggtgagcgaggccgtggagaagggctacagaatggagccccccgagggctgccccggccccgtgcacgtgctgatgagcagctgctgggaggccgagcccgccagaagaccccccttcagaaagctggccgagaagctggccagagagctgagaagcgccggcgcccccgccagcgtgagcggccaggacgccgacggcagcaccagccccagaagccaggagccctag

SEQ ID NO: 88382 - DNA, 1134 bp, Artificial Sequence
  Description of Artificial Sequence: Synthetic coding sequence
atgacccaggagcccttcagagaggagctggcctacgacagaatgcccaccctggagagaggcagacaggaccccgccagctacgcccccgacgccaagcccagcgacctgcagctgagcaagagactgcccccctgcttcagccacaagacctgggtgttcagcgtgctgatgggcagctgcctgctggtgaccagcggcttcagcctgtacctgggcaacgtgttccccgccgagatggactacctgagatgcgccgccggcagctgcatccccagcgccatcgtgagcttcaccgtgagcagaagaaacgccaacgtgatccccaacttccagatcctgttcgtgagcaccttcgccgtgaccaccacctgcctgatctggttcggctgcaagctggtgctgaaccccagcgccatcaacatcaacttcaacctgatcctgctgctgctgctggagctgctgatggccgccaccgtgatcatcgccgccagaagcagcgaggaggactgcaagaagaagaagggcagcatgagcgacagcgccaacatcctggacgaggtgcccttccccgccagagtgctgaagagctacagcgtggtggaggtgatcgccggcatcagcgccgtgctgggcggcatcatcgccctgaacgtggacgacagcgtgagcggcccccacctgagcgtgaccttcttctggatcctggtggcctgcttccccagcgccatcgccagccacgtggccgccgagtgccccagcaagtgcctggtggaggtgctgatcgccatcagcagcctgaccagccccctgctgttcaccgccagcggctacctgagcttcagcatcatgagaatcgtggagatgttcaaggactacccccccgccatcaagcccagctacgacgtgctgctgctgctgctgctgctggtgctgctgctgcaggccggcctgaacaccggcaccgccatccagtgcgtgagattcaaggtgagcgccagactgcagggcgccagctgggacacccagaacggcccccaggagagactggccggcgaggtggccagaagccccctgaaggagttcgacaaggagaaggcctggagagccgtggtggtgcagatggcccagtag

SEQ ID NO: 88383 - DNA, 1134 bp, Artificial Sequence; identical to SEQ ID NO: 88382
  Description of Artificial Sequence: Synthetic coding sequence

SEQ ID NO: 88384 - DNA, 1044 bp, Artificial Sequence
  Description of Artificial Sequence: Synthetic coding sequence
atgacccaggagcccttcagagaggagctggcctacgacagaatgcccaccctggagagaggcagacaggaccccgccagctacgcccccgacgccaagcccagcgacctgcagctgagcaagagactgcccccctgcttcagccacaagacctgggtgttcagcgtgctgatgggctgcatccccagcgccatcgtgagcttcaccgtgagcagaagaaacgccaacgtgatccccaacttccagatcctgttcgtgagcaccttcgccgtgaccaccacctgcctgatctggttcggctgcaagctggtgctgaaccccagcgccatcaacatcaacttcaacctgatcctgctgctgctgctggagctgctgatggccgccaccgtgatcatcgccgccagaagcagcgaggaggactgcaagaagaagaagggcagcatgagcgacagcgccaacatcctggacgaggtgcccttccccgccagagtgctgaagagctacagcgtggtggaggtgatcgccggcatcagcgccgtgctgggcggcatcatcgccctgaacgtggacgacagcgtgagcggcccccacctgagcgtgaccttcttctggatcctggtggcctgcttccccagcgccatcgccagccacgtggccgccgagtgccccagcaagtgcctggtggaggtgctgatcgccatcagcagcctgaccagccccctgctgttcaccgccagcggctacctgagcttcagcatcatgagaatcgtggagatgttcaaggactacccccccgccatcaagcccagctacgacgtgctgctgctgctgctgctgctggtgctgctgctgcaggccggcctgaacaccggcaccgccatccagtgcgtgagattcaaggtgagcgccagactgcagggcgccagctgggacacccagaacggcccccaggagagactggccggcgaggtggccagaagccccctgaaggagttcgacaaggagaaggcctggagagccgtggtggtgcagatggcccagtag

SEQ ID NO: 88385 - DNA, 672 bp, Artificial Sequence
  Description of Artificial Sequence: Synthetic coding sequence
atgacccaggagcccttcagagaggagctggcctacgacagaatgcccaccctggagagaggcagacaggaccccgccagctacgcccccgacgccaagcccagcgacctgcagctgagcaagagactgcccccctgcttcagccacaagacctgggtgttcagcgtgctgatgggctgcatccccagcgccatcgtgagcttcaccgtgagcagaagaaacgccaacgtgatccccaacttccagatcctgttcgtgagcaccttcgccgtgaccaccacctgcctgatctggttcggctgcaagctggtgctgaaccccagcgccatcaacatcaacttcaacctgatcctgctgctgctgctggagctgctgatggccgccaccgtgatcatcgccgccagaagcagcgaggaggactgcaagaagaagaagggcagcatgagcgacagcgccaacatcctggacgaggtgcccttccccgccagagtgctgaagagctacagcgtggtggaggtgatcgccggcatcagcgccgtgctgggcggcatcatcgccctgaacgtggacgacagcgtgagcggcccccacctgagcgtgaccttcttctggatcctggtggcctgcttccccagcgccatcgccagccacgtggccgccgagtgcccctag

SEQ ID NO: 88386 - DNA, 978 bp, Artificial Sequence
  Description of Artificial Sequence: Synthetic coding sequence
atgacccaggagcccttcagagaggagctggcctacgacagaatgcccaccctggagagaggcagacaggaccccgccagctacgcccccgacgccaagcccagcgacctgcagctgagcaagagactgcccccctgcttcagccacaagacctgggtgttcagcgtgctgatgggcagctgcctgctggtgaccagcggcttcagcctgtacctgggcaacgtgttccccgccgagatggactacctgagatgcgccgccggcagcatcaacttcaacctgatcctgctgctgctgctggagctgctgatggccgccaccgtgatcatcgccgccagaagcagcgaggaggactgcaagaagaagaagggcagcatgagcgacagcgccaacatcctggacgaggtgcccttccccgccagagtgctgaagagctacagcgtggtggaggtgatcgccggcatcagcgccgtgctgggcggcatcatcgccctgaacgtggacgacagcgtgagcggcccccacctgagcgtgaccttcttctggatcctggtggcctgcttccccagcgccatcgccagccacgtggccgccgagtgccccagcaagtgcctggtggaggtgctgatcgccatcagcagcctgaccagccccctgctgttcaccgccagcggctacctgagcttcagcatcatgagaatcgtggagatgttcaaggactacccccccgccatcaagcccagctacgacgtgctgctgctgctgctgctgctggtgctgctgctgcaggccggcctgaacaccggcaccgccatccagtgcgtgagattcaaggtgagcgccagactgcagggcgccagctgggacacccagaacggcccccaggagagactggccggcgaggtggccagaagccccctgaaggagttcgacaaggagaaggcctggagagccgtggtggtgcagatggcccagtag

SEQ ID NO: 88387 - DNA, 897 bp, Artificial Sequence
  Description of Artificial Sequence: Synthetic coding sequence
atggactacctgagatgcgccgccggcagctgcatccccagcgccatcgtgagcttcaccgtgagcagaagaaacgccaacgtgatccccaacttccagatcctgttcgtgagcaccttcgccgtgaccaccacctgcctgatctggttcggctgcaagctggtgctgaaccccagcgccatcaacatcaacttcaacctgatcctgctgctgctgctggagctgctgatggccgccaccgtgatcatcgccgccagaagcagcgaggaggactgcaagaagaagaagggcagcatgagcgacagcgccaacatcctggacgaggtgcccttccccgccagagtgctgaagagctacagcgtggtggaggtgatcgccggcatcagcgccgtgctgggcggcatcatcgccctgaacgtggacgacagcgtgagcggcccccacctgagcgtgaccttcttctggatcctggtggcctgcttccccagcgccatcgccagccacgtggccgccgagtgccccagcaagtgcctggtggaggtgctgatcgccatcagcagcctgaccagccccctgctgttcaccgccagcggctacctgagcttcagcatcatgagaatcgtggagatgttcaaggactacccccccgccatcaagcccagctacgacgtgctgctgctgctgctgctgctggtgctgctgctgcaggccggcctgaacaccggcaccgccatccagtgcgtgagattcaaggtgagcgccagactgcagggcgccagctgggacacccagaacggcccccaggagagactggccggcgaggtggccagaagccccctgaaggagttcgacaaggagaaggcctggagagccgtggtggtgcagatggcccagtag

SEQ ID NO: 88388 - DNA, 1032 bp, Artificial Sequence
  Description of Artificial Sequence: Synthetic coding sequence
atgacccaggagcccttcagagaggagctggcctacgacagaatgcccaccctggagagaggcagacaggaccccgccagctacgcccccgacgccaagcccagcgacctgcagctgagcaagagactgcccccctgcttcagccacaagacctgggtgttcagcgtgctgatgggcagctgcctgctggtgaccagcggcttcagcctgtacctgggcaacgtgttccccgccgagatggactacctgagatgcgccgccggcagctgcatccccagcgccatcgtgagcttcaccgtgagcagaagaaacgccaacgtgatcaacttcaacctgatcctgctgctgctgctggagctgctgatggccgccaccgtgatcatcgccgccagaagcagcgaggaggactgcaagaagaagaagggcagcatgagcgacagcgccaacatcctggacgaggtgcccttccccgccagagtgctgaagagctacagcgtggtggaggtgatcgccggcatcagcgccgtgctgggcggcatcatcgccctgaacgtggacgacagcgtgagcggcccccacctgagcgtgaccttcttctggatcctggtggcctgcttccccagcgccatcgccagccacgtggccgccgagtgccccagcaagtgcctggtggaggtgctgatcgccatcagcagcctgaccagccccctgctgttcaccgccagcggctacctgagcttcagcatcatgagaatcgtggagatgttcaaggactacccccccgccatcaagcccagctacgacgtgctgctgctgctgctgctgctggtgctgctgctgcaggccggcctgaacaccggcaccgccatccagtgcgtgagattcaaggtgagcgccagactgcagggcgccagctgggacacccagaacggcccccaggagagactggccggcgaggtggccagaagccccctgaaggagttcgacaaggagaaggcctggagagccgtggtggtgcagatggcccagtag

SEQ ID NO: 88389 - DNA, 267 bp, Artificial Sequence
  Description of Artificial Sequence: Synthetic coding sequence
atggccagcagcgacgtgaagcccaagagcgtgagccacgccaagaagtggagcgaggagatcgagaacctgtacagattccagcaggccggctacagagacgagaccgagtacagacaggtgaagcaggtgagcatggtggacagatggcccgagaccggctacgtgaagaagctgcagagaagagacaacaccttctactactacaacaagcagagagagtgcgacgacaaggaggtgcacaaggtgaagatctacgcctactag

SEQ ID NO: 88390 - DNA, 267 bp, Artificial Sequence; identical to SEQ ID NO: 88389
  Description of Artificial Sequence: Synthetic coding sequence

SEQ ID NO: 88391 - DNA, 1488 bp, Artificial Sequence
  Description of Artificial Sequence: Synthetic coding sequence
atgggcagcaagagaagaaacctgagctgcagcgagagacaccagaagctggtggacgagaactactgcaagaagctgcacgtgcaggccctgaagaacgtgaacagccagatcagaaaccagatggtgcagaacgagaacgacaacagagtgcagagaaagcagttcctgagactgctgcagaacgagcagttcgagctggacatggaggaggccatccagaaggccgaggagaacaagagactgaaggagctgcagctgaagcaggaggagaagctggccatggagctggccaagctgaagcacgagagcctgaaggacgagaagatgagacagcaggtgagagagaacagcatcgagctgagagagctggagaagaagctgaaggccgcctacatgaacaaggagagagccgcccagatcgccgagaaggacgccatcaagtacgagcagatgaagagagacgccgagatcgccaagaccatgatggaggagcacaagagaatcatcaaggaggagaacgccgccgaggacaagagaaacaaggccaaggcccagtactacctggacctggagaagcagctggaggagcaggagaagaagaagcaggaggcctacgagcagctgctgaaggagaagctgatgatcgacgagatcgtgagaaagatctacgaggaggaccagctggagaagcagcagaagctggagaagatgaacgccatgagaagatacatcgaggagttccagaaggagcaggccctgtggagaaagaagaagagagaggagatggaggaggagaacagaaagatcatcgagttcgccaacatgcagcagcagagagaggaggacagaatggccaaggtgcaggagaacgaggagaagagactgcagctgcagaacgccctgacccagaagctggaggagatgctgagacagagagaggacctggagcaggtgagacaggagctgtaccaggaggagcaggccgagatctacaagagcaagctgaaggaggaggccgagaagaagctgagaaagcagaaggagatgaagcaggacttcgaggagcagatggccctgaaggagctggtgctgcaggccgccaaggaggaggaggagaacttcagaaagaccatgctggccaagttcgccgaggacgacagaatcgagctgatgaacgcccagaagcagagaatgaagcagctggagcacagaagagccgtggagaagctgatcgaggagagaagacagcagttcctggccgacaagcagagagagctggaggagtggcagctgcagcagagaagacagggcttcatcaacgccatcatcgaggaggagagactgaagctgctgaaggagcacgccaccaacctgctgggctacctgcccaagggcgtgttcaagaaggaggacgacatcgacctgctgggcgaggagttcagaaaggtgtaccagcagagaagcgagatctgcgaggagaagtag

SEQ ID NO: 88392 - DNA, 1173 bp, Artificial Sequence
  Description of Artificial Sequence: Synthetic coding sequence
atggcccagagatacgacgacctgccccactacggcggcatggacggcgtgggcatccccagcaccatgtacggcgacccccacgccgccagaagcatgcagcccgtgcaccacctgaaccacggcccccccctgcacagccaccagtacccccacaccgcccacaccaacgccatggcccccagcatgggcagcagcgtgaacgacgccctgaagagagacaaggacgccatctacggccaccccctgttccccctgctggccctgatcttcgagaagtgcgagctggccacctgcacccccagagagcccggcgtggccggcggcgacgtgtgcagcagcgagagcttcaacgaggacatcgccgtgttcgccaagcagatcagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggcatcagagcccccggccccatgagcggcatgggcatgaacatgggcatggagggccagtggcactacatgtag

SEQ ID NO: 88393 - DNA, 1392 bp, Artificial Sequence
  Description of Artificial Sequence: Synthetic coding sequence
atgcagtacgacgacctgccccactacggcggcatggacggcgtgggcatccccagcaccatgtacggcgacccccacgccgccagaagcatgcagcccgtgcaccacctgaaccacggcccccccctgcacagccaccagtacccccacaccgcccacaccaacgccatggcccccagcatgggcagcagcgtgaacgacgccctgaagagagacaaggacgccatctacggccaccccctgttccccctgctggccctgatcttcgagaagtgcgagctggccacctgcacccccagagagcccggcgtggccggcggcgacgtgtgcagcagcgagagcttcaacgaggacatcgccgtgttcgccaagcagatcagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggcatcagagcccccggcctgcagagcatgcccggcgagtacgtggccagaggcggccccatgggcgtgagcatgggccagcccagctacacccagccccagatgcccccccaccccgcccagctgagacacggcccccccatgcacacctacatccccggccacccccaccaccccaccgtgatgatgcacggcggccccccccaccccggcatgcccatgagcgccagcagccccaccgtgctgaacaccggcgaccccaccatgagcggccaggtgatggacatccacgcccagtag

SEQ ID NO: 88394 - DNA, 762 bp, Artificial Sequence
  Description of Artificial Sequence: Synthetic coding sequence
atgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggcatcagagcccccggccccatgagcggcatgggcatgaacatgggccccccctgcatcagaaccttcctggacaccctgaccacccagcagtag

SEQ ID NO: 88395 - DNA, 1398 bp, Artificial Sequence
  Description of Artificial Sequence: Synthetic coding sequence
atggcccagagatacgacgacctgccccactacggcggcatggacggcgtgggcatccccagcaccatgtacggcgacccccacgccgccagaagcatgcagcccgtgcaccacctgaaccacggcccccccctgcacagccaccagtacccccacaccgcccacaccaacgccatggcccccagcatgggcagcagcgtgaacgacgccctgaagagagacaaggacgccatctacggccaccccctgttccccctgctggccctgatcttcgagaagtgcgagctggccacctgcacccccagagagcccggcgtggccggcggcgacgtgtgcagcagcgagagcttcaacgaggacatcgccgtgttcgccaagcagatcagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggcatcagagcccccggcctgcagagcatgcccggcgagtacgtggccagaggcggccccatgggcgtgagcatgggccagcccagctacacccagccccagatgcccccccaccccgcccagctgagacacggcccccccatgcacacctacatccccggccacccccaccaccccaccgtgatgatgcacggcggccccccccaccccggcatgcccatgagcgccagcagccccaccgtgctgaacaccggcgaccccaccatgagcggccaggtgatggacatccacgcccagtag

SEQ ID NO: 88396 - DNA, 423 bp, Artificial Sequence
  Description of Artificial Sequence: Synthetic coding sequence
atgaagaagaacggcgacgagaagagccccctgggcaccgagatcatgatgaccagacacctgctggtgcaggaggagccccaggccctgcccgccgtggccaccagacacaccgtgggcaccaccgccgtgagcaagcacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggcatcagagcccccggccccatgagcggcatgggcatgaacatgggcatggagggccagtggcactacatgtag

SEQ ID NO: 88397 - DNA, 663 bp, Artificial Sequence
  Description of Artificial Sequence: Synthetic coding sequence
atgcagcccgtgcaccacctgaaccacggcccccccctgcacagccaccagtacccccacaccgcccacaccaacgccatggcccccagcatgggcagcagcgtgaacgacgccctgaagagagacaaggacgccatctacggccaccccctgttccccctgctggccctgatcttcgagaagtgcgagctggccacctgcacccccagagagcccggcgtggccggcggcgacgtgtgcagcagcgagagcttcaacgaggacatcgccgtgttcgccaagcagatcagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcaggcccccctgcccttctag

SEQ ID NO: 88398 - DNA, 540 bp, Artificial Sequence
  Description of Artificial Sequence: Synthetic coding sequence
atgaagagcctgctgaccttctacaagtgcggcagcgagctgctgcccgccgccgtgtggagcgccggcggcagccccagcctgttcagcgacctgaagagcaagaagggcaagaagttcagcagagaccacatcgaggtgaccatcagcaactgcggcgtgaacggcaacgccaagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggctag

SEQ ID NO: 88399 - DNA, 978 bp, Artificial Sequence
  Description of Artificial Sequence: Synthetic coding sequence
atggcccagggcctgagactgcagggcagcagaagaaagggcagacaccccctgttccccctgctggccctgatcttcgagaagtgcgagctggccacctgcacccccagagagcccggcgtggccggcggcgacgtgtgcagcagcgagagcttcaacgaggacatcgccgtgttcgccaagcagatcagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcaccccctacaaccccgacggccagcccatgggcggcttcgtgatggacggccagcagcacatgggcatcagagcccccggccccatgagcggcatgggcatgaacatgggcatggagggccagtggcactacatgtag

SEQ ID NO: 88400 - DNA, 1113 bp, Artificial Sequence
  Description of Artificial Sequence: Synthetic coding sequence
atggcccagagatacgacgacctgccccactacggcggcatggacggcgtgggcatccccagcaccatgtacggcgacccccacgccgccagaagcatgcagcccgtgcaccacctgaaccacggcccccccctgcacagccaccagtacccccacaccgcccacaccaacgccatggcccccagcatgggcagcagcgtgaacgacgccctgaagagagacaaggacgccatctacggccaccccctgttccccctgctggccctgatcttcgagaagtgcgagctggccacctgcacccccagagagcccggcgtggccggcggcgacgtgtgcagcagcgagagcttcaacgaggacatcgccgtgttcgccaagcagatcagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgacagagagggcggcagcaagagcgacagcgaggacatcaccagaagcgccaacctgaccgaccagcccagctggaacagagaccacgacgacaccgccagcaccagaagcggcggcacccccggccccagcagcggcggccacaccagccacagcggcgacaacagcagcgagcagggcgacggcctggacaacagcgtggccagccccagcaccggcgacgacgacgaccccgacaaggacaagaagagacacaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccggcaagagccccatcgtgaccgtgttcaagagcagaaagagaaagcccagcagcagccacagccccggcggccccctgcccggcaagtag

SEQ ID NO: 88401 - DNA, 2259 bp, Artificial Sequence
  Description of Artificial Sequence: Synthetic coding sequence
accaccgccatggcccacagaaagctggagagcgtgggcagcggcatgctggaccacagagtgagacccggccccgtgccccacagccaggagcccgagagcgaggacatggagctgcccctggagggctacgtgcccgagggcctggagctggccgccctgagacccgagagccccgcccccgaggagcaggagtgccacaaccacagccccgacggcgacagcagcagcgactacgtgaacaacaccagcgaggaggaggactacgacgagggcctgcccgaggaggaggagggcatcacctactacatcagatactgccccgaggacgacagctacctggagggcatggactgcaacggcgaggagtacctggcccacagcgcccaccccgtggacaccgacgagtgccaggaggccgtggaggagtggaccgacagcgccggcccccacccccacggccacgaggccgagggcagccaggactaccccgacggccagctgcccatccccgaggacgagcccagcgtgctggaggcccacgaccaggaggaggacggccactactgcgccagcaaggagggctaccaggactactaccccgaggaggccaacggcaacaccggcgccagcccctacagactgagaagaggcgacggcgacctggaggaccaggaggaggacatcgaccagatcgtggccgagatcaagatgagcctgagcatgaccagcatcaccagcgccagcgaggccagccccgagcacggccccgagcccggccccgaggacagcgtggaggcctgcccccccatcaaggccagctgcagccccagcagacacgaggccagacccaagagcctgaacctgctgcccgaggccaagcaccccggcgacccccagagaggcttcaagcccaagaccagaacccccgaggagagactgaagtggccccacgagcaggtgtgcaacggcctggagcagcccagaaagcagcagagaagcgacctgaacggccccgtggacaacaacaacatccccgagaccaagaaggtggccagcttccccagcttcgtggccgtgcccggcccctgcgagcccgaggacctgatcgacggcatcatcttcgccgccaactacctgggcagcacccagctgctgagcgagagaaaccccagcaagaacatcagaatgatgcaggcccaggaggccgtgagcagagtgaagagaatgcagaaggccgccaagatcaagaagaaggccaacagcgagggcgacgcccagaccctgaccgaggtggacctgttcatcagcacccagagaatcaaggtgctgaacgccgacacccaggagaccatgatggaccacgccctgagaaccatcagctacatcgccgacatcggcaacatcgtggtgctgatggccagaagaagaatgcccagaagcgccagccaggactgcatcgagaccacccccggcgcccaggagggcaagaagcagtacaagatgatctgccacgtgttcgagagcgaggacgcccagctgatcgcccagagcatcggccaggccttcagcgtggcctaccaggagttcctgagagccaacggcatcaaccccgaggacctgagccagaaggagtacagcgacatcatcaacacccaggagatgtacaacgacgacctgatccacttcagcaacagcgagaactgcaaggagctgcagctggagaagcacaagggcgagatcctgggcgtggtggtggtggagagcggctggggcagcatcctgcccaccgtgatcctggccaacatgatgaacggcggccccgccgccagaagcggcaagctgagcatcggcgaccagatcatgagcatcaacggcaccagcctggtgggcctgcccctggccacctgccagggcatcatcaagggcctgaagaaccagacccaggtgaagctgaacatcgtgagctgcccccccgtgaccaccgtgctgatcaagagacccgacctgaagtaccagctgggcttcagcgtgcagaacggcatcatctgcagcctgatgagaggcggcatcgccgagagaggcggcgtgagagtgggccacagaatcatcgagatcaacggccagagcgtggtggccaccgcccacgagaagatcgtgcaggccctgagcaacagcgtgggcgagatccacatgaagaccatgcccgccgccatgttcagactgctgaccggccaggagacccccctgtacatctag

SEQ ID NO: 88402 - DNA, 1413 bp, Artificial Sequence
  Description of Artificial Sequence: Synthetic coding sequence
atggcccagagatacgacgagctgccccactacggcggcatggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcgccgcctacagccccgagggccagcccatgggcagcttcgtgctggacggccagcagcacatgggcatcagacccgccggcctgcagagcatgcccggcgactacgtgagccagggcggccccatgggcatgagcatggcccagcccagctacacccccccccagatgaccccccaccccacccagctgagacacggcccccccatgcacagctacctgcccagccacccccaccaccccgccatgatgatgcacggcggcccccccacccaccccggcatgaccatgagcgcccagagccccaccatgctgaacagcgtggaccccaacgtgggcggccaggtgatggacatccacgcccagtag

SEQ ID NO: 88403 - DNA, 1146 bp, Artificial Sequence
  Description of Artificial Sequence: Synthetic coding sequence
atggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcgccgcctacagccccgagggccagcccatgggcagcttcgtgctggacggccagcagcacatgggcatcagacccgccggccccatgagcggcatgggcatgaacatgggcatggacggccagtggcactacatgtag

SEQ ID NO: 88404 - DNA, 1413 bp, Artificial Sequence; identical to SEQ ID NO: 88402
  Description of Artificial Sequence: Synthetic coding sequence

SEQ ID NO: 88405 - DNA, 921 bp, Artificial Sequence
  Description of Artificial Sequence: Synthetic coding sequence
atggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcgccgcctacagccccgagggccagcccatgggcagcttcgtgctggacggccagcagcacatgggcatcagacccgccggccccatgagcggcatgggcatgaacatgggcatggacggccagtggcactacatgtag

SEQ ID NO: 88406 - DNA, 921 bp, Artificial Sequence; identical to SEQ ID NO: 88405
  Description of Artificial Sequence: Synthetic coding sequence

SEQ ID NO: 88407 - DNA, 1206 bp, Artificial Sequence
  Description of Artificial Sequence: Synthetic coding sequence
atggcccagagatacgacgagctgccccactacggcggcatggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccggcttcctgctggaccccagcgtgagccagggcgccgcctacagccccgagggccagcccatgggcagcttcgtgctggacggccagcagcacatgggcatcagacccgccggccccatgagcggcatgggcatgaacatgggcatggacggccagtggcactacatgtag

SEQ ID NO: 88408 - DNA, 1185 bp, Artificial Sequence
  Description of Artificial Sequence: Synthetic coding sequence
atggcccagagatacgacgagctgccccactacggcggcatggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccgtgagccagggcgccgcctacagccccgagggccagcccatgggcagcttcgtgctggacggccagcagcacatgggcatcagacccgccggccccatgagcggcatgggcatgaacatgggcatggacggccagtggcactacatgtag

SEQ ID NO: 88409 - DNA, 717 bp, Artificial Sequence
  Description of Artificial Sequence: Synthetic coding sequence
atggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagtag

SEQ ID NO: 88410 - DNA, 240 bp, Artificial Sequence
  Description of Artificial Sequence: Synthetic coding sequence
atggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgagcagaaagtag

SEQ ID NO: 88411 - DNA, 1167 bp, Artificial Sequence
  Description of Artificial Sequence: Synthetic coding sequence
atggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccggcttcctgctggaccccagcgtgagccagggcgccgcctacagccccgagggccagcccatgggcagcttcgtgctggacggccagcagcacatgggcatcagacccgccggccccatgagcggcatgggcatgaacatgggcatggacggccagtggcactacatgtag

SEQ ID NO: 88412 - DNA, 1185 bp, Artificial Sequence; identical to SEQ ID NO: 88408
  Description of Artificial Sequence: Synthetic coding sequence

SEQ ID NO: 88413 - DNA, 1434 bp, Artificial Sequence
  Description of Artificial Sequence: Synthetic coding sequence
atggcccagagatacgacgagctgccccactacggcggcatggacggcgtgggcgtgcccgccagcatgtacggcgacccccacgcccccagacccatcccccccgtgcaccacctgaaccacggcccccccctgcacgccacccagcactacggcgcccacgccccccaccccaacgtgatgcccgccagcatgggcagcgccgtgaacgacgccctgaagagagacaaggacgccatctacggccaccccctgttccccctgctggccctggtgttcgagaagtgcgagctggccacctgcacccccagagagcccggcgtggccggcggcgacgtgtgcagcagcgacagcttcaacgaggacatcgccgtgttcgccaagcaggtgagagccgagaagcccctgttcagcagcaaccccgagctggacaacctgatgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccggcttcctgctggaccccagcgtgagccagggcgccgcctacagccccgagggccagcccatgggcagcttcgtgctggacggccagcagcacatgggcatcagacccgccggcctgcagagcatgcccggcgactacgtgagccagggcggccccatgggcatgagcatggcccagcccagctacacccccccccagatgaccccccaccccacccagctgagacacggcccccccatgcacagctacctgcccagccacccccaccaccccgccatgatgatgcacggcggcccccccacccaccccggcatgaccatgagcgcccagagccccaccatgctgaacagcgtggaccccaacgtgggcggccaggtgatggacatccacgcccagtag

SEQ ID NO: 88414 - DNA, 1434 bp, Artificial Sequence; identical to SEQ ID NO: 88413
  Description of Artificial Sequence: Synthetic coding sequence

SEQ ID NO: 88415 - DNA, 357 bp, Artificial Sequence
  Description of Artificial Sequence: Synthetic coding sequence
atgcccagagaggacgcccacttcatctacggctaccccaagaagggccacggccacagctacaccaccgccgaggaggccgccggcatcggcatcctgaccgtgatcctgggcgtgctgctgctgatcggctgctggtactgcagaagaagaaacggctacagagccctgatggacaagagcctgcacgtgggcacccagtgcgccctgaccagaagatgcccccaggagggcttcgaccacagagacagcaaggtgagcctgcaggagaagaactgcgagcccgtggtgcccaacgccccccccgcctacgagaagctgagcgccgagcagagcccccccccctacagcccctag

SEQ ID NO: 88416 - DNA, 357 bp, Artificial Sequence; identical to SEQ ID NO: 88415
  Description of Artificial Sequence: Synthetic coding sequence

SEQ ID NO: 88417 - DNA, 357 bp, Artificial Sequence; identical to SEQ ID NO: 88415
  Description of Artificial Sequence: Synthetic coding sequence

SEQ ID NO: 88418 - DNA, 1269 bp, Artificial Sequence
  Description of Artificial Sequence: Synthetic coding sequence
atgagcgtgggcgccatgaagaagggcgtgggcagagccgtgggcctgggcggcggcagcggctgccaggccaccgaggaggaccccctgcccaactgcggcgcctgcgcccccggccagggcggcagaagatggagactgccccagcccgcctgggtggagggcagcagcgccagactgtgggagcaggccaccggcaccggctggatggacctggaggccagcctgctgcccaccggccccaacgccagcaacaccagcgacggccccgacaacctgaccagcgccggcagcccccccagaaccggcagcatcagctacatcaacatcatcatgcccagcgtgttcggcaccatctgcctgctgggcatcatcggcaacagcaccgtgatcttcgccgtggtgaagaagagcaagctgcactggtgcaacaacgtgcccgacatcttcatcatcaacctgagcgtggtggacctgctgttcctgctgggcatgcccttcatgatccaccagctgatgggcaacggcgtgtggcacttcggcgagaccatgtgcaccctgatcaccgccatggacgccaacagccagttcaccagcacctacatcctgaccgccatggccatcgacagatacctggccaccgtgcaccccatcagcagcaccaagttcagaaagcccagcgtggccaccctggtgatctgcctgctgtgggccctgagcttcatcagcatcacccccgtgtggctgtacgccagactgatccccttccccggcggcgccgtgggctgcggcatcagactgcccaaccccgacaccgacctgtactggttcaccctgtaccagttcttcctggccttcgccctgcccttcgtggtgatcaccgccgcctacgtgagaatcctgcagagaatgaccagcagcgtggcccccgccagccagagaagcatcagactgagaaccaagagagtgaccagaaccgccatcgccatctgcctggtgttcttcgtgtgctgggccccctactacgtgctgcagctgacccagctgagcatcagcagacccaccctgaccttcgtgtacctgtacaacgccgccatcagcctgggctacgccaacagctgcctgaaccccttcgtgtacatcgtgctgtgcgagaccttcagaaagagactggtgctgagcgtgaagcccgccgcccagggccagctgagagccgtgagcaacgcccagaccgccgacgaggagagaaccgagagcaagggcacctag

SEQ ID NO: 88419 - DNA, 891 bp, Artificial Sequence
  Description of Artificial Sequence: Synthetic coding sequence
atgagcgtgggcgccatgaagaagggcgtgggcagagccgtgggcctgggcggcggcagcggctgccaggccaccgaggaggaccccctgcccaactgcggcgcctgcgcccccggccagggcggcagaagatggagactgccccagcccgcctgggtggagggcagcagcgccagactgtgggagcaggccaccggcaccggctggatggacctggaggccagcctgctgcccaccggccccaacgccagcaacaccagcgacggccccgacaacctgaccagcgccggcagcccccccagaaccggcagcatcagctacatcaacatcatcatgcccagcgtgttcggcaccatctgcctgctgggcatcatcggcaacagcaccgtgatcttcgccgtggtgaagaagagcaagctgcactggtgcaacaacgtgcccgacatcttcatcatcaacctgagcttcttcctggccttcgccctgcccttcgtggtgatcaccgccgcctacgtgagaatcctgcagagaatgaccagcagcgtggcccccgccagccagagaagcatcagactgagaaccaagagagtgaccagaaccgccatcgccatctgcctggtgttcttcgtgtgctgggccccctactacgtgctgcagctgacccagctgagcatcagcagacccaccctgaccttcgtgtacctgtacaacgccgccatcagcctgggctacgccaacagctgcctgaaccccttcgtgtacatcgtgctgtgcgagaccttcagaaagagactggtgctgagcgtgaagcccgccgcccagggccagctgagagccgtgagcaacgcccagaccgccgacgaggagagaaccgagagcaagggcacctag

SEQ ID NO: 88420 - DNA, 1023 bp, Artificial Sequence
  Description of Artificial Sequence: Synthetic coding sequence
atgaaccccttccacgccagctgctggaacaccagcgccgagctgctgaacaagagctggaacaaggagttcgcctaccagaccgccagcgtggtggacaccgtgatcctgcccagcatgatcggcatcatctgcagcaccggcctggtgggcaacatcctgatcgtgttcaccatcatcagaagcagaaagaagaccgtgcccgacatctacatctgcaacctggccgtggccgacctggtgcacatcgtgggcatgcccttcctgatccaccagtgggccagaggcggcgagtgggtgttcggcggccccctgtgcaccatcatcaccagcctggacacctgcaaccagttcgcctgcagcgccatcatgaccgtgatgagcgtggacagatacttcgccctggtgcagcccttcagactgaccagatggagaaccagatacaagaccatcagaatcaacctgggcctgtgggccgccagcttcatcctggccctgcccgtgtgggtgtacagcaaggtgatcaagttcaaggacggcgtggagagctgcgccttcgacctgaccagccccgacgacgtgctgtggtacaccctgtacctgaccatcaccaccttcttcttccccctgcccctgatcctggtgtgctacatcctgatcctgtgctacacctgggagatgtaccagcagaacaaggacgccagatgctgcaaccccagcgtgcccaagcagagagtgatgaagctgaccaagatggtgctggtgctggtggtggtgttcatcctgagcgccgccccctaccacgtgatccagctggtgaacctgcagatggagcagcccaccctggccttctacgtgggctactacctgagcatctgcctgagctacgccagcagcagcatcaaccccttcctgtacatcctgctgagcggcaacttccagaagagactgccccagatccagagaagagccaccgagaaggagatcaacaacatgggcaacaccctgaagagccacttctag

SEQ ID NO: 88421 - DNA, 1023 bp, Artificial Sequence; identical to SEQ ID NO: 88420
  Description of Artificial Sequence: Synthetic coding sequence

SEQ ID NO: 88422 - DNA, 1023 bp, Artificial Sequence; identical to SEQ ID NO: 88420
  Description of Artificial Sequence: Synthetic coding sequence

SEQ ID NO: 88423 - DNA, 519 bp, Artificial Sequence
  Description of Artificial Sequence: Synthetic coding sequence
atggccaacggcaccaacgccagcgccccctactacagctacgagtactacctggactacctggacctgatccccgtggacgagaagaagctgaaggcccacaagcacagcatcgtgatcgccttctgggtgagcctggccgccttcgtggtgctgctgttcctgatcctgctgtacatgagctggagcgccagcccccagatgagaaacagccccaagcaccaccagacctgcccctggagccacggcctgaacctgcacctgtgcatccagaagtgcctgccctgccacagagagcccctggccaccagccaggcccaggccagcagcgtggagcccggcagcagaaccggccccgaccagcccctgagacaggagagcagcagcaccctgcccctgggcggcttccagacccaccccaccctgctgtgggagctgaccctgaacggcggccccctggtgagaagcaagcccagcgagcccccccccggcgacagaaccagccagctgcagagctag

SEQ ID NO: 88424 - DNA, 309 bp, Artificial Sequence
  Description of Artificial Sequence: Synthetic coding sequence
atggccaacggcaccaacgccagcgccccctactacagctacgagtactacctggactacctggacctgatccccgtggacgagaagaagctgaaggcccacaagcacagcatcgtgatcgccttctgggtgagcctggccgccttcgtggtgctgctgttcctgatcctgctgtacatgagctggagcgccagcccccagatgagcttcaacaccgacgagagcctgctgcacagcgaggtgctgccccagaccagagccatcagctgcgacgagctgcaggcccccagagaggagggcgccgcctag

SEQ ID NO: 88425 - DNA, 519 bp, Artificial Sequence; identical to SEQ ID NO: 88423
  Description of Artificial Sequence: Synthetic coding sequence

SEQ ID NO: 88426 - DNA, 309 bp, Artificial Sequence; identical to SEQ ID NO: 88424
  Description of Artificial Sequence: Synthetic coding sequence

SEQ ID NO: 88427 - DNA, 1110 bp, Artificial Sequence
  Description of Artificial Sequence: Synthetic coding sequence
atgcccagagcccccaagagacagagatgcatgcccgaggaggacctgcagagccagagcgagacccagggcctggagggcgcccaggcccccctggccgtggaggaggacgccagcagcagcaccagcaccagcagcagcttccccagcagcttccccagcagcagcagcagcagcagcagcagctgctaccccctgatccccagcacccccgaggaggtgagcgccgacgacgagacccccaaccccccccagagcgcccagatcgcctgcagcagccccagcgtggtggccagcctgcccctggaccagagcgacgagggcagcagcagccagaaggaggagagccccagcaccctgcaggtgctgcccgacagcgagagcctgcccagaagcgagatcgacgagaaggtgaccgacctggtgcagttcctgctgttcaagtaccagatgaaggagcccatcaccaaggccgagatcctggagagcgtgatcagaaactacgaggaccacttccccctgctgttcagcgaggccagcgagtgcatgctgctggtgttcggcatcgacgtgaaggaggtggaccccaccggccacagcttcgtgctggtgaccagcctgggcctgacctacgacggcatgctgagcgacgtgcagagcatgcccaagaccggcatcctgatcctgatcctgagcatcgtgttcatcgagggctactgcacccccgaggaggtgatctgggaggccctgaacatgatgggcctgtacgacggcatggagcacctgatctacggcgagcccagaaagctgctgacccaggactgggtgcaggagaactacctggagtacagacaggtgcccggcagcgaccccgccagatacgagttcctgtggggccccagagcccacgccgagatcagaaagatgagcctgctgaagttcctggccaaggtgaacggcagcgaccccagaagcttccccctgtggtacgaggaggccctgaaggacgaggaggagagagcccaggacagaatcgccaccaccgacgacaccaccgccatggccagcgccagcagcagcgccaccggcagcttcagctaccccgagtag

SEQ ID NO: 88428 - DNA, 1110 bp, Artificial Sequence; identical to SEQ ID NO: 88427
  Description of Artificial Sequence: Synthetic coding sequence

SEQ ID NO: 88429 - DNA, 486 bp, Artificial Sequence
  Description of Artificial Sequence: Synthetic coding sequence
atgcccagagcccccaagagacagagatgcatgcccgaggaggacctgcagagccagagcgagacccagggcctggagggcgcccaggcccccctggccgtggaggaggacgccagcagcagcaccagcaccagcagcagcttccccagcagcttccccagcagcagcagcagcagcagcagcagctgctaccccctgatccccagcacccccgaggaggtgagcgccgacgacgagacccccaaccccccccagagcgcccagatcgcctgcagcagccccagcgtggtggccagcctgcccctggaccagagcgacgagggcagcagcagccagaaggaggagagccccagcaccctgcaggtgctgcccgacagcgagagcctgcccagaagcgagatcgacgagaaggtgaccgacctggtgcagttcctgctgttcaagtaccagatgaaggagcccatcaccaaggccgagatcctgtag

SEQ ID NO: 88430 - DNA, 573 bp, Artificial Sequence
  Description of Artificial Sequence: Synthetic coding sequence
atgcccagagcccccaagagacagagatgcatgcccgaggaggacctgcagagccagagcgagacccagggcctggagggcgcccaggcccccctggccgtggaggaggacgccagcagcagcaccagcaccagcagcagcttccccagcagcttccccagcagcagcagcagcagcagcagcagctgctaccccctgatccccagcacccccgaggaggtgagcgccgacgacgagacccccaaccccccccagagcgcccagatcgcctgcagcagccccagcgtggtggccagcctgcccctggaccagagcgacgagggcagcagcagccagaaggaggagagccccagcaccctgcaggtgctgcccgacagcgagagcctgcccagaagcgagatcgacgagaaggtgaccgacctggtgcagttcctgctgttcaagtaccagatgaaggagcccatcaccaaggccgagatcctggagagcgtgatcagaaactacgaggaccacttccccctgctgttcagcgaggccagcgagtgcatgctgctggtgttcggcatcgactag

SEQ ID NO: 88431 - DNA, 1203 bp, Artificial Sequence
  Description of Artificial Sequence: Synthetic coding sequence
atgagcaaggtgagcaccatgttcagcgaggacgacttccagagcaccgagagagccccctacggcccccagctgcagtggagccaggacctgcccagagtgcaggtgttcagagagcaggccaacctggaggacagaagccccagaagaacccagagaatcaccggcggcgagcaggtgctgtggggccccatcacccagatcttccccaccgtgagacccgccgacctgaccagagtgatcatgcccctggagcagagaagccagcactgcaagcccgaggagggcctgcaggcccaggaggaggacctgggcctggtgggcgcccaggccctgcaggccgaggagcaggaggccgccttcttcagcagcaccctgaacgtgggcaccctggaggagctgcccgccgccgagagccccagccccccccagagcccccaggaggagagcttcagccccaccgccatggacgccatcttcggcagcctgagcgacgagggcagcggcagccaggagaaggagggccccagcaccagccccgacctgatcgaccccgagagcttcagccaggacatcctgcacgacaagatcatcgacctggtgcacctgctgctgagaaagtacagagtgaagggcctgatcaccaaggccgagatgctgggcagcgtgatcaagaactacgaggactacttccccgagatcttcagagaggccagcgtgtgcatgcagctgctgttcggcatcgacgtgaaggaggtggaccccaccagccacagctacgtgctggtgaccagcctgaacctgagctacgacggcatccagtgcaacgagcagagcatgcccaagagcggcctgctgatcatcgtgctgggcgtgatcttcatggagggcaactgcatccccgaggaggtgatgtgggaggtgctgagcatcatgggcgtgtacgccggcagagagcacttcctgttcggcgagcccaagagactgctgacccagaactgggtgcaggagaagtacctggtgtacagacaggtgcccggcaccgaccccgcctgctacgagttcctgtggggccccagagcccacgccgagaccagcaagatgaaggtgctggagtacatcgccaacgccaacggcagagaccccaccagctaccccagcctgtacgaggacgccctgagagaggagggcgagggcgtgtag

SEQ ID NO: 88432 - DNA, 1290 bp, Artificial Sequence
  Description of Artificial Sequence: Synthetic coding sequence
atggagacccagttcagaagaggcggcctgggctgcagccccgccagcatcaagagaaagaagaagagagaggacagcggcgacttcggcctgcaggtgagcaccatgttcagcgaggacgacttccagagcaccgagagagccccctacggcccccagctgcagtggagccaggacctgcccagagtgcaggtgttcagagagcaggccaacctggaggacagaagccccagaagaacccagagaatcaccggcggcgagcaggtgctgtggggccccatcacccagatcttccccaccgtgagacccgccgacctgaccagagtgatcatgcccctggagcagagaagccagcactgcaagcccgaggagggcctgcaggcccaggaggaggacctgggcctggtgggcgcccaggccctgcaggccgaggagcaggaggccgccttcttcagcagcaccctgaacgtgggcaccctggaggagctgcccgccgccgagagccccagccccccccagagcccccaggaggagagcttcagccccaccgccatggacgccatcttcggcagcctgagcgacgagggcagcggcagccaggagaaggagggccccagcaccagccccgacctgatcgaccccgagagcttcagccaggacatcctgcacgacaagatcatcgacctggtgcacctgctgctgagaaagtacagagtgaagggcctgatcaccaaggccgagatgctgggcagcgtgatcaagaactacgaggactacttccccgagatcttcagagaggccagcgtgtgcatgcagctgctgttcggcatcgacgtgaaggaggtggaccccaccagccacagctacgtgctggtgaccagcctgaacctgagctacgacggcatccagtgcaacgagcagagcatgcccaagagcggcctgctgatcatcgtgctgggcgtgatcttcatggagggcaactgcatccccgaggaggtgatgtgggaggtgctgagcatcatgggcgtgtacgccggcagagagcacttcctgttcggcgagcccaagagactgctgacccagaactgggtgcaggagaagtacctggtgtacagacaggtgcccggcaccgaccccgcctgctacgagttcctgtggggccccagagcccacgccgagaccagcaagatgaaggtgctggagtacatcgccaacgccaacggcagagaccccaccagctaccccagcctgtacgaggacgccctgagagaggagggcgagggcgtgtag

SEQ ID NO: 88433 - DNA, 945 bp, Artificial Sequence
  Description of Artificial Sequence: Synthetic coding sequence
atgcccctggagcagagaagccagcactgcaagcccgaggagggcctggaggcccagggcgaggccctgggcctggtgggcgcccaggcccccgccaccgaggagcaggagaccgccagcagcagcagcaccctggtggaggtgaccctgagagaggtgcccgccgccgagagccccagccccccccacagcccccagggcgccagcaccctgcccaccaccatcaactacaccctgtggagccagagcgacgagggcagcagcaacgaggagcaggagggccccagcaccttccccgacctggagaccagcttccaggtggccctgagcagaaagatggccgagctggtgcacttcctgctgctgaagtacagagccagagagcccttcaccaaggccgagatgctgggcagcgtgatcagaaacttccaggacttcttccccgtgatcttcagcaaggccagcgagtacctgcagctggtgttcggcatcgaggtggtggaggtggtgagaatcggccacctgtacatcctggtgacctgcctgggcctgagctacgacggcctgctgggcgacaaccagatcgtgcccaagaccggcctgctgatcatcgtgctggccatcatcgccaaggagggcgactgcgcccccgaggagaagatctgggaggagctgagcgtgctggaggccagcgacggcagagaggacagcgtgttcgcccaccccagaaagctgctgacccaggacctggtgcaggagaactacctggagtacagacaggtgcccggcagcgaccccgcctgctacgagttcctgtggggccccagagccctggtggagaccagctacgtgaaggtgctgcaccacctgctgaagatcagcggcggcccccacatcagctacccccccctgcacgagtgggccttcagagagggcgaggagtag

SEQ ID NO: 88434 - DNA, 945 bp, Artificial Sequence; identical to SEQ ID NO: 88433
  Description of Artificial Sequence: Synthetic coding sequence

SEQ ID NO: 88435 - DNA, 945 bp, Artificial Sequence; identical to SEQ ID NO: 88433
  Description of Artificial Sequence: Synthetic coding sequence

SEQ ID NO: 88436 - DNA, 945 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcagcagaccgccagcagcagcagcaccctggtggaggtgaccctgggcgaggtgcccgccgccgacagccccagccccccccacagcccccagggcgccagcagcttcagcaccaccatcaactacaccctgtggagacagagcgacgagggcagcagcaaccaggaggaggagggccccagaatgttccccgacctggagagcgagttccaggccgccatcagcagaaagatggtggagctggtgcacttcctgctgctgaagtacagagccagagagcccgtgaccaaggccgagatgctggagagcgtgctgagaaactgccaggacttcttccccgtgatcttcagcaaggccagcgagtacctgcagctggtgttcggcatcgaggtggtggaggtggtgcccatcagccacctgtacatcctggtgacctgcctgggcctgagctacgacggcctgctgggcgacaaccaggtgatgcccaagaccggcctgctgatcatcgtgctggccatcatcgccatcgagggcgactgcgcccccgaggagaagatctgggaggagctgagcatgctggaggtgttcgagggcagagaggacagcgtgttcgcccaccccagaaagctgctgatgcaggacctggtgcaggagaactacctggagtacagacaggtgcccggcagcgaccccgcctgctacgagttcctgtggggccccagagccctgatcgagaccagctacgtgaaggtgctgcaccacaccctgaagatcggcggcgagccccacatcagctacccccccctgcacgagagagccctgagagagggcgaggagtag

SEQ ID NO: 88437 - DNA, 945 bp, Artificial Sequence; identical to SEQ ID NO: 88436
  Description of Artificial Sequence: Synthetic coding sequence

SEQ ID NO: 88438 - DNA, 945 bp, Artificial Sequence; identical to SEQ ID NO: 88436
  Description of Artificial Sequence: Synthetic coding sequence

SEQ ID NO: 88439 - DNA, 945 bp, Artificial Sequence; identical to SEQ ID NO: 88436
  Description of Artificial Sequence: Synthetic coding sequence

SEQ ID NO: 88440 - DNA, 945 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcaggaggccgccagcagcagcagcaccctggtggaggtgaccctgggcgaggtgcccgccgccgagagccccgaccccccccagagcccccagggcgccagcagcctgcccaccaccatgaactaccccctgtggagccagagctacgaggacagcagcaaccaggaggaggagggccccagcaccttccccgacctggagagcgagttccaggccgccctgagcagaaaggtggccgagctggtgcacttcctgctgctgaagtacagagccagagagcccgtgaccaaggccgagatgctgggcagcgtggtgggcaactggcagtacttcttccccgtgatcttcagcaaggccagcagcagcctgcagctggtgttcggcatcgagctgatggaggtggaccccatcggccacctgtacatcttcgccacctgcctgggcctgagctacgacggcctgctgggcgacaaccagatcatgcccaaggccggcctgctgatcatcgtgctggccatcatcgccagagagggcgactgcgcccccgaggagaagatctgggaggagctgagcgtgctggaggtgttcgagggcagagaggacagcatcctgggcgaccccaagaagctgctgacccagcacttcgtgcaggagaactacctggagtacagacaggtgcccggcagcgaccccgcctgctacgagttcctgtggggccccagagccctggtggagaccagctacgtgaaggtgctgcaccacatggtgaagatcagcggcggcccccacatcagctacccccccctgcacgagtgggtgctgagagagggcgaggagtag

SEQ ID NO: 88441 - DNA, 945 bp, Artificial Sequence; identical to SEQ ID NO: 88440
  Description of Artificial Sequence: Synthetic coding sequence

SEQ ID NO: 88442 - DNA, 597 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcaggaggccgccagcagcagcagcaccctggtggaggtgaccctgggcgaggtgcccgccgccgagagccccgaccccccccagagcccccagggcgccagcagcctgcccaccaccatgaactaccccctgtggagccagagctacgaggacagcagcaaccaggaggaggagggccccagcaccttccccgacctggagagcgagttccaggccgccctgagcagaaaggtggccgagctggtgcacttcctgctgctgaagtacagagccagagagcccgtgaccaaggccgagatgctgggcagcgtggtgggcaactggcagtacttcttccccgtgatcttcagcaaggccagcagcagcctgcagctggtgttcggcatcgagctgatggaggtggaccccatcggccacctgtacatcttcgccacctgcctgggcctgagctacgacggcctgctgggcgacaaccagatcatgcccaagtag

SEQ ID NO: 88443 - DNA, 954 bp, Artificial Sequence
  Description of Artificial Sequence: Synthetic coding sequence
atgagcagcgagcagaagagccagcactgcaagcccgaggagggcgtggaggcccaggaggaggccctgggcctggtgggcgcccaggcccccaccaccgaggagcaggaggccgccgtgagcagcagcagccccctggtgcccggcaccctggaggaggtgcccgccgccgagagcgccggccccccccagagcccccagggcgccagcgccctgcccaccaccatcagcttcacctgctggagacagcccaacgagggcagcagcagccaggaggaggagggccccagcaccagccccgacgccgagagcctgttcagagaggccctgagcaacaaggtggacgagctggcccacttcctgctgagaaagtacagagccaaggagctggtgaccaaggccgagatgctggagagagtgatcaagaactacaagagatgcttccccgtgatcttcggcaaggccagcgagagcctgaagatgatcttcggcatcgacgtgaaggaggtggaccccgccagcaacacctacaccctggtgacctgcctgggcctgagctacgacggcctgctgggcaacaaccagatcttccccaagaccggcctgctgatcatcgtgctgggcaccatcgccatggagggcgacagcgccagcgaggaggagatctgggaggagctgggcgtgatgggcgtgtacgacggcagagagcacaccgtgtacggcgagcccagaaagctgctgacccaggactgggtgcaggagaactacctggagtacagacaggtgcccggcagcaaccccgccagatacgagttcctgtggggccccagagccctggccgagaccagctacgtgaaggtgctggagcacgtggtgagagtgaacgccagagtgagaatcgcctaccccagcctgagagaggccgccctgctggaggaggaggagggcgtgtag

SEQ ID NO: 88444 - DNA, 954 bp, Artificial Sequence; identical to SEQ ID NO: 88443
  Description of Artificial Sequence: Synthetic coding sequence

SEQ ID NO: 88445 - DNA, 954 bp, Artificial Sequence; identical to SEQ ID NO: 88443
  Description of Artificial Sequence: Synthetic coding sequence

SEQ ID NO: 88446 - DNA, 954 bp, Artificial Sequence; identical to SEQ ID NO: 88443
  Description of Artificial Sequence: Synthetic coding sequence

SEQ ID NO: 88447 - DNA, 954 bp, Artificial Sequence; identical to SEQ ID NO: 88443
  Description of Artificial Sequence: Synthetic coding sequence

SEQ ID NO: 88448 - DNA, 954 bp, Artificial Sequence; identical to SEQ ID NO: 88443
  Description of Artificial Sequence: Synthetic coding sequence

SEQ ID NO: 88449 - DNA, 954 bp, Artificial Sequence; identical to SEQ ID NO: 88443
  Description of Artificial Sequence: Synthetic coding sequence

SEQ ID NO: 88450 - DNA, 693 bp, Artificial Sequence
  Description of Artificial Sequence: Synthetic coding sequence
atgagcagcgagcagaagagccagcactgcaagcccgaggagggcgtggaggcccaggaggaggccctgggcctggtgggcgcccaggcccccaccaccgaggagcaggaggccgccgtgagcagcagcagccccctggtgcccggcaccctggaggaggtgcccgccgccgagagcgccggccccccccagagcccccagggcgccagcgccctgcccaccaccatcagcttcacctgctggagacagcccaacgagggcagcagcagccaggaggaggagggccccagcaccagccccgacgccgagagcctgttcagagaggccctgagcaacaaggtggacgagctggcccacttcctgctgagaaagtacagagccaaggagctggtgaccaaggccgagatgctggagagagtgatcaagaactacaagagatgcttccccgtgatcttcggcaaggccagcgagagcctgaagatgatcttcggcatcgacgtgaaggaggtggaccccgccagcaacacctacaccctggtgacctgcctgggcctgagctacgacggcctgctgggcaacaaccagatcttccccaagaccggcctgctgatcatcgtgctgggcaccatcgccatggagggcgacagcgccagcgaggaggagatctgggaggagctgggcgtgatgggctag

SEQ ID NO: 88451 - DNA, 654 bp, Artificial Sequence
  Description of Artificial Sequence: Synthetic coding sequence
atgagcagcgagcagaagagccagcactgcaagcccgaggagggcgtggaggcccaggaggaggccctgggcctggtgggcgcccaggcccccaccaccgaggagcaggaggccgccgtgagcagcagcagccccctggtgcccggcaccctggaggaggtgcccgccgccgagagcgccggccccccccagagcccccagggcgccagcgccctgcccaccaccatcagcttcacctgctggagacagcccaacgagggcagcagcagccaggaggaggagggccccagcaccagccccgacgccgagagcctgttcagagaggccctgagcaacaaggtggacgagctggcccacttcctgctgagaaagtacagagccaaggagctggtgaccaaggccgagatgctggagagagtgatcaagaactacaagagatgcttccccgtgatcttcggcaaggccagcgagagcctgaagatgatcttcggcatcgacgtgaaggaggtggaccccgccagcaacacctacaccctggtgacctgcctgggcctgagctacgacggcctgctgggcaacaaccagatcttccccaagaccggcctgctgatcatcgtgctgggcaccatcgccatggagggcgacagcgcctag

SEQ ID NO: 88452 - DNA, 726 bp, Artificial Sequence
  Description of Artificial Sequence: Synthetic coding sequence
atgagcagcgagcagaagagccagcactgcaagcccgaggagggcgtggaggcccaggaggaggccctgggcctggtgggcgcccaggcccccaccaccgaggagcaggaggccgccgtgagcagcagcagccccctggtgcccggcaccctggaggaggtgcccgccgccgagagcgccggccccccccagagcccccagggcgccagcgccctgcccaccaccatcagcttcacctgctggagacagcccaacgagggcagcagcagccaggaggaggagggccccagcaccagccccgacgccgagagcctgttcagagaggccctgagcaacaaggtggacgagctggcccacttcctgctgagaaagtacagagccaaggagctggtgaccaaggccgagatgctggagagagtgatcaagaactacaagagatgcttccccgtgatcttcggcaaggccagcgagagcctgaagatgatcttcggcatcgacgtgaaggaggtggaccccgccagcaacacctacaccctggtgacctgcctgggcctgagctacgacggcctgctgggcaacaaccagatcttccccaagaccggcctgctgatcatcgtgctgggcaccatcgccatggagggcgacagcgccagcgaggaggagatctgggaggagctgggcgtgatgggcgtgtacgacggcagagagcacaccgtgtacggctag

SEQ ID NO: 88453 - DNA, 519 bp, Artificial Sequence
  Description of Artificial Sequence: Synthetic coding sequence
atgagcagcgagcagaagagccagcactgcaagcccgaggagggcgtggaggcccaggaggaggccctgggcctggtgggcgcccaggcccccaccaccgaggagcaggaggccgccgtgagcagcagcagccccctggtgcccggcaccctggaggaggtgcccgccgccgagagcgccggccccccccagagcccccagggcgccagcgccctgcccaccaccatcagcttcacctgctggagacagcccaacgagggcagcagcagccaggaggaggagggccccagcaccagccccgacgccgagagcctgttcagagaggccctgagcaacaaggtggacgagctggcccacttcctgctgagaaagtacagagccaaggagctggtgaccaaggccgagatgctggagagagtgatcaagaactacaagagatgcttccccgtgatcttcggcaaggccagcgagagcctgaagatgatcttcggcatcgacgtgaaggaggtggacccctag

SEQ ID NO: 88454 - DNA, 726 bp, Artificial Sequence; identical to SEQ ID NO: 88452
  Description of Artificial Sequence: Synthetic coding sequence

SEQ ID NO: 88455 - DNA, 726 bp, Artificial Sequence; identical to SEQ ID NO: 88452
  Description of Artificial Sequence: Synthetic coding sequence

SEQ ID NO: 88456 - DNA, 654 bp, Artificial Sequence; identical to SEQ ID NO: 88451
  Description of Artificial Sequence: Synthetic coding sequence

SEQ ID NO: 88457 - DNA, 726 bp, Artificial Sequence; identical to SEQ ID NO: 88452
  Description of Artificial Sequence: Synthetic coding sequence

SEQ ID NO: 88458 - DNA, 945 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcaggaggccgccagcagcagcagcaccctggtggaggtgaccctgggcgaggtgcccgccgccgagagccccgaccccccccagagcccccagggcgccagcagcctgcccaccaccatgaactaccccctgtggagccagagctacgaggacagcagcaaccaggaggaggagggccccagcaccttccccgacctggagagcgagttccaggccgccctgagcagaaaggtggccaagctggtgcacttcctgctgctgaagtacagagccagagagcccgtgaccaaggccgagatgctgggcagcgtggtgggcaactggcagtacttcttccccgtgatcttcagcaaggccagcgacagcctgcagctggtgttcggcatcgagctgatggaggtggaccccatcggccacgtgtacatcttcgccacctgcctgggcctgagctacgacggcctgctgggcgacaaccagatcatgcccaagaccggcttcctgatcatcatcctggccatcatcgccaaggagggcgactgcgcccccgaggagaagatctgggaggagctgagcgtgctggaggtgttcgagggcagagaggacagcatcttcggcgaccccaagaagctgctgacccagtacttcgtgcaggagaactacctggagtacagacaggtgcccggcagcgaccccgcctgctacgagttcctgtggggccccagagccctgatcgagaccagctacgtgaaggtgctgcaccacatggtgaagatcagcggcggccccagaatcagctaccccctgctgcacgagtgggccctgagagagggcgaggagtag

SEQ ID NO: 88459 - DNA, 606 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcaggaggccgccagcagcagcagcaccctggtggaggtgaccctgggcgaggtgcccgccgccgagagccccgaccccccccagagcccccagggcgccagcagcctgcccaccaccatgaactaccccctgtggagccagagctacgaggacagcagcaaccaggaggaggagggccccagcaccttccccgacctggagagcgagttccaggccgccctgagcagaaaggtggccaagctggtgcacttcctgctgctgaagtacagagccagagagcccgtgaccaaggccgagatgctgggcagcgtggtgggcaactggcagtacttcttccccgtgatcttcagcaaggccagcgacagcctgcagctggtgttcggcatcgagctgatggaggtggaccccatcggccacgtgtacatcttcgccacctgcctgggcctgagctacgacggcctgctgggcgacaaccagatcatgcccaagaccggcttctag

SEQ ID NO: 88460 - DNA, 708 bp, Artificial Sequence
  Description of Artificial Sequence: Synthetic coding sequence
atgcccctggagcagagaagccagcactgcaagcccgaggagggcctggaggccagaggcgaggccctgggcctggtgggcgcccaggcccccgccaccgaggagcaggaggccgccagcagcagcagcaccctggtggaggtgaccctgggcgaggtgcccgccgccgagagccccgaccccccccagagcccccagggcgccagcagcctgcccaccaccatgaactaccccctgtggagccagagctacgaggacagcagcaaccaggaggaggagggccccagcaccttccccgacctggagagcgagttccaggccgccctgagcagaaaggtggccaagctggtgcacttcctgctgctgaagtacagagccagagagcccgtgaccaaggccgagatgctgggcagcgtggtgggcaactggcagtacttcttccccgtgatcttcagcaaggccagcgacagcctgcagctggtgttcggcatcgagctgatggaggtggaccccatcggccacgtgtacatcttcgccacctgcctgggcctgagctacgacggcctgctgggcgacaaccagatcatgcccaagaccggcttcctgatcatcatcctggccatcatcgccaaggagggcgactgcgcccccgaggagaagatctgggaggagctgagcgtgctggaggtgttcgagggcagagagtag

SEQ ID NO: 88461 - DNA, 957 bp, Artificial Sequence
  Description of Artificial Sequence: Synthetic coding sequence
atgctgctgggccagaagagccagagatacaaggccgaggagggcctgcaggcccagggcgaggcccccggcctgatggacgtgcagatccccaccgccgaggagcagaaggccgccagcagcagcagcaccctgatcatgggcaccctggaggaggtgaccgacagcggcagccccagccccccccagagccccgagggcgccagcagcagcctgaccgtgaccgacagcaccctgtggagccagagcgacgagggcagcagcagcaacgaggaggagggccccagcaccagccccgaccccgcccacctggagagcctgttcagagaggccctggacgagaaggtggccgagctggtgagattcctgctgagaaagtaccagatcaaggagcccgtgaccaaggccgagatgctggagagcgtgatcaagaactacaagaaccacttccccgacatcttcagcaaggccagcgagtgcatgcaggtgatcttcggcatcgacgtgaaggaggtggaccccgccggccacagctacatcctggtgacctgcctgggcctgagctacgacggcctgctgggcgacgaccagagcacccccaagaccggcctgctgatcatcgtgctgggcatgatcctgatggagggcagcagagcccccgaggaggccatctgggaggccctgagcgtgatgggcctgtacgacggcagagagcacagcgtgtactggaagctgagaaagctgctgacccaggagtgggtgcaggagaactacctggagtacagacaggcccccggcagcgaccccgtgagatacgagttcctgtggggccccagagccctggccgagaccagctacgtgaaggtgctggagcacgtggtgagagtgaacgccagagtgagaatcagctaccccagcctgcacgaggaggccctgggcgaggagaagggcgtgtag

SEQ ID NO: 88462 - DNA, 957 bp, Artificial Sequence; identical to SEQ ID NO: 88461
  Description of Artificial Sequence: Synthetic coding sequence

SEQ ID NO: 88463 - DNA, 957 bp, Artificial Sequence; identical to SEQ ID NO: 88461
  Description of Artificial Sequence: Synthetic coding sequence

SEQ ID NO: 88464 - DNA, 948 bp, Artificial Sequence
  Description of Artificial Sequence: Synthetic coding sequence
atgagcctggagcagagaagcccccactgcaagcccgacgaggacctggaggcccagggcgaggacctgggcctgatgggcgcccaggagcccaccggcgaggaggaggagaccaccagcagcagcgacagcaaggaggaggaggtgagcgccgccggcagcagcagccccccccagagcccccagggcggcgccagcagcagcatcagcgtgtactacaccctgtggagccagttcgacgagggcagcagcagccaggaggaggaggagcccagcagcagcgtggaccccgcccagctggagttcatgttccaggaggccctgaagctgaaggtggccgagctggtgcacttcctgctgcacaagtacagagtgaaggagcccgtgaccaaggccgagatgctggagagcgtgatcaagaactacaagagatacttccccgtgatcttcggcaaggccagcgagttcatgcaggtgatcttcggcaccgacgtgaaggaggtggaccccgccggccacagctacatcctggtgaccgccctgggcctgagctgcgacagcatgctgggcgacggccacagcatgcccaaggccgccctgctgatcatcgtgctgggcgtgatcctgaccaaggacaactgcgcccccgaggaggtgatctgggaggccctgagcgtgatgggcgtgtacgtgggcaaggagcacatgttctacggcgagcccagaaagctgctgacccaggactgggtgcaggagaactacctggagtacagacaggtgcccggcagcgaccccgcccactacgagttcctgtggggcagcaaggcccacgccgagaccagctacgagaaggtgatcaactacctggtgatgctgaacgccagagagcccatctgctaccccagcctgtacgaggaggtgctgggcgaggagcaggagggcgtgtag

SEQ ID NO: 88465 - DNA, 345 bp, Artificial Sequence
  Description of Artificial Sequence: Synthetic coding sequence
atgagcctggagcagagaagcccccactgcaagcccgacgaggacctggaggcccagggcgaggacctgggcctgatgggcgcccaggagcccaccggcgaggaggaggagaccaccagcagcagcgacagcaaggaggaggaggtgagcgccgccggcagcagcagccccccccagagcccccagggcggcgccagcagcagcatcagcgtgtactacaccctgtggagccagttcgacgagggcagcagcagccaggaggaggaggagcccagcagcagcgtggaccccgcccagctggagttcatgttccaggaggccctgaagctgaaggtggccgagtag

SEQ ID NO: 88466 - DNA, 930 bp, Artificial Sequence
  Description of Artificial Sequence: Synthetic coding sequence
atgagcctggagcagagaagcccccactgcaagcccgacgaggacctggaggcccagggcgaggacctgggcctgatgggcgcccaggagcccaccggcgaggaggaggagaccaccagcagcagcgacagcaaggaggaggaggtgagcgccgccggcagcagcagccccccccagagcccccagggcggcgccagcagcagcatcagcgtgtactacaccctgtggagccagttcgacgagggcagcagcagccaggaggaggaggagcccagcagcagcgtggaccccgcccagctggagttcatgttccaggaggccctgaagctgaaggtggccgagctggtgcacttcctgctgcacaagtacagagtgaaggagcccgtgaccaaggccgagatgctggagagcgtgatcaagaactacaagagatacttccccgtgatcttcggcaaggccagcgagttcatgcaggtgatcttcggcaccgacgtgaaggaggtggaccccgccggccacagctacatcctggtgaccgccctgggcctgagctgcgacagcatgctgggcgacggccacagcatgcccaaggccgccctgctgatcatcgtgctgggcgtgatcctgaccaaggacaactgcgcccccgaggaggtgatctgggaggccctgagcgtgatgggcgtgtacgtgggcaaggagcacatgttctacggcgagcccagaaagctgctgacccaggactgggtgcaggagaactacctggagtacagacaggtgcccggcagcgaccccgcccactacgagttcctgtggggcagcaaggcccacgccgagaccagctacgagaaggtgatcaactacctggtgatgctgaacgccagagagcccatctgctaccccagcctgtacgaggaggtgctgggctag

SEQ ID NO: 88467 - DNA, 591 bp, Artificial Sequence
  Description of Artificial Sequence: Synthetic coding sequence
atgagcctggagcagagaagcccccactgcaagcccgacgaggacctggaggcccagggcgaggacctgggcctgatgggcgcccaggagcccaccggcgaggaggaggagaccaccagcagcagcgacagcaaggaggaggaggtgagcgccgccggcagcagcagccccccccagagcccccagggcggcgccagcagcagcatcagcgtgtactacaccctgtggagccagttcgacgagggcagcagcagccaggaggaggaggagcccagcagcagcgtggaccccgcccagctggagttcatgttccaggaggccctgaagctgaaggtggccgagctggtgcacttcctgctgcacaagtacagagtgaaggagcccgtgaccaaggccgagatgctggagagcgtgatcaagaactacaagagatacttccccgtgatcttcggcaaggccagcgagttcatgcaggtgatcttcggcaccgacgtgaaggaggtggaccccgccggccacagctacatcctggtgaccgccctgggcctgagctgcgacagcatgctgggcgacggccacagcatgccctag

SEQ ID NO: 88468 - DNA, 294 bp, Artificial Sequence
  Description of Artificial Sequence: Synthetic coding sequence
atgagcctggagcagagaagcccccactgcaagcccgacgaggacctggaggcccagggcgaggacctgggcctgatgggcgcccaggagcccaccggcgaggaggaggagaccaccagcagcagcgacagcaaggaggaggaggtgagcgccgccggcagcagcagccccccccagagcccccagggcggcgccagcagcagcatcagcgtgtactacaccctgtggagccagttcgacgagggcagcagcagccaggaggaggaggagcccagcagcagcgtggacccctag

SEQ ID NO: 88469 - DNA, 948 bp, Artificial Sequence; identical to SEQ ID NO: 88464
  Description of Artificial Sequence: Synthetic coding sequence

SEQ ID NO: 88470 - DNA, 1044 bp, Artificial Sequence
  Description of Artificial Sequence: Synthetic coding sequence
atgcccagaggccagaagagcaagctgagagccagagagaagagaagaaaggccagagaggagacccagggcctgaaggtggcccacgccaccgccgccgagaaggaggagtgccccagcagcagccccgtgctgggcgacacccccaccagcagccccgccgccggcatcccccagaagccccagggcgccccccccaccaccaccgccgccgccgccgtgagctgcaccgagagcgacgagggcgccaagtgccagggcgaggagaacgccagcttcagccaggccaccaccagcaccgagagcagcgtgaaggaccccgtggcctgggaggccggcatgctgatgcacttcatcctgagaaagtacaagatgagagagcccatcatgaaggccgacatgctgaaggtggtggacgagaagtacaaggaccacttcaccgagatcctgaacggcgccagcagaagactggagctggtgttcggcctggacctgaaggaggacaaccccagcggccacacctacaccctggtgagcaagctgaacctgaccaacgacggcaacctgagcaacgactgggacttccccagaaacggcctgctgatgcccctgctgggcgtgatcttcctgaagggcaacagcgccaccgaggaggagatctggaagttcatgaacgtgctgggcgcctacgacggcgaggagcacctgatctacggcgagcccagaaagttcatcacccaggacctggtgcaggagaagtacctgaagtacgagcaggtgcccaacagcgacccccccagataccagttcctgtggggccccagagcctacgccgagaccaccaagatgaaggtgctggagttcctggccaagatgaacggcgccacccccagagacttccccagccactacgaggaggccctgagagacgaggaggagagagcccaggtgagaagcagcgtgagagccagaagaagaaccaccgccaccaccttcagagccagaagcagagcccccttcagcagaagcagccaccccatgtag

SEQ ID NO: 88471 - DNA, 1044 bp, Artificial Sequence; identical to SEQ ID NO: 88470
  Description of Artificial Sequence: Synthetic coding sequence

SEQ ID NO: 88472 - DNA, 1044 bp, Artificial Sequence; identical to SEQ ID NO: 88470
  Description of Artificial Sequence: Synthetic coding sequence

SEQ ID NO: 88473 - DNA, 1044 bp, Artificial Sequence
  Description of Artificial Sequence: Synthetic coding sequence
atgcccagaggccagaagagcaagctgagagccagagagaagagaagacaggccagaggcggcctggaggacctgatcgacgccctggacatcctggaggaggaggaggagagcccccccagcgccagcgcctgcctgaaggacgtgttccagagcagcctggacggcgccagcaacaacccccacggcctgagagaggcccagagcaccagcaccagcgccaccgccgccagccacaccagacaccccgagggcgtgaacgaccagatggaggagagacccatctgcacccaggacctggaggccaccgacagcttccccagaggccccgtggacgagaaggtgatcatcctggtgcactacctgctgtacaagtaccagatgaaggagcccatcaccaaggccgacatgctgagaaacgtgacccagatgagcaagagccagttccccgtgatcctgagcagagccagcgagcacctggagctgatcttcggcctggacctgaaggaggtggagcccaacaagcacatctacgtgctggtgaacaagctggacctgggctgcgacgccaagctgagcgacgagaccggcgtgcccaagaccggcctgctgatgaccgtgctgggcatcatcttcaccaacggcaactgcgtggccgaggaggaggtgtggaaggtgttcaacaccatgggcctgtacgacggcatcgagcacttcatgttcggcgagcccagaaagctgctgaccaaggacctggtgaaggagaactacctggagtaccagcaggtgcccaacagcgacccccccagataccagttcctgtggggccccagagcccacgccgagaccagcaagatgaaggtgctggagttcctggccaaggtgaacgacaccgcccccagcgagttcagcaactggtacaccgaggccctgcaggacgaggaggagagagccagagccagagtggccgccaaggccagagtgagcgccaccgccggcgccagaagcaaggtgaagagcagcaagagcagccagctgcagtag

SEQ ID NO: 88474 - DNA, 975 bp, Artificial Sequence
  Description of Artificial Sequence: Synthetic coding sequence
atgagccaggaccaggagagccccagatgcacccacgaccagcacctgcagaccttcagcgagacccagagcctggaggtggcccaggtgagcaaggccctggagaagaccctgctgagcagcagccaccccctggtgcccggcaagctgaaggaggcccccgccgccaaggccgagagccccctggaggtgccccagagcttctgcagcagcagcatcgccgtgaccaccaccagcagcagcgagagcgacgaggccagcagcaaccaggaggaggaggacagccccagcagcagcgaggacaccagcgaccccagaaacgtgcccgccgacgccctggaccagaaggtggccttcctggtgaacttcatgctgcacaagtgccagatgaagaagcccatcaccaaggccgacatgctgaagatcatcatcaaggacgacgagagccacttcagcgagatcctgctgagagccagcgagcacctggagatgatcttcggcctggacgtggtggaggtggaccccaccacccactgctacggcctgttcatcaagctgggcctgacctacgacggcatgctgagcggcgagaagggcgtgcccaagaccggcctgctgatcatcgtgctgggcgtgatcttcatgaagggcaacagagccaccgaggaggaggtgtgggaggtgctgaacctgaccggcgtgtacagcggcaagaagcacttcatcttcggcgagcccagaatgctgatcaccaaggacttcgtgaaggagaagtacctggagtaccagcaggtggccaacagcgaccccgccagatacgagttcctgtggggccccagagccaaggccgagaccagcaagatgaaggtgctggagttcgtggccaaggtgcacggcagctacccccacagcttccccagccagtacgccgaggccctgaaggaggaggaggagagagccagagccagaatctag

SEQ ID NO: 88475 - DNA, 975 bp, Artificial Sequence; identical to SEQ ID NO: 88474
  Description of Artificial Sequence: Synthetic coding sequence

SEQ ID NO: 88476 - DNA, 975 bp, Artificial Sequence; identical to SEQ ID NO: 88474
  Description of Artificial Sequence: Synthetic coding sequence

SEQ ID NO: 88477 - DNA, 975 bp, Artificial Sequence; identical to SEQ ID NO: 88474
  Description of Artificial Sequence: Synthetic coding sequence

SEQ ID NO: 88478 - DNA, 1071 bp, Artificial Sequence
  Description of Artificial Sequence: Synthetic coding sequence
atgggcaccgaggcccagcccgtggtgaaggccgtgatcctgcactgcctgcccagctgcccccacagctgcctgctgccccccaccagagtgatcatgagccaggaccaggagagccccagatgcacccacgaccagcacctgcagaccttcagcgagacccagagcctggaggtggcccaggtgagcaaggccctggagaagaccctgctgagcagcagccaccccctggtgcccggcaagctgaaggaggcccccgccgccaaggccgagagccccctggaggtgccccagagcttctgcagcagcagcatcgccgtgaccaccaccagcagcagcgagagcgacgaggccagcagcaaccaggaggaggaggacagccccagcagcagcgaggacaccagcgaccccagaaacgtgcccgccgacgccctggaccagaaggtggccttcctggtgaacttcatgctgcacaagtgccagatgaagaagcccatcaccaaggccgacatgctgaagatcatcatcaaggacgacgagagccacttcagcgagatcctgctgagagccagcgagcacctggagatgatcttcggcctggacgtggtggaggtggaccccaccacccactgctacggcctgttcatcaagctgggcctgacctacgacggcatgctgagcggcgagaagggcgtgcccaagaccggcctgctgatcatcgtgctgggcgtgatcttcatgaagggcaacagagccaccgaggaggaggtgtgggaggtgctgaacctgaccggcgtgtacagcggcaagaagcacttcatcttcggcgagcccagaatgctgatcaccaaggacttcgtgaaggagaagtacctggagtaccagcaggtggccaacagcgaccccgccagatacgagttcctgtggggccccagagccaaggccgagaccagcaagatgaaggtgctggagttcgtggccaaggtgcacggcagctacccccacagcttccccagccagtacgccgaggccctgaaggaggaggaggagagagccagagccagaatctag

SEQ ID NO: 88479 - DNA, 996 bp, Artificial Sequence
  Description of Artificial Sequence: Synthetic coding sequence
atgcccagaggccaggccagcaagagaagagccagagagaagagaagacaggccagaggcgaggaccagtgcctgggcggcgcccaggccaccgccgccgagaaggagaagctgcccagcagcagcagccccgcctgccagagccccccccagagcttccccaacgccggcatcccccaggagagccagagagccagctaccccagcagccccgccagcgccgtgagcctgaccagcagcgacgagggcgccaagggccagaagggcgagagccccaacagcttccacggccccagcagcagcgagagcaccggcagagacctgctgaacaccaagaccggcgagctggtgcagttcctgctgaacaagtacatcagaaaggagcccatcaccagagaggccatgctgaaggtgatcaacagaaagtacaagcagcacttccccgagatcctgagaagaagcaccgagaacgtggaggtggtgttcggcctgtacctgaaggagatggaccccagcagacagagctacgtgctggtgggcaagctggacttccccaaccagggcagcctgagcgacggcggcggcttccccctgagcggcctgctgatggtgctgctgagcaccatcttcatgcacggcaacagagccaccgaggaggagatgtgggagtgcctgaacgccctgggcatgtacaagggcagaaagcacttcatctacggcgagccccaggagctggtgaccaaggacctggtgagagagggctacctggagtaccagcaggtgcccagcagcgacccccccagatacgagttcctgtggggccccagagccagagccgagaccagcaagatgaaggtgctggagttcgtggccaagctgaacgacaccgtggccagcacctacaagagcagatacgaggaggccctgagagaggaggaggagcaggccagagccagagccgtggccagagacagcgccagagccagagccagctag

SEQ ID NO: 88480 - DNA, 1011 bp, Artificial Sequence
  Description of Artificial Sequence: Synthetic coding sequence
atgcccagaggccaggccagcaagagaagagccagagagaagagaagacaggccagaggcgaggaccagtgcctgggcggcgcccaggccaccgccgccgagaaggagaagctgcccagcagcagcagccccgcctgccagagccccccccagagcttccccaacgccggcatcccccaggagagccagagagccagctaccccagcagccccgccagcgccgtgagcctgaccagcagcgacgagggcgccaagggccagaagggcgagagccccaacagcttccacggccccagcagcagcgagagcaccggcagagacctgctgaacaccaagaccggcgagctggtgcagttcctgctgaacaagtacatcagaaaggagcccatcaccagagaggccatgctgaaggtgatcaacagaaagtacaagcagcacttccccgagatcctgagaagaagcaccgagaacgtggaggtggtgttcggcctgtacctgaaggagatggaccccagcagacagagctacgtgctggtgggcaagctggacttccccaaccagggcagcctgagcgacggcggcggcttccccctgagcggcctgctgatggtgctgctgagcaccatcttcatgcacggcaacagagccaccgaggaggagatgtgggagtgcctgaacgccctgggcatgtacaagggcagaaagcacttcatctacggcgagccccaggagctggtgaccaaggacctggtgagagagggctacctggagtaccagcaggtgcccagcagcgacccccccagatacgagttcctgtggggccccagagccagagccgagaccagcaagatgaaggtgctggagttcgtggccaagctgaacgacaccgtggccagcacctacaagagcagatacgaggaggccctgagagaggaggaggagcaggccagagccagagccgtggccagagacagcgccagagccagagccagcagaagcttccagccctag

SEQ ID NO: 88481 - DNA, 1011 bp, Artificial Sequence; identical to SEQ ID NO: 88480
  Description of Artificial Sequence: Synthetic coding sequence

SEQ ID NO: 88482 - DNA, 960 bp, Artificial Sequence
  Description of Artificial Sequence: Synthetic coding sequence
atgcccagaggccagaagagcaagctgagagccagagagaagagaagaaaggccagagacgagaccagaggcctgaacgtgccccaggtgaccgaggccgaggaggaggaggccccctgctgcagcagcagcgtgagcggcggcgccgccagcagcagccccgccgccggcatcccccaggagccccagagagcccccaccaccgccgccgccgccgccgccggcgtgagcagcaccaagagcaagaagggcgccaagagccaccagggcgagaagaacgccagcagcagccaggccagcaccagcaccaagagccccagcgaggaccccctgaccagaaagagcggcagcctggtgcagttcctgctgtacaagtacaagatcaagaagagcgtgaccaagggcgagatgctgaagatcgtgggcaagagattcagagagcacttccccgagatcctgaagaaggccagcgagggcctgagcgtggtgttcggcctggagctgaacaaggtgaaccccaacggccacacctacaccttcatcgacaaggtggacctgaccgacgaggagagcctgctgagcagctgggacttccccagaagaaagctgctgatgcccctgctgggcgtgatcttcctgaacggcaacagcgccaccgaggaggagatctgggagttcctgaacatgctgggcgtgtacgacggcgaggagcacagcgtgttcggcgagccctggaagctgatcaccaaggacctggtgcaggagaagtacctggagtacaagcaggtgcccagcagcgacccccccagattccagttcctgtggggccccagagcctacgccgagaccagcaagatgaaggtgctggagttcctggccaaggtgaacggcaccaccccctgcgccttccccacccactacgaggaggccctgaaggacgaggagaaggccggcgtgtag

SEQ ID NO: 88483 - DNA, 1041 bp, Artificial Sequence
  Description of Artificial Sequence: Synthetic coding sequence
atgcccagaggccagaagagcaccctgcacgccagagagaagagacagcagaccagaggccagacccaggaccaccagggcgcccagatcaccgccaccaacaagaagaaggtgagcttcagcagccccctgatcctgggcgccaccatccagaagaagagcgccggcagaagcagaagcgccctgaagaagccccagagagccctgagcaccaccaccagcgtggacgtgagctacaagaagagctacaagggcgccaacagcaagatcgagaagaagcagagcttcagccagggcctgagcagcaccgtgcagagcagaaccgaccccctgatcatgaagaccaacatgctggtgcagttcctgatggagatgtacaagatgaagaagcccatcatgaaggccgacatgctgaagatcgtgcagaagagccacaagaactgcttccccgagatcctgaagaaggccagcttcaacatggaggtggtgttcggcgtggacctgaagaaggtggacagcaccaaggacagctacgtgctggtgagcaagatggacctgcccaacaacggcaccgtgaccagaggcagaggcttccccaagaccggcctgctgctgaacctgctgggcgtgatcttcatgaagggcaactgcgccaccgaggagaagatctgggagttcctgaacaagatgagaatctacgacggcaagaagcacttcatcttcggcgagcccagaaagctgatcacccaggacctggtgaagctgaagtacctggagtacagacaggtgcccaacagcaaccccgccagatacgagttcctgtggggccccagagcccacgccgagaccagcaagatgaaggtgctggagttctgggccaaggtgaacaagaccgtgcccagcgccttccagttctggtacgaggaggccctgagagacgaggaggagagagtgcaggccgccgccatgctgaacgacggcagcagcgccatgggcagaaagtgcagcaaggccaaggccagcagcagcagccacgcctag

SEQ ID NO: 88484 - DNA, 1041 bp, Artificial Sequence; identical to SEQ ID NO: 88483
  Description of Artificial Sequence: Synthetic coding sequence

SEQ ID NO: 88485 - DNA, 1041 bp, Artificial Sequence
  Description of Artificial Sequence: Synthetic coding sequence
atgcccagaggccagaagagcaagctgagagccagagagaagagacagagaaccagaggccagacccaggacctgaaggtgggccagcccaccgccgccgagaaggaggagagccccagcagcagcagcagcgtgctgagagacaccgccagcagcagcctggccttcggcatcccccaggagccccagagagagccccccaccaccagcgccgccgccgccatgagctgcaccggcagcgacaagggcgacgagagccaggacgaggagaacgccagcagcagccaggccagcaccagcaccgagagaagcctgaaggacagcctgaccagaaagaccaagatgctggtgcagttcctgctgtacaagtacaagatgaaggagcccaccaccaaggccgagatgctgaagatcatcagcaagaagtacaaggagcacttccccgagatcttcagaaaggtgagccagagaaccgagctggtgttcggcctggccctgaaggaggtgaaccccaccacccacagctacatcctggtgagcatgctgggccccaacgacggcaaccagagcagcgcctggaccctgcccagaaacggcctgctgatgcccctgctgagcgtgatcttcctgaacggcaactgcgccagagaggaggagatctgggagttcctgaacatgctgggcatctacgacggcaagagacacctgatcttcggcgagcccagaaagctgatcacccaggacctggtgcaggagaagtacctggagtaccagcaggtgcccaacagcgacccccccagataccagttcctgtggggccccagagcccacgccgagaccagcaagatgaaggtgctggagttcctggccaaggtgaacgacaccacccccaacaacttccccctgctgtacgaggaggccctgagagacgaggaggagagagccggcgccagacccagagtggccgccagaagaggcaccaccgccatgaccagcgcctacagcagagccaccagcagcagcagcagccagcccatgtag

SEQ ID NO: 88486 - DNA, 828 bp, Artificial Sequence
  Description of Artificial Sequence: Synthetic coding sequence
atgaccagcgccggcgtgttcaacgccggcagcgacgagagagccaacagcagagacgaggagtacccctgcagcagcgaggtgagccccagcaccgagagcagctgcagcaacttcatcaacatcaaggtgggcctgctggagcagttcctgctgtacaagttcaagatgaagcagagaatcctgaaggaggacatgctgaagatcgtgaaccccagataccagaaccagttcgccgagatccacagaagagccagcgagcacatcgaggtggtgttcgccgtggacctgaaggaggtgaaccccacctgccacctgtacgacctggtgagcaagctgaagctgcccaacaacggcagaatccacgtgggcaaggtgctgcccaagaccggcctgctgatgaccttcctggtggtgatcttcctgaagggcaactgcgccaacaaggaggacacctggaagttcctggacatgatgcagatctacgacggcaagaagtactacatctacggcgagcccagaaagctgatcacccaggacttcgtgagactgacctacctggagtaccaccaggtgccctgcagctaccccgcccactaccagttcctgtggggccccagagcctacaccgagaccagcaagatgaaggtgctggagtacctggccaaggtgaacgacatcgcccccggcgccttcagcagccagtacgaggaggccctgcaggacgaggaggagagccccagccagagatgcagcagaaactggcactactgcagcggccaggactgcctgagagccaagttcagcagcttcagccagccctactag

SEQ ID NO: 88487 - DNA, 1224 bp, Artificial Sequence
  Description of Artificial Sequence: Synthetic coding sequence
atgcccagaggccacaagagcaagctgagaacctgcgagaagagacaggagaccaacggccagccccagggcctgaccggcccccaggccaccgccgagaagcaggaggagagccacagcagcagcagcagcagcagagcctgcctgggcgactgcagaagaagcagcgacgccagcatcccccaggagagccagggcgtgagccccaccggcagccccgacgccgtggtgagctacagcaagagcgacgtggccgccaacggccaggacgagaagagccccagcaccagcagagacgccagcgtgccccaggagagccagggcgccagccccaccggcagccccgacgccggcgtgagcggcagcaagtacgacgtggccgccaacggccaggacgagaagagccccagcaccagccacgacgtgagcgtgccccaggagagccagggcgccagccccaccggcagccccgacgccggcgtgagcggcagcaagtacgacgtggccgccgagggcgaggacgaggagagcgtgagcgccagccagaaggccatcatcttcaagagactgagcaaggacgccgtgaagaagaaggcctgcaccctggcccagttcctgcagaagaagttcgagaagaaggagagcatcctgaaggccgacatgctgaagtgcgtgagaagagagtacaagccctacttcccccagatcctgaacagaaccagccagcacctggtggtggccttcggcgtggagctgaaggagatggacagcagcggcgagagctacaccctggtgagcaagctgggcctgcccagcgagggcatcctgagcggcgacaacgccctgcccaagagcggcctgctgatgagcctgctggtggtgatcttcatgaacggcaactgcgccaccgaggaggaggtgtgggagttcctgggcctgctgggcatctacgacggcatcctgcacagcatctacggcgacgccagaaagatcatcaccgaggacctggtgcaggacaagtacgtggtgtacagacaggtgtgcaacagcgaccccccctgctacgagttcctgtggggccccagagcctacgccgagaccaccaagatgagagtgctgagagtgctggccgacagcagcaacaccagccccggcctgtacccccacctgtacgaggacgccctgatcgacgaggtggagagagccctgagactgagagcctag

SEQ ID NO: 88488 - DNA, 3429 bp, Artificial Sequence
  Description of Artificial Sequence: Synthetic coding sequence
atgggcgacaaggacatgcccaccgccggcatgcccagcctgctgcagagcagcagcgagagcccccagagctgccccgagggcgaggacagccagagccccctgcagatcccccagagcagccccgagagcgacgacaccctgtaccccctgcagagcccccagagcagaagcgagggcgaggacagcagcgaccccctgcagagaccccccgagggcaaggacagccagagccccctgcagatcccccagagcagccccgagggcgacgacacccagagccccctgcagaacagccagagcagccccgagggcaaggacagcctgagccccctggagatcagccagagcccccccgagggcgaggacgtgcagagccccctgcagaaccccgccagcagcttcttcagcagcgccctgctgagcatcttccagagcagccccgagagcacccagagccccttcgagggcttcccccagagcgtgctgcagatccccgtgagcgccgccagcagcagcaccctggtgagcatcttccagagcagccccgagagcacccagagccccttcgagggcttcccccagagccccctgcagatccccgtgagcagaagcttcagcagcaccctgctgagcatcttccagagcagccccgagagaacccagagcaccttcgagggcttcgcccagagccccctgcagatccccgtgagccccagcagcagcagcaccctgctgagcctgttccagagcttcagcgagagaacccagagcaccttcgagggcttcgcccagagcagcctgcagatccccgtgagccccagcttcagcagcaccctggtgagcctgttccagagcagccccgagagaacccagagcaccttcgagggcttcccccagagccccctgcagatccccgtgagcagcagcagcagcagcaccctgctgagcctgttccagagcagccccgagagaacccacagcaccttcgagggcttcccccagagcctgctgcagatccccatgaccagcagcttcagcagcaccctgctgagcatcttccagagcagccccgagagcgcccagagcaccttcgagggcttcccccagagccccctgcagatccccggcagccccagcttcagcagcaccctgctgagcctgttccagagcagccccgagagaacccacagcaccttcgagggcttcccccagagccccctgcagatccccatgaccagcagcttcagcagcaccctgctgagcatcctgcagagcagccccgagagcgcccagagcgccttcgagggcttcccccagagccccctgcagatccccgtgagcagcagcttcagctacaccctgctgagcctgttccagagcagccccgagagaacccacagcaccttcgagggcttcccccagagccccctgcagatccccgtgagcagcagcagcagcagcagcaccctgctgagcctgttccagagcagccccgagtgcacccagagcaccttcgagggcttcccccagagccccctgcagatcccccagagcccccccgagggcgagaacacccacagccccctgcagatcgtgcccagcctgcccgagtgggaggacagcctgagcccccactacttcccccagagccccccccagggcgaggacagcctgagcccccactacttcccccagagccccccccagggcgaggacagcctgagcccccactacttcccccagagcccccagggcgaggacagcctgagcccccactacttcccccagagccccccccagggcgaggacagcatgagccccctgtacttcccccagagccccctgcagggcgaggagttccagagcagcctgcagagccccgtgagcatctgcagcagcagcacccccagcagcctgccccagagcttccccgagagcagccagagcccccccgagggccccgtgcagagccccctgcacagcccccagagcccccccgagggcatgcacagccagagccccctgcagagccccgagagcgcccccgagggcgaggacagcctgagccccctgcagatcccccagagccccctggagggcgaggacagcctgagcagcctgcacttcccccagagcccccccgagtgggaggacagcctgagccccctgcacttcccccagttccccccccagggcgaggacttccagagcagcctgcagagccccgtgagcatctgcagcagcagcaccagcctgagcctgccccagagcttccccgagagcccccagagcccccccgagggccccgcccagagccccctgcagagacccgtgagcagcttcttcagctacaccctggccagcctgctgcagagcagccacgagagcccccagagcccccccgagggccccgcccagagccccctgcagagccccgtgagcagcttccccagcagcaccagcagcagcctgagccagagcagccccgtgagcagcttccccagcagcaccagcagcagcctgagcaagagcagccccgagagccccctgcagagccccgtgatcagcttcagcagcagcaccagcctgagccccttcagcgaggagagcagcagccccgtggacgagtacaccagcagcagcgacaccctgctggagagcgacagcctgaccgacagcgagagcctgatcgagagcgagcccctgttcacctacaccctggacgagaaggtggacgagctggccagattcctgctgctgaagtaccaggtgaagcagcccatcaccaaggccgagatgctgaccaacgtgatcagcagatacaccggctacttccccgtgatcttcagaaaggccagagagttcatcgagatcctgttcggcatcagcctgagagaggtggaccccgacgacagctacgtgttcgtgaacaccctggacctgaccagcgagggctgcctgagcgacgagcagggcatgagccagaacagactgctgatcctgatcctgagcatcatcttcatcaagggcacctacgccagcgaggaggtgatctgggacgtgctgagcggcatcggcgtgagagccggcagagagcacttcgccttcggcgagcccagagagctgctgaccaaggtgtgggtgcaggagcactacctggagtacagagaggtgcccaacagcagcccccccagatacgagttcctgtggggccccagagcccacagcgaggtgatcaagagaaaggtggtggagttcctggccatgctgaagaacaccgtgcccatcaccttccccagcagctacaaggacgccctgaaggacgtggaggagagagcccaggccatcatcgacaccaccgacgacagcaccgccaccgagagcgccagcagcagcgtgatgagccccagcttcagcagcgagtag

SEQ ID NO: 88489 - DNA, 354 bp, Artificial Sequence
  Description of Artificial Sequence: Synthetic coding sequence
ggcgacaaggacatgcccaccgccggcatgcccagcctgctgcagagcagcagcgagagcccccagagctgccccgagggcgaggacagccagagccccctgcagatccccgtgagccccagcagcagcagcaccctgctgagcctgttccagagcttcagcgagagaacccagagcaccttcgagggcttcgcccagagcagcctgcagatccccgtgagccccagcttcagcagcaccctggtgagcctgttccagagcagccccgagagaacccagagcaccttcgagggcttcccccagagccccctgcagatccccgtgagcagcagcagcagcagcaccctgctgtag

SEQ ID NO: 88490 - DNA, 357 bp, Artificial Sequence
  Description of Artificial Sequence: Synthetic coding sequence
atgggcgacaaggacatgcccaccgccggcatgcccagcctgctgcagagcagcagcgagagcccccagagctgccccgagggcgaggacagccagagccccctgcagatccccgtgagccccagcagcagcagcaccctgctgagcctgttccagagcttcagcgagagaacccagagcaccttcgagggcttcgcccagagcagcctgcagatccccgtgagccccagcttcagcagcaccctggtgagcctgttccagagcagccccgagagaacccagagcaccttcgagggcttcccccagagccccctgcagatccccgtgagcagcagcagcagcagcaccctgctgtag

SEQ ID NO: 88491 - DNA, 630 bp, Artificial Sequence
  Description of Artificial Sequence: Synthetic coding sequence
atgctgaccaacgtgatcagcagatacaccggctacttccccgtgatcttcagaaaggccagagagttcatcgagatcctgttcggcatcagcctgagagaggtggaccccgacgacagctacgtgttcgtgaacaccctggacctgaccagcgagggctgcctgagcgacgagcagggcatgagccagaacagactgctgatcctgatcctgagcatcatcttcatcaagggcacctacgccagcgaggaggtgatctgggacgtgctgagcggcatcggcgtgagagccggcagagagcacttcgccttcggcgagcccagagagctgctgaccaaggtgtgggtgcaggagcactacctggagtacagagaggtgcccaacagcagcccccccagatacgagttcctgtggggccccagagcccacagcgaggtgatcaagagaaaggtggtggagttcctggccatgctgaagaacaccgtgcccatcaccttccccagcagctacaaggacgccctgaaggacgtggaggagagagcccaggccatcatcgacaccaccgacgacagcaccgccaccgagagcgccagcagcagcgtgatgagccccagcttcagcagcgagtag

SEQ ID NO: 88492 - DNA, 1122 bp, Artificial Sequence
  Description of Artificial Sequence: Synthetic coding sequence
atgccccccgtgcccggcgtgcccttcagaaacgtggacaacgacagccccaccagcgtggagctggaggactgggtggacgcccagcaccccaccgacgaggaggaggaggaggccagcagcgccagcagcaccctgtacctggtgttcagccccagcagcttcagcaccagcagcagcctgatcctgggcggccccgaggaggaggaggtgcccagcggcgtgatccccaacctgaccgagagcatccccagcagccccccccagggccccccccagggccccagccagagccccctgagcagctgctgcagcagcttcagctggagcagcttcagcgaggagagcagcagccagaagggcgaggacaccggcacctgccagggcctgcccgacagcgagagcagcttcacctacaccctggacgagaaggtggccgagctggtggagttcctgctgctgaagtacgaggccgaggagcccgtgaccgaggccgagatgctgatgatcgtgatcaagtacaaggactacttccccgtgatcctgaagagagccagagagttcatggagctgctgttcggcctggccctgatcgaggtgggccccgaccacttctgcgtgttcgccaacaccgtgggcctgaccgacgagggcagcgacgacgagggcatgcccgagaacagcctgctgatcatcatcctgagcgtgatcttcatcaagggcaactgcgccagcgaggaggtgatctgggaggtgctgaacgccgtgggcgtgtacgccggcagagagcacttcgtgtacggcgagcccagagagctgctgaccaaggtgtgggtgcagggccactacctggagtacagagaggtgccccacagcagccccccctactacgagttcctgtggggccccagagcccacagcgagagcatcaagaagaaggtgctggagttcctggccaagctgaacaacaccgtgcccagcagcttccccagctggtacaaggacgccctgaaggacgtggaggagagagtgcaggccaccatcgacaccgccgacgacgccaccgtgatggccagcgagagcctgagcgtgatgagcagcaacgtgagcttcagcgagtag

SEQ ID NO: 88493 - DNA, 1932 bp, Artificial Sequence
  Description of Artificial Sequence: Synthetic coding sequence
atgctgctgccctgccactgggtgctggacgccaccttcagcgacggcagcctgggccagtgggtgaagaacacctgcgccacctacgccctgagccccgtggtgctgcccccccagccccagcccagaaagaaggccaccgacaaggactacagcgccttccacctgggccacctgagagaggtgagactgttcctgagaggcggcaccagcgaccagagaatggacagcctggtgctgtgccccacctacttcaagctgtggagaaccctgagcggcagccccggcctgcagctgagcgacctgcacttcggcagccagcccgagggcaagttcagcctgagaagagccgtgagcgtgaagcagagagaggagccccaggactggcccctgaacgagaagagaaccctgtggaaggacagcgacctgcccacctggagaagaggcaccggctacaccctgagcctgcccgccgtgagccccggcaagagactgtggggcgagaaggccggcagcctgcccgagagcgagcccctgttcacctacaccctggacgagaaggtggacaagctggtgcagttcctgctgctgaagtaccaggccaaggagcccctgaccagagccgagatgcagatgaacgtgatcaacacctacaccggctacttccccatgatcttcagaaaggccagagagttcatcgagatcctgttcggcatcagcctgaccgaggtggaccccgaccacttctacgtgttcgtgaacaccctggacctgacctgcgagggcagcctgagcgacgagcagggcatgccccagaacagactgctgatcctgatcctgagcgtgatcttcatcaagggcaactgcgccagcgaggaggtgatctgggaggtgctgaacgccatcggcccctggagcgccctggccggcttcgccgacgtgctgagcagactggccctgtgggagagcgagggccccgaggccttctgcgaggagagcggcctgagaagcgccgagggcagcgtgctggacctggccaacccccagggcctggccggccacagacaggaggacggcagaagaggcctgaccgaggccagcccccagcagaagaagggcggcgaggacgaggacatgcccgccgccggcatgccccccctgccccagagcccccccgagatccccccccagggcccccccaagatcagcccccagggccccccccagagccccccccagagccccctggacagctgcagcagccccctgctgtggaccagactggacgaggagagcagcagcgaggaggaggacaccgccacctggcacgccctgcccgagagcgagagcctgcccagatacgccctggacgagaaggtggccgagctggtgcagttcctgctgctgaagtaccagaccaaggagcccgtgaccaaggccgagatgctgaccaccgtgatcaagaagtacaaggactacttccccatgatcttcggcaaggcccacgagttcatcgagctgatcttcggcatcgccctgaccgacatggaccccgacaaccacagctacttcttcgaggacaccctggacctgacctacgagggcagcctgatcgacgaccagggcatgcccaagaactgcctgctgatcctgatcctgagcatgatcttcatcaagggcagctgcgtgcccgaggaggtgatctgggaggtgctgagcgccatcggccccatccagagacccgccagagaggtgctggagttcctgagcaagctgagcagcatcatccccagcgccttccccagctggtacatggacgccctgaaggacatggaggacagagcccaggccatcatcgacaccaccgacgacgccaccgccatggccagcgccagccccagcgtgatgagcaccaacttctgccccgagtag

SEQ ID NO: 88494 - DNA, 801 bp, Artificial Sequence
  Description of Artificial Sequence: Synthetic coding sequence
atgcccgccgccggcatgccccccctgccccagagcccccccgagatccccccccagggcccccccaagatcagcccccagggccccccccagagccccccccagagccccctggacagctgcagcagccccctgctgtggaccagactggacgaggagagcagcagcgaggaggaggacaccgccacctggcacgccctgcccgagagcgagagcctgcccagatacgccctggacgagaaggtggccgagctggtgcagttcctgctgctgaagtaccagaccaaggagcccgtgaccaaggccgagatgctgaccaccgtgatcaagaagtacaaggactacttccccatgatcttcggcaaggcccacgagttcatcgagctgatcttcggcatcgccctgaccgacatggaccccgacaaccacagctacttcttcgaggacaccctggacctgacctacgagggcagcctgatcgacgaccagggcatgcccaagaactgcctgctgatcctgatcctgagcatgatcttcatcaagggcagctgcgtgcccgaggaggtgatctgggaggtgctgagcgccatcggcgtgtgcgccggcagagagcacttcatctacggcgaccccagaaagctgctgaccatccactgggtgcagagaaagtacctggagtacagagaggtgcccaacagcgccccccccagatacgagttcctgtggggccccagagcccacagcgaggccagcaagagaagcctgagagtgttcatccaggccatccagtaccacccctag

SEQ ID NO: 88495 - DNA, 381 bp, Artificial Sequence
  Description of Artificial Sequence: Synthetic coding sequence
atggacaccggccagctgcagctgagcagagagagaagccccggcgccggccagcaggccagaagagagctgtgcggcagaatcgccatcagccagcacggcggcaaggcccaggccagccccagccacagcctgctgagccccctggacaagaccgacggcgagccctggagcgccctggccggcttcgccgacgtgctgagcagactggccctgtgggagagcgagggccccgaggccttctgcgaggagagcggcctgagaagcgccgagggcagcgtgctggacctggccaacccccagggcaagggccccaagggcgagctgagagacttcgcccccagaaccgaggaggcccccgtgtgccccgccctgccctag

SEQ ID NO: 88496 - DNA, 1041 bp, Artificial Sequence
  Description of Artificial Sequence: Synthetic coding sequence
atgcccctgttccccaacctgcccagactgagcttcgaggaggacttccagaaccccagcgtgaccgaggacctggtggacgcccaggacagcatcgacgaggaggaggaggacgccagcagcaccagcagcagcagcttccacttcctgttccccagcagcagcagcctgagcagcagcagccccctgagcagccccctgcccagcaccctgatcctgggcgtgcccgaggacgaggacatgcccgccgccggcatgccccccctgccccagagcccccccgagatccccccccagggcccccccaagatcagcccccagggccccccccagagccccccccagagccccctggacagctgcagcagccccctgctgtggaccagactggacgaggagagcagcagcgaggaggaggacaccgccacctggcacgccctgcccgagagcgagagcctgcccagatacgccctggacgagaaggtggccgagctggtgcagttcctgctgctgaagtaccagaccaaggagcccgtgaccaaggccgagatgctgaccaccgtgatcaagaagtacaaggactacttccccatgatcttcggcaaggcccacgagttcatcgagctgatcttcggcatcgccctgaccgacatggaccccgacaaccacagctacttcttcgaggacaccctggacctgacctacgagggcagcctgatcgacgaccagggcatgcccaagaactgcctgctgatcctgatcctgagcatgatcttcatcaagggcagctgcgtgcccgaggaggtgatctgggaggtgctgagcgccatcggcgtgtgcgccggcagagagcacttcatctacggcgaccccagaaagctgctgaccatccactgggtgcagagaaagtacctggagtacagagaggtgcccaacagcgccccccccagatacgagttcctgtggggccccagagcccacagcgaggccagcaagagaagcctgagagtgttcatccaggccatccagtaccacccctag

SEQ ID NO: 88497 - DNA, 1041 bp, Artificial Sequence; identical to SEQ ID NO: 88496
  Description of Artificial Sequence: Synthetic coding sequence

SEQ ID NO: 88498 - DNA, 2337 bp, Artificial Sequence
  Description of Artificial Sequence: Synthetic coding sequence
atggcccagaagatggactgcggcgccggcctgctgggcttccaggccgaggccagcgtggaggacagcgccctgctgatgcagaccctgatggaggccatccagatcagcgaggccccccccaccaaccaggccaccgccgccgccagcccccagagcagccagccccccaccgccaacgagatggccgacatccaggtgagcgccgccgccgccagacccaagagcgccttcaaggtgcagaacgccaccaccaagggccccaacggcgtgtacgacttcagccaggcccacaacgccaaggacgtgcccaacacccagcccaaggccgccttcaagagccagaacgccacccccaagggccccaacgccgcctacgacttcagccaggccgccaccaccggcgagctggccgccaacaagagcgagatggccttcaaggcccagaacgccaccaccaaggtgggccccaacgccacctacaacttcagccagagcctgaacgccaacgacctggccaacagcagacccaagacccccttcaaggcctggaacgacaccaccaaggcccccaccgccgacacccagacccagaacgtgaaccaggccaagatggccaccagccaggccgacatcgagaccgaccccggcatcagcgagcccgacggcgccaccgcccagaccagcgccgacggcagccaggcccagaacctggagagcagaaccatcatcagaggcaagagaaccagaaagatcaacaacctgaacgtggaggagaacagcagcggcgaccagagaagagcccccctggccgccggcacctggagaagcgcccccgtgcccgtgaccacccagaacccccccggcgccccccccaacgtgctgtggcagacccccctggcctggcagaaccccagcggctggcagaaccagaccgccagacagaccccccccgccagacagagcccccccgccagacagaccccccccgcctggcagaaccccgtggcctggcagaaccccgtgatctggcccaaccccgtgatctggcagaaccccgtgatctggcccaaccccatcgtgtggcccggccccgtggtgtggcccaaccccctggcctggcagaacccccccggctggcagaccccccccggctggcagaccccccccggctggcagggcccccccgactggcagggcccccccgactggcccctgccccccgactggcccctgccccccgactggcccctgcccaccgactggcccctgccccccgactggatccccgccgactggcccatcccccccgactggcagaacctgagacccagccccaacctgagacccagccccaacagcagagccagccagaaccccggcgccgcccagcccagagacgtggccctgctgcaggagagagccaacaagctggtgaagtacctgatgctgaaggactacaccaaggtgcccatcaagagaagcgagatgctgagagacatcatcagagagtacaccgacgtgtaccccgagatcatcgagagagcctgcttcgtgctggagaagaagttcggcatccagctgaaggagatcgacaaggaggagcacctgtacatcctgatcagcacccccgagagcctggccggcatcctgggcaccaccaaggacacccccaagctgggcctgctgctggtgatcctgggcgtgatcttcatgaacggcaacagagccagcgaggccgtgctgtgggaggccctgagaaagatgggcctgagacccggcgtgagacaccccctgctgggcgacctgagaaagctgctgacctacgagttcgtgaagcagaagtacctggactacagaagagtgcccaacagcaacccccccgagtacgagttcctgtggggcctgagaagctaccacgagaccagcaagatgaaggtgctgagattcatcgccgaggtgcagaagagagaccccagagactggaccgcccagttcatggaggccgccgacgaggccctggacgccctggacgccgccgccgccgaggccgaggccagagccgaggccagaaccagaatgggcatcggcgacgaggccgtgagcggcccctggagctgggacgacatcgagttcgagctgctgacctgggacgaggagggcgacttcggcgacccctggagcagaatccccttcaccttctgggccagataccaccagaacgccagaagcagattcccccagaccttcgccggccccatcatcggccccggcggcaccgccagcgccaacttcgccgccaacttcggcgccatcggcttcttctgggtggagtag

SEQ ID NO: 88499 - DNA, 2505 bp, Artificial Sequence
  Description of Artificial Sequence: Synthetic coding sequence
atggcccagaagatggactgcggcgccggcctgctgggcttccagaaccccgacgcctgcagagccgtgtgccaccccctgccccagccccccgccagcaccctgcccctgagcgccttccccaccctgtgcgaccccccctacagccagctgagagacccccccgccgtgctgagctgctactgcacccccctgggcgccagccccgcccccgccgaggccagcgtggaggacagcgccctgctgatgcagaccctgatggaggccatccagatcagcgaggccccccccaccaaccaggccaccgccgccgccagcccccagagcagccagccccccaccgccaacgagatggccgacatccaggtgagcgccgccgccgccagacccaagagcgccttcaaggtgcagaacgccaccaccaagggccccaacggcgtgtacgacttcagccaggcccacaacgccaaggacgtgcccaacacccagcccaaggccgccttcaagagccagaacgccacccccaagggccccaacgccgcctacgacttcagccaggccgccaccaccggcgagctggccgccaacaagagcgagatggccttcaaggcccagaacgccaccaccaaggtgggccccaacgccacctacaacttcagccagagcctgaacgccaacgacctggccaacagcagacccaagacccccttcaaggcctggaacgacaccaccaaggcccccaccgccgacacccagacccagaacgtgaaccaggccaagatggccaccagccaggccgacatcgagaccgaccccggcatcagcgagcccgacggcgccaccgcccagaccagcgccgacggcagccaggcccagaacctggagagcagaaccatcatcagaggcaagagaaccagaaagatcaacaacctgaacgtggaggagaacagcagcggcgaccagagaagagcccccctggccgccggcacctggagaagcgcccccgtgcccgtgaccacccagaacccccccggcgccccccccaacgtgctgtggcagacccccctggcctggcagaaccccagcggctggcagaaccagaccgccagacagaccccccccgccagacagagcccccccgccagacagaccccccccgcctggcagaaccccgtggcctggcagaaccccgtgatctggcccaaccccgtgatctggcagaaccccgtgatctggcccaaccccatcgtgtggcccggccccgtggtgtggcccaaccccctggcctggcagaacccccccggctggcagaccccccccggctggcagaccccccccggctggcagggcccccccgactggcagggcccccccgactggcccctgccccccgactggcccctgccccccgactggcccctgcccaccgactggcccctgccccccgactggatccccgccgactggcccatcccccccgactggcagaacctgagacccagccccaacctgagacccagccccaacagcagagccagccagaaccccggcgccgcccagcccagagacgtggccctgctgcaggagagagccaacaagctggtgaagtacctgatgctgaaggactacaccaaggtgcccatcaagagaagcgagatgctgagagacatcatcagagagtacaccgacgtgtaccccgagatcatcgagagagcctgcttcgtgctggagaagaagttcggcatccagctgaaggagatcgacaaggaggagcacctgtacatcctgatcagcacccccgagagcctggccggcatcctgggcaccaccaaggacacccccaagctgggcctgctgctggtgatcctgggcgtgatcttcatgaacggcaacagagccagcgaggccgtgctgtgggaggccctgagaaagatgggcctgagacccggcgtgagacaccccctgctgggcgacctgagaaagctgctgacctacgagttcgtgaagcagaagtacctggactacagaagagtgcccaacagcaacccccccgagtacgagttcctgtggggcctgagaagctaccacgagaccagcaagatgaaggtgctgagattcatcgccgaggtgcagaagagagaccccagagactggaccgcccagttcatggaggccgccgacgaggccctggacgccctggacgccgccgccgccgaggccgaggccagagccgaggccagaaccagaatgggcatcggcgacgaggccgtgagcggcccctggagctgggacgacatcgagttcgagctgctgacctgggacgaggagggcgacttcggcgacccctggagcagaatccccttcaccttctgggccagataccaccagaacgccagaagcagattcccccagaccttcgccggccccatcatcggccccggcggcaccgccagcgccaacttcgccgccaacttcggcgccatcggcttcttctgggtggagtag

SEQ ID NO: 88500 - DNA, 2337 bp, Artificial Sequence; identical to SEQ ID NO: 88498
  Description of Artificial Sequence: Synthetic coding sequence

SEQ ID NO: 88501 - DNA, 2337 bp, Artificial Sequence; identical to SEQ ID NO: 88498
  Description of Artificial Sequence: Synthetic coding sequence

SEQ ID NO: 88502 - DNA, 414 bp, Artificial Sequence
  Description of Artificial Sequence: Synthetic coding sequence
atggcccagaagatggactgcggcgccggcctgctgggcttccaggccgaggccagcgtggaggacagcgccctgctgatgcagaccctgatggaggccatccagatcagcgaggccccccccaccaaccaggccaccgccgccgccagcccccagagcagccagccccccaccgccaacgagatggccgacatccaggtgagcgccgccgccgccagacccaagagcgccttcaaggtgcagaacgccaccaccaagggccccaacggcgtgtacgacttcagccagagcctgaacgccaacgacctggccaacagcagacccaagacccaggtgagcctgaacctgaccgtgcagctgcacagacaccagcagatggtgcccagactgagaatctggagccccggccagtag

SEQ ID NO: 88503 - DNA, 3942 bp, Artificial Sequence
  Description of Artificial Sequence: Synthetic coding sequence
atgagcggctggagatacctgatctgcgtgagcttcctgctgaccatcctgctggagctgacctaccagggcccccccgtgcccgccagcagcagcaccaagctgctgatgaccagctacagcatgagaagcaccgtggtgagcagatacgcccacaccctggtgaccagcgtgctgttcaacccccacgccgaggcccacgaggccatcttcgacctggacctgccccacctggccttcatcagcaacttcaccatgaccatcaacaacaaggtgtacatcgccgaggtgaaggagaagcaccaggccaagaagatctacgaggaggcccaccagcagggcaagaccgccgcccacgtgggcatcagagacagagagagcgagaagttcagaatcagcaccagcctggccgccggcaccgaggtgaccttcagcctggcctacgaggagctgctgcagagacaccagggccagtaccagctggtggtgagcctgagacccggccagctggtgaagagactgagcatcgaggtgaccgtgagcgagagaaccggcatcagctacgtgcacatcccccccctgagaaccggcagactgagaaccaacgcccacgccagcgaggtggacagcccccccagcaccagaatcgagagaggcgagacctgcgtgagaatcacctactgccccaccctgcaggaccagagcagcatcagcggcagcggcatcatggccgacttcctggtgcagtacgacgtggtgatggaggacatcatcggcgacgtgcagatctacgacgactacttcatccactacttcgcccccagaggcctgccccccatggagaagaacgtggtgttcgtgatcgacgtgagcagcagcatgttcggcaccaagatggagcagaccaagaccgccatgaacgtgatcctgagcgacctgcaggccaacgactacttcaacatcatcagcttcagcgacaccgtgaacgtgtggaaggccggcggcagcatccaggccaccatccagaacgtgcacagcgccaaggactacctgcactgcatggaggccgacggctggaccgacgtgaacagcgccctgctggccgccgccagcgtgctgaaccacagcaaccaggagcccggcagaggccccagcgtgggcagaatccccctgatcatcttcctgaccgacggcgagcccaccgccggcgtgaccacccccagcgtgatcctgagcaacgtgagacaggccctgggccacagagtgagcctgttcagcctggccttcggcgacgacgccgacttcaccctgctgagaagactgagcctggagaacagaggcatcgccagaagaatctacgaggacaccgacgccgccctgcagctgaagggcctgtacgaggagatcagcatgcccctgctggccgacgtgagactgaactacctgggcggcctggtgggcgccagcccctgggccgtgttccccaactacttcggcggcagcgagctggtggtggccggccaggtgcagcccggcaagcaggagctgggcatccacctggccgccagaggccccaaggaccagctgctggtggcccaccacagcgagggcgccaccaacaacagccagaaggccttcggctgccccggcgagcccgcccccaacgtggcccacttcatcagaagactgtgggcctacgtgaccatcggcgagctgctggacgcccacttccaggccagagacaccaccaccagacacctgctggccgccaaggtgctgaacctgagcctggagtacaacttcgtgacccccctgaccagcctggtgatggtgcagcccaagcaggccagcgaggagaccagaagacagaccagcaccagcgccggccccgacaccatcatgcccagcagcagcagcagacacggcctgggcgtgagcaccgcccagcccgccctggtgcccaaggtgatcagccccaagagcagacccgtgaagcccaagttctacctgagcagcaccaccaccgccagcaccaagaagatgctgagcagcaaggagctggagcccctgggcgagagcccccacaccctgagcatgcccacctaccccaaggccaagatccccgcccagcaggacagcggcaccctggcccagcccaccctgagaaccaagcccaccatcctggtgcccagcaacagcggcaccctgctgcccctgaagcccggcagcctgagccaccagaaccccgacatcctgcccaccaacagcagaacccaggtgccccccgtgaagcccggcatccccgccagccccaaggccgacaccgtgaagtgcgtgacccccctgcacagcaagcccggcgcccccagccacccccagctgggcgccctgaccagccaggcccccaagggcctgccccagagcagacccggcgtgagcaccctgcaggtgcccaagtaccccctgcacaccagacccagagtgcccgcccccaagaccagaaacaacatgccccacctgggccccggcatcctgctgagcaagacccccaagatcctgctgagcctgaagcccagcgcccccccccaccagatcagcaccagcatcagcctgagcaagcccgagacccccaacccccacatgccccagacccccctgccccccagacccgacagacccagaccccccctgcccgagagcctgagcaccttccccaacaccatcagcagcagcaccggccccagcagcaccaccaccaccagcgtgctgggcgagcccctgcccatgcccttcacccccaccctgccccccggcagattctggcaccagtacgacctgctgcccggcccccagagaaccagacaggtgctgggccccagcagacccggcgtgcccaccatgagcctgctgaacagcagcagacccacccccgagggcagcccccccaacctgcccatcctgctgcccagcagcatcctgcccgaggccatcagcctgctgctgctgcccgaggagctggagctgctgagcgagagcatggtggagagcaagttcgtggagagcctgaacccccccgccttctacaccttcctgacccccgacgaggacggcagccccaactgggacggcaacagcgaggagatcctgggcggcgccggcggcagcatggagagccagggcagcagcgtgggcctggccaagggcaccctgcccagcatcttcaccttcagcagcagcgtggacggcgacccccacttcgtgatccagatcccccacagcgaggagaagatctgcttcaccctgaacggccaccccggcgacctgctgcagctgatcgaggaccccaaggccggcctgcacgtgagcggcaagctgctgggcgccccccccagacccggccacaaggaccagaccagaacctacttccagatcatcaccgtgaccaccgacaagcccagagcctacaccatcaccatcagcagaagcagcatcagcctgagaggcgagggcaccctgagactgagctgggaccagcccgccctgctgaagagaccccagctggagctgtacgtggccgccgccgccagactgaccctgagactgggcccctacctggagttcctggtgctgagacacagatacagacaccccagcaccctgcagctgccccacctgggcttctacgtggccaacggcagcggcctgagccccagcgccagaggcctgatcggccagttccagcacgccgacatcagactggtgaccggccccatgggcccctgcctgagaagacaccacggccccgacgtgcccgtgatcctgggcaagagactgctgaaggacagccccagactgctgcccagatgggccagctgctggctggtgaagagaagccacgtggagctgctgctgggccacccctacctgagctacgtgctgtag

SEQ ID NO: 88504 - DNA, 1767 bp, Artificial Sequence
  Description of Artificial Sequence: Synthetic coding sequence
atgagcgacaccagcgagagcggcgccggcctgaccagattccaggccgaggccagcgagaaggacagcagcagcatgatgcagaccctgctgaccgtgacccagaacgtggaggtgcccgagacccccaaggccagcaaggccaccgaggtgagcaagacccccgaggccagagaggcccccgccacccaggccagcagcaccacccagctgaccgacacccaggtgctggccgccgagaacaagagcctggccgccgacaccaagaagcagaacgccgacccccaggccgtgaccatgcccgccaccgagaccaagaaggtgagccacgtggccgacaccaaggtgaacaccaaggcccaggagaccgaggccgcccccagccaggcccccgccgacgagcccgagcccgagagcgccgccgcccagagccaggagaaccaggacaccagacccaaggtgaaggccaagaaggccagaaaggtgaagcacctggacggcgaggaggacggcagcagcgaccagagccaggccagcggcaccaccggcggcagaagagtgagcaaggccctgatggccagcatggccagaagagccagcagaggccccatcgccttctgggccagaagagccagcagaaccagactggccgcctgggccagaagagccctgctgagcctgagaagccccaaggccagaagaggcaaggccagaagaagagccgccaagctgcagagcagccaggagcccgaggcccccccccccagagacgtggccctgctgcagggcagagccaacgacctggtgaagtacctgctggccaaggaccagaccaagatccccatcaagagaagcgacatgctgaaggacatcatcaaggagtacaccgacgtgtaccccgagatcatcgagagagccggctacagcctggagaaggtgttcggcatccagctgaaggagatcgacaagaacgaccacctgtacatcctgctgagcaccctggagcccaccgacgccggcatcctgggcaccaccaaggacagccccaagctgggcctgctgatggtgctgctgagcatcatcttcatgaacggcaacagaagcagcgaggccgtgatctgggaggtgctgagaaagctgggcctgagacccggcatccaccacagcctgttcggcgacgtgaagaagctgatcaccgacgagttcgtgaagcagaagtacctggactacgccagagtgcccaacagcaacccccccgagtacgagttcttctggggcctgagaagctactacgagaccagcaagatgaaggtgctgaagttcgcctgcaaggtgcagaagaaggaccccaaggagtgggccgcccagtacagagaggccatggaggccgacctgaaggccgccgccgaggccgccgccgaggccaaggccagagccgagatcagagccagaatgggcatcggcctgggcagcgagaacgccgccggcccctgcaactgggacgaggccgacatcggcccctgggccaaggccagaatccaggccggcgccgaggccaaggccaaggcccaggagagcggcagcgccagcaccggcgccagcaccagcaccaacaacagcgccagcgccagcgccagcaccagcggcggcttcagcgccggcgccagcctgaccgccaccctgaccttcggcctgttcgccggcctgggcggcgccggcgccagcaccagcggcagcagcggcgcctgcggcttcagctacaagtag

SEQ ID NO: 88505 - DNA, 1653 bp, Artificial Sequence
  Description of Artificial Sequence: Synthetic coding sequence
atgtggagaagccagagacacagaagaccccagagagtgagcaagacccccgaggccagagaggcccccgccacccaggccagcagcaccacccagctgaccgacacccaggtgctggccgccgagaacaagagcctggccgccgacaccaagaagcagaacgccgacccccaggccgtgaccatgcccgccaccgagaccaagaaggtgagccacgtggccgacaccaaggtgaacaccaaggcccaggagaccgaggccgcccccagccaggcccccgccgacgagcccgagcccgagagcgccgccgcccagagccaggagaaccaggacaccagacccaaggtgaaggccaagaaggccagaaaggtgaagcacctggacggcgaggaggacggcagcagcgaccagagccaggccagcggcaccaccggcggcagaagagtgagcaaggccctgatggccagcatggccagaagagccagcagaggccccatcgccttctgggccagaagagccagcagaaccagactggccgcctgggccagaagagccctgctgagcctgagaagccccaaggccagaagaggcaaggccagaagaagagccgccaagctgcagagcagccaggagcccgaggcccccccccccagagacgtggccctgctgcagggcagagccaacgacctggtgaagtacctgctggccaaggaccagaccaagatccccatcaagagaagcgacatgctgaaggacatcatcaaggagtacaccgacgtgtaccccgagatcatcgagagagccggctacagcctggagaaggtgttcggcatccagctgaaggagatcgacaagaacgaccacctgtacatcctgctgagcaccctggagcccaccgacgccggcatcctgggcaccaccaaggacagccccaagctgggcctgctgatggtgctgctgagcatcatcttcatgaacggcaacagaagcagcgaggccgtgatctgggaggtgctgagaaagctgggcctgagacccggcatccaccacagcctgttcggcgacgtgaagaagctgatcaccgacgagttcgtgaagcagaagtacctggactacgccagagtgcccaacagcaacccccccgagtacgagttcttctggggcctgagaagctactacgagaccagcaagatgaaggtgctgaagttcgcctgcaaggtgcagaagaaggaccccaaggagtgggccgcccagtacagagaggccatggaggccgacctgaaggccgccgccgaggccgccgccgaggccaaggccagagccgagatcagagccagaatgggcatcggcctgggcagcgagaacgccgccggcccctgcaactgggacgaggccgacatcggcccctgggccaaggccagaatccaggccggcgccgaggccaaggccaaggcccaggagagcggcagcgccagcaccggcgccagcaccagcaccaacaacagcgccagcgccagcgccagcaccagcggcggcttcagcgccggcgccagcctgaccgccaccctgaccttcggcctgttcgccggcctgggcggcgccggcgccagcaccagcggcagcagcggcgcctgcggcttcagctacaagtag

SEQ ID NO: 88506 - DNA, 1821 bp, Artificial Sequence
  Description of Artificial Sequence: Synthetic coding sequence
atgagcgacaccagcgagagcggcgccggcctgaccagattccaggccgaggccagcgagaaggacagcagcagcatgatgcagaccctgctgaccgtgacccagaacgtggaggtgcccgagacccccaaggccagcaaggccctggaggtgagcgaggacgtgaaggtgagcaaggccagcggcgtgagcaaggccaccgaggtgagcaagacccccgaggccagagaggcccccgccacccaggccagcagcaccacccagctgaccgacacccaggtgctggccgccgagaacaagagcctggccgccgacaccaagaagcagaacgccgacccccaggccgtgaccatgcccgccaccgagaccaagaaggtgagccacgtggccgacaccaaggtgaacaccaaggcccaggagaccgaggccgcccccagccaggcccccgccgacgagcccgagcccgagagcgccgccgcccagagccaggagaaccaggacaccagacccaaggtgaaggccaagaaggccagaaaggtgaagcacctggacggcgaggaggacggcagcagcgaccagagccaggccagcggcaccaccggcggcagaagagtgagcaaggccctgatggccagcatggccagaagagccagcagaggccccatcgccttctgggccagaagagccagcagaaccagactggccgcctgggccagaagagccctgctgagcctgagaagccccaaggccagaagaggcaaggccagaagaagagccgccaagctgcagagcagccaggagcccgaggcccccccccccagagacgtggccctgctgcagggcagagccaacgacctggtgaagtacctgctggccaaggaccagaccaagatccccatcaagagaagcgacatgctgaaggacatcatcaaggagtacaccgacgtgtaccccgagatcatcgagagagccggctacagcctggagaaggtgttcggcatccagctgaaggagatcgacaagaacgaccacctgtacatcctgctgagcaccctggagcccaccgacgccggcatcctgggcaccaccaaggacagccccaagctgggcctgctgatggtgctgctgagcatcatcttcatgaacggcaacagaagcagcgaggccgtgatctgggaggtgctgagaaagctgggcctgagacccggcatccaccacagcctgttcggcgacgtgaagaagctgatcaccgacgagttcgtgaagcagaagtacctggactacgccagagtgcccaacagcaacccccccgagtacgagttcttctggggcctgagaagctactacgagaccagcaagatgaaggtgctgaagttcgcctgcaaggtgcagaagaaggaccccaaggagtgggccgcccagtacagagaggccatggaggccgacctgaaggccgccgccgaggccgccgccgaggccaaggccagagccgagatcagagccagaatgggcatcggcctgggcagcgagaacgccgccggcccctgcaactgggacgaggccgacatcggcccctgggccaaggccagaatccaggccggcgccgaggccaaggccaaggcccaggagagcggcagcgccagcaccggcgccagcaccagcaccaacaacagcgccagcgccagcgccagcaccagcggcggcttcagcgccggcgccagcctgaccgccaccctgaccttcggcctgttcgccggcctgggcggcgccggcgccagcaccagcggcagcagcggcgcctgcggcttcagctacaagtag

SEQ ID NO: 88507 - DNA, 1821 bp, Artificial Sequence; identical to SEQ ID NO: 88506
  Description of Artificial Sequence: Synthetic coding sequence

SEQ ID NO: 88508 - DNA, 1566 bp, Artificial Sequence
  Description of Artificial Sequence: Synthetic coding sequence
atgagcgacaccagcgagagcggcgccggcctgaccagattccaggccgaggccagcgagaaggacagcagcagcatgatgcagaccctgctgaccgtgacccagaacgtggaggtgcccgagacccccaaggccagcagcaccacccagctgaccgacacccaggtgctggccgccgagaacaagagcctggccgccgacaccaagaagcagaacgccgacccccaggccgtgaccatgcccgccaccgagaccaagaaggtgagccacgtggccgacaccaaggtgaacaccaaggcccaggagaccgaggccgcccccagccaggcccccgccgacgagcccgagcccgagagcgccgccgcccagagccaggagaaccaggacaccagacccaaggtgaaggccaagaaggccagaaaggtgaagcacctggacggcgaggaggacggcagcagcgaccagagccaggccagcggcaccaccggcggcagaagagtgagcaaggccagaagaagagccgccaagctgcagagcagccaggagcccgaggcccccccccccagagacgtggccctgctgcagggcagagccaacgacctggtgaagtacctgctggccaaggaccagaccaagatccccatcaagagaagcgacatgctgaaggacatcatcaaggagtacaccgacgtgtaccccgagatcatcgagagagccggctacagcctggagaaggtgttcggcatccagctgaaggagatcgacaagaacgaccacctgtacatcctgctgagcaccctggagcccaccgacgccggcatcctgggcaccaccaaggacagccccaagctgggcctgctgatggtgctgctgagcatcatcttcatgaacggcaacagaagcagcgaggccgtgatctgggaggtgctgagaaagctgggcctgagacccggcatccaccacagcctgttcggcgacgtgaagaagctgatcaccgacgagttcgtgaagcagaagtacctggactacgccagagtgcccaacagcaacccccccgagtacgagttcttctggggcctgagaagctactacgagaccagcaagatgaaggtgctgaagttcgcctgcaaggtgcagaagaaggaccccaaggagtgggccgcccagtacagagaggccatggaggccgacctgaaggccgccgccgaggccgccgccgaggccaaggccagagccgagatcagagccagaatgggcatcggcctgggcagcgagaacgccgccggcccctgcaactgggacgaggccgacatcggcccctgggccaaggccagaatccaggccggcgccgaggccaaggccaaggcccaggagagcggcagcgccagcaccggcgccagcaccagcaccaacaacagcgccagcgccagcgccagcaccagcggcggcttcagcgccggcgccagcctgaccgccaccctgaccttcggcctgttcgccggcctgggcggcgccggcgccagcaccagcggcagcagcggcgcctgcggcttcagctacaagtag

SEQ ID NO: 88509 - DNA, 1566 bp, Artificial Sequence; identical to SEQ ID NO: 88508
  Description of Artificial Sequence: Synthetic coding sequence

SEQ ID NO: 88510 - DNA, 1821 bp, Artificial Sequence; identical to SEQ ID NO: 88506
  Description of Artificial Sequence: Synthetic coding sequence

SEQ ID NO: 88511 - DNA, 1821 bp, Artificial Sequence; identical to SEQ ID NO: 88506
  Description of Artificial Sequence: Synthetic coding sequence

SEQ ID NO: 88512 - DNA, 2220 bp, Artificial Sequence
  Description of Artificial Sequence: Synthetic coding sequence
atggccgagggcagcttcagcgtgcagagcgagagctacagcgtggaggacatggacgagggcagcgacgaggtgggcgaggaggagatggtggagggcaacgactacgaggagttcggcgccttcggcggctacggcaccctgaccagcttcgacatccacatcctgagagccttcggcagcctgggccccggcctgagaatcctgagcaacgagccctgggagctggagaaccccgtgctggcccagaccctggtggaggccctgcagctggaccccgagaccctggccaacgagaccgccgccagagccgccaacgtggccagagccgccgccagcaacagagccgccagagccgccgccgccgccgccagaaccgccttcagccaggtggtggccagccacagagtggccaccccccaggtgagcggcgaggacacccagcccaccacctacgccgccgaggcccagggccccacccccgagccccccctggccagcccccagaccagccagatgctggtgaccagcaagatggccgcccccgaggcccccgccaccagcgcccagagccagaccggcagccccgcccaggaggccgccaccgagggccccagcagcgcctgcgccttcagccaggccccctgcgccagagaggtggacgccaacagacccagcaccgccttcctgggccagaacgacgtgttcgacttcacccagcccgccggcgtgagcggcatggccttccccagacccaagagacccgcccccgcccaggaggccgccaccgagggccccagcgccgccagcggcgtgccccagaccggccccggcagagaggtggccgccaccagacccaagaccaccaagagcggcaaggccctggccaagaccagatgggtggagccccagaacgtggtggccgccgccgccgccaaggccaagatggccaccagcatccccgagcccgagggcgccgccgccgccaccgcccagcacagcgccgagccctgggccagaatgggcggcaagagaaccaagaagagcaagcacctggacgacgagtacgagagcagcgaggaggagagagagacccccgccgtgccccccacctggagagccagccagcccagcctgaccgtgagagcccagctggcccccagaccccccatggcccccagaagccagatccccagcagacacgtgctgtgcctgccccccagaaacgtgaccctgctgcaggagagagccaacaagctggtgaagtacctgatgatcaaggactacaagaagatccccatcaagagagccgacatgctgaaggacgtgatcagagagtacgacgagcacttccccgagatcatcgagagagccacctacaccctggagaagaagttcggcatccacctgaaggagatcgacaaggaggagcacctgtacatcctggtgtgcaccagagacagcagcgccagactgctgggcaagaccaaggacacccccagactgagcctgctgctggtgatcctgggcgtgatcttcatgaacggcaacagagccagcgaggccgtgctgtgggaggccctgagaaagatgggcctgagacccggcgtgagacaccccttcctgggcgacctgagaaagctgatcaccgacgacttcgtgaagcagaagtacctggagtacaagaagatccccaacagcaacccccccgagtacgagttcctgtggggcctgagagccagacacgagaccagcaagatgagagtgctgagattcatcgcccagaaccagaacagagaccccagagagtggaaggcccacttcctggaggccgtggacgacgccttcaagaccatggacgtggacatggccgaggagcacgccagagcccagatgagagcccagatgaacatcggcgacgaggccctgatcggcagatggagctgggacgacatccaggtggagctgctgacctgggacgaggacggcgacttcggcgacgcctgggccagaatccccttcgccttctgggccagataccaccagtacatcctgaacagcaacagagccaacagaagagccacctggagagccggcgtgagcagcggcaccaacggcggcgccagcaccagcgtgctggacggccccagcaccagcagcaccatcagaaccagaaacgccgccagagccggcgccagcttcttcagctggatccagtag

SEQ ID NO: 88513 - DNA, 2274 bp, Artificial Sequence
  Description of Artificial Sequence: Synthetic coding sequence
atggccgagggcagcttcagcgtgcagagcgagagctacagcgtggaggacatggacgagggcagcgacgaggtgggcgaggaggagatggtggagggcaacgactacgaggagttcggcgccttcggcggctacggcaccctgaccagcttcgacatccacatcctgagagccttcggcagcctgggccccggcctgagaatcctgagcaacgagccctgggagctggagaaccccgtgctggcccagaccctggtggaggccctgcagctggaccccgagaccctggccaacgagaccgccgccagagccgccaacgtggccagagccgccgccagcaacagagccgccagagccgccgccgccgccgccagaaccgccttcagccaggtggtggccagccacagagtggccaccccccaggtgagcggcgaggacacccagcccaccacctacgccgccgaggcccagggccccacccccgagccccccctggccagcccccagaccagccagatgctggtgaccagcaagatggccgcccccgaggcccccgccaccagcgcccagagccagaccggcagccccgcccaggaggccgccaccgagggccccagcagcgcctgcgccttcagccaggccccctgcgccagagaggtggacgccaacagacccagcaccgccttcctgggccagaacgacgtgttcgacttcacccagcccgccggcgtgagcggcatggccttccccagacccaagagacccgcccccgcccaggaggccgccaccgagggccccagcgccgccagcggcgtgccccagaccggccccggcagagaggtggccgccaccagacccaagaccaccaagagcggcaaggccctggccaagaccagatgggtggagccccagaacgtggtggccgccgccgccgccaaggccaagatggccaccagcatccccgagcccgagggcgccgccgccgccaccgcccagcacagcgccgagccctgggccagaatgggcggcaagagaaccaagaagagcaagcacctggacgacgagtacgagagcagcgaggaggagagagagacccccgccgtgccccccacctggagagccagccagcccagcctgaccgtgagagcccagctggcccccagaccccccatggcccccagaagccagatccccagcagacacgtgctgtgcctgccccccagaaacgtgaccctgctgcaggagagagccaacaagctggtgaagtacctgatgatcaaggactacaagaagatccccatcaagagagccgacatgctgaaggacgtgatcagagagtacgacgagcacttccccgagatcatcgagagagccacctacaccctggagaagaagttcggcatccacctgaaggagatcgacaaggaggagcacctgtacatcctggtgtgcaccagagacagcagcgccagactgctgggcaagaccaaggacacccccagactgagcctgctgctggtgatcctgggcgtgatcttcatgaacggcaacagagccagcgaggccgtgctgtgggaggccctgagaaagatgggcctgagacccggcgtgagacaccccttcctgggcgacctgagaaagctgatcaccgacgacttcgtgaagcagaagaaccccgagctgagagaggagacccccctgagcatggcccccagctggtacctggagtacaagaagatccccaacagcaacccccccgagtacgagttcctgtggggcctgagagccagacacgagaccagcaagatgagagtgctgagattcatcgcccagaaccagaacagagaccccagagagtggaaggcccacttcctggaggccgtggacgacgccttcaagaccatggacgtggacatggccgaggagcacgccagagcccagatgagagcccagatgaacatcggcgacgaggccctgatcggcagatggagctgggacgacatccaggtggagctgctgacctgggacgaggacggcgacttcggcgacgcctgggccagaatccccttcgccttctgggccagataccaccagtacatcctgaacagcaacagagccaacagaagagccacctggagagccggcgtgagcagcggcaccaacggcggcgccagcaccagcgtgctggacggccccagcaccagcagcaccatcagaaccagaaacgccgccagagccggcgccagcttcttcagctggatccagcacagatag

SEQ ID NO: 88514 - DNA, 2226 bp, Artificial Sequence
  Description of Artificial Sequence: Synthetic coding sequence
atggccgagggcagcttcagcgtgcagagcgagagctacagcgtggaggacatggacgagggcagcgacgaggtgggcgaggaggagatggtggagggcaacgactacgaggagttcggcgccttcggcggctacggcaccctgaccagcttcgacatccacatcctgagagccttcggcagcctgggccccggcctgagaatcctgagcaacgagccctgggagctggagaaccccgtgctggcccagaccctggtggaggccctgcagctggaccccgagaccctggccaacgagaccgccgccagagccgccaacgtggccagagccgccgccagcaacagagccgccagagccgccgccgccgccgccagaaccgccttcagccaggtggtggccagccacagagtggccaccccccaggtgagcggcgaggacacccagcccaccacctacgccgccgaggcccagggccccacccccgagccccccctggccagcccccagaccagccagatgctggtgaccagcaagatggccgcccccgaggcccccgccaccagcgcccagagccagaccggcagccccgcccaggaggccgccaccgagggccccagcagcgcctgcgccttcagccaggccccctgcgccagagaggtggacgccaacagacccagcaccgccttcctgggccagaacgacgtgttcgacttcacccagcccgccggcgtgagcggcatggccttccccagacccaagagacccgcccccgcccaggaggccgccaccgagggccccagcgccgccagcggcgtgccccagaccggccccggcagagaggtggccgccaccagacccaagaccaccaagagcggcaaggccctggccaagaccagatgggtggagccccagaacgtggtggccgccgccgccgccaaggccaagatggccaccagcatccccgagcccgagggcgccgccgccgccaccgcccagcacagcgccgagccctgggccagaatgggcggcaagagaaccaagaagagcaagcacctggacgacgagtacgagagcagcgaggaggagagagagacccccgccgtgccccccacctggagagccagccagcccagcctgaccgtgagagcccagctggcccccagaccccccatggcccccagaagccagatccccagcagacacgtgctgtgcctgccccccagaaacgtgaccctgctgcaggagagagccaacaagctggtgaagtacctgatgatcaaggactacaagaagatccccatcaagagagccgacatgctgaaggacgtgatcagagagtacgacgagcacttccccgagatcatcgagagagccacctacaccctggagaagaagttcggcatccacctgaaggagatcgacaaggaggagcacctgtacatcctggtgtgcaccagagacagcagcgccagactgctgggcaagaccaaggacacccccagactgagcctgctgctggtgatcctgggcgtgatcttcatgaacggcaacagagccagcgaggccgtgctgtgggaggccctgagaaagatgggcctgagacccggcgtgagacaccccttcctgggcgacctgagaaagctgatcaccgacgacttcgtgaagcagaagtacctggagtacaagaagatccccaacagcaacccccccgagtacgagttcctgtggggcctgagagccagacacgagaccagcaagatgagagtgctgagattcatcgcccagaaccagaacagagaccccagagagtggaaggcccacttcctggaggccgtggacgacgccttcaagaccatggacgtggacatggccgaggagcacgccagagcccagatgagagcccagatgaacatcggcgacgaggccctgatcggcagatggagctgggacgacatccaggtggagctgctgacctgggacgaggacggcgacttcggcgacgcctgggccagaatccccttcgccttctgggccagataccaccagtacatcctgaacagcaacagagccaacagaagagccacctggagagccggcgtgagcagcggcaccaacggcggcgccagcaccagcgtgctggacggccccagcaccagcagcaccatcagaaccagaaacgccgccagagccggcgccagcttcttcagctggatccagcacagatag

SEQ ID NO: 88515 - DNA, 2220 bp, Artificial Sequence; identical to SEQ ID NO: 88512
  Description of Artificial Sequence: Synthetic coding sequence

SEQ ID NO: 88516 - DNA, 2274 bp, Artificial Sequence; identical to SEQ ID NO: 88513
  Description of Artificial Sequence: Synthetic coding sequence

SEQ ID NO: 88517 - DNA, 2226 bp, Artificial Sequence; identical to SEQ ID NO: 88514
  Description of Artificial Sequence: Synthetic coding sequence

SEQ ID NO: 88518 - DNA, 2874 bp, Artificial Sequence
  Description of Artificial Sequence: Synthetic coding sequence
atgagcctggtgagccagaacagcagaagaagaagaagaagagtggccaaggccaccgcccacaacagcagctggggcgagatgcaggcccccaacgcccccggcctgcccgccgacgtgcccggcagcgacgtgccccagggccccagcgacagccagatcctgcagggcctgtgcgccagcgagggccccagcaccagcgtgctgcccaccagcgccgagggccccagcaccttcgtgccccccaccatcagcgaggccagcagcgccagcggccagcccaccatcagcgagggccccggcaccagcgtgctgcccacccccagcgagggcctgagcaccagcggcccccccaccatcagcaagggcctgtgcaccagcgtgaccctggccgccagcgagggcagaaacaccagcagaccccccaccagcagcgaggagcccagcaccagcgtgccccccaccgccagcgaggtgcccagcaccagcctgccccccacccccggcgagggcaccagcaccagcgtgccccccaccgcctacgagggccccagcaccagcgtggtgcccacccccgacgagggccccagcaccagcgtgctgcccacccccggcgagggccccggcaccagcgtgcccctggccgccaccgagggcctgagcaccagcgtgcaggccacccccgacgagggccccagcaccagcgtgccccccaccgccaccgagggcctgagcacccccgtgccccccaccagagacgagggccccagcaccagcgtgcccgccacccccggcgagggccccagcaccagcgtgctgcccgccgccagcgacggccagagcatcagcctggtgcccaccagaggcaagggcagcagcaccagcgtgccccccaccgccaccgagggcctgagcaccagcgtgcagcccaccgccggcgagggcagcagcaccagcgtgccccccacccccggcggcggcctgagcaccagcgtgccccccaccgccaccgaggagctgagcaccagcgtgccccccacccccggcgagggccccagcaccagcgtgctgcccatccccggcgagggcctgagcaccagcgtgccccccaccgccagcgacggcagcgacaccagcgtgccccccacccccggcgagggcgccagcaccctggtgcagcccaccgcccccgacggccccggcagcagcgtgctgcccaaccccggcgagggccccagcaccctgttcagcagcagcgccagcgtggacagaaaccccagcaagtgcagcctggtgctgcccagccccagagtgaccaaggccagcgtggacagcgacagcgagggccccaagggcgccgagggccccatcgagttcgaggtgctgagagactgcgagagccccaacagcatcagcatcatgggcctgaacaccagcagagtggccatcaccctgaagccccaggaccccatggagcagaacgtggccgagctgctgcagttcctgctggtgaaggaccagagcaagtaccccatcagagagagcgagatgagagagtacatcgtgaaggagtacagaaaccagttccccgagatcctgagaagagccgccgcccacctggagtgcatcttcagattcgagctgagagagctggaccccgaggcccacacctacatcctgctgaacaagctgggccccgtgcccttcgagggcctggaggagagccccaacggccccaagatgggcctgctgatgatgatcctgggccagatcttcctgaacggcaaccaggccaaggaggccgagatctgggagatgctgtggagaatgggcgtgcagagagagagaagactgagcatcttcggcaaccccaagagactgctgagcgtggagttcgtgtggcagagatacctggactacagacccgtgaccgactgcaagcccgtggagtacgagttcttctggggccccagaagccacctggagaccaccaagatgaagatcctgaagttcatggccaagatctacaacaaggaccccatggactggcccgagaagtacaacgaggccctggaggaggacgccgccagagccttcgccgagggctggcaggccctgccccacttcagaagacccttcttcgaggaggccgccgccgaggtgcccagccccgacagcgaggtgagcagctacagcagcaagtacgccccccacagctggcccgagagcagactggagagcaaggccagaaagctggtgcagctgttcctgctgatggacagcaccaagctgcccatccccaagaagggcatcctgtactacatcggcagagagtgcagcaaggtgttccccgacctgctgaacagagccgccagaaccctgaaccacgtgtacggcaccgagctggtggtgctggaccccagaaaccacagctacaccctgtacaacagaagagagatggaggagaccgaggagatcgtggacagccccaacagacccggcaacaacttcctgatgcaggtgctgagcttcatcttcatcatgggcaaccacgccagagagagcgccgtgtgggccttcctgagaggcctgggcgtgcaggccggcagaaagcacgtgatcacctgcagatacctgagccagagatacatcgacagcctgagagtgcccgacagcgaccccgtgcagtacgagttcgtgtggggccccagagccagactggagaccagcaagatgaaggccctgagatacgtggccagaatccacagaaaggagccccaggactggccccagcagtacagagaggccatggaggacgaggccaacagagccgacgtgggccacagacagatcttcgtgcacaacttcagatag

SEQ ID NO: 88519 - DNA, 1572 bp, Artificial Sequence
  Description of Artificial Sequence: Synthetic coding sequence
atgagcctggtgagccagaacgccagacactgcagcgccgagatcaccgccgactacggcgacggcagaggcgagatccaggccaccaacgccagcggcagccccaccagcatgctggtggtggacgccccccagtgcccccaggcccccatcaacagccagtgcgtgaacaccagccaggccgtgcaggaccccaacgacctggaggtgctgatcgacgagcagagcagaagactgggcgccctgagagtgcacgaccccctggaggacagaagcatcgccctggtgaacttcatgagaatgaagagccagaccgagggcagcatccagcagagcgagatgctggagttcctgagagagtacagcgaccagttccccgagatcctgagaagagccagcgcccacctggaccaggtgttcggcctgaacctgagagtgatcgacccccaggccgacacctacaacctggtgagcaagagaggcttccagatcaccgacagaatcgccgagagcctggacatgcccaaggccagcctgctggccctggtgctgggccacatcctgctgaacggcaacagagccagagaggccagcatctgggacctgctgctgaaggtggacatgtgggacaagccccagagaatcaacaacctgttcggcaacaccagaaacctgctgaccaccgacttcgtgtgcatgagattcctggagtactggcccgtgtacggcaccaaccccctggagttcgagttcctgtggggcagcagagcccacagagagatcaccaagatggaggccctgaagttcgtgagcgacgcccacgacgaggagccctggagctggcccgaggagtacaacaaggccctggagggcgacaagaccaaggagagaagcctgaccgccggcctggagttctggagcgaggacaccatgaacgacaaggccaacgacctggtgcagctggccatcagcgtgaccgaggagatgctgcccatccaccaggacgagctgctggcccacaccggcaaggagttcgaggacgtgttccccaacatcctgaacagagccaccctgatcctggacatgttctacggcctgagcctgatcgaggtggacaccagcgagcacatctacctgctggtgcagcagcccgagagcgaggaggagcaggtgatgctggagagcctgggcagacccacccaggagtacgtgatgcccatcctgggcctgatcttcctgatgggcaacagagtgaaggaggccaacgtgtggaacctgctgagaagattcagcgtggacgtgggcagaaagcacagcatcaccagaaagctgatgagacagagatacctggagtgcagacccctgagctacagcaaccccgtggagtacgagctgctgtggggccccagagcccaccacgagaccatcaagatgaaggtgctggagtacatggccagactgtacagaaagagaccccagaactggcccgagcagtacagagaggccgtggaggacgaggaggccagagccaagagcgaggccaccatcatgttcttcctggaccccacctag

SEQ ID NO: 88520 - DNA, 924 bp, Artificial Sequence
  Description of Artificial Sequence: Synthetic coding sequence
atgctgcagacccccgagagcagaggcctgcccgtgccccaggccgagggcgagaaggacggcggccacgacggcgagaccagagcccccaccgccagccaggagagacccaaggaggagctgggcgccggcagagaggagggcgccgccgagcccgccctgaccagaaagggcgccagagccctggccgccaaggccctggccagaagaagagcctacagaagactgaacagaaccgtggccgagctggtgcagttcctgctggtgaaggacaagaagaagagccccatcaccagaagcgagatggtgaagtacgtgatcggcgacctgaagatcctgttccccgacatcatcgccagagccgccgagcacctgagatacgtgttcggcttcgagctgaagcagttcgacagaaagcaccacacctacatcctgatcaacaagctgaagcccctggaggaggaggaggaggaggacctgggcggcgacggccccagactgggcctgctgatgatgatcctgggcctgatctacatgagaggcaacagcgccagagaggcccaggtgtgggagatgctgagaagactgggcgtgcagcccagcaagtaccacttcctgttcggctaccccaagagactgatcatggaggacttcgtgcagcagagatacctgagctacagaagagtgccccacaccaacccccccgagtacgagttcagctggggccccagaagcaacctggagatcagcaagatggaggtgctgggcttcgtggccaagctgcacaagaaggagccccagcactggcccgtgcagtacagagaggccctggccgacgaggccgacagagccagagccaaggccagagccgaggccagcatgagagccagagccagcgccagagccggcatccacctgtggtag

SEQ ID NO: 88521 - DNA, 396 bp, Artificial Sequence
  Description of Artificial Sequence: Synthetic coding sequence
atggccagaagcctggtgtgcctgggcgtgatcatcctgctgagcgccttcagcggccccggcgtgagaggcggccccatgcccaagctggccgacagaaagctgtgcgccgaccaggagtgcagccaccccatcagcatggccgtggccctgcaggactacatggcccccgactgcagattcctgaccatccacagaggccaggtggtgtacgtgttcagcaagctgaagggcagaggcagactgttctggggcggcagcgtgcagggcgactactacggcgacctggccgccagactgggctacttccccagcagcatcgtgagagaggaccagaccctgaagcccggcaaggtggacgtgaagaccgacaagtgggacttctactgccagtag

SEQ ID NO: 88522 - DNA, 642 bp, Artificial Sequence
  Description of Artificial Sequence: Synthetic coding sequence
atggccgagacctacgacttcctgttcaagttcctggtgatcggcagcgccggcaccggcaagagctgcctgctgcaccagttcatcgagaacaagttcaagcaggacagcaaccacaccatcggcgtggagttcggcagcagagtggtgaacgtgggcggcaagaccgtgaagctgcagatctgggacaccgccggccaggagagattcagaagcgtgaccagaagctactacagaggcgccgccggcgccctgctggtgtacgacatcaccagcagagagacctacaacagcctggccgcctggctgaccgacgccagaaccctggccagccccaacatcgtggtgatcctgtgcggcaacaagaaggacctggaccccgagagagaggtgaccttcctggaggccagcagattcgcccaggagaacgagctgatgttcctggagaccagcgccctgaccggcgagaacgtggaggaggccttcctgaagtgcgccagaaccatcctgaacaagatcgacagcggcgagctggaccccgagagaatgggcagcggcatccagtacggcgacgccagcctgagacagctgagacagcccagaagcgcccaggccgtggccccccagccctgcggctgctag

SEQ ID NO: 88523 - DNA, 366 bp, Artificial Sequence
  Description of Artificial Sequence: Synthetic coding sequence
atggccgagacctacgacttcctgttcaagttcctggtgatcggcagcgccggcaccggcaagagctgcctgctgcaccagttcatcgagaacaagttcaagcaggacagcaaccacaccatcggcgtggagttcggcagcagagtggtgaacgtgggcggcaagaccgtgaagctgcagatctgggacaccgccggccaggagagattcagaagcgtgaccagaagctactacagaggcgccgccggcgccctgctggtgtacgacatcaccagagccgacgtgcccggcgaccagagaagccacagaagagagagaggcggcggcgtgccccaggtgtgcccccactacccccagcaggactag

SEQ ID NO: 88524 - DNA, 396 bp, Artificial Sequence
  Description of Artificial Sequence: Synthetic coding sequence
atggccagaagcctggtgtgcctgggcgtgatcatcctgctgagcgccttcagcggccccggcgtgagaggcggccccatgcccaagctggccgacagaaagctgtgcgccgaccaggagtgcagccaccccatcagcatggccgtggccctgcaggactacatggcccccgactgcagattcctgaccatccacagaggccaggtggtgtacgtgttcagcaagctgaagggcagaggcagactgttctggggcggcagcgtgcagggcgactactacggcgacctggccgccagactgggctacttccccagcagcatcgtgagagaggaccagaccctgaagcccggcaaggtggacgtgaagaccgacaccagcagcagcaacagctggtag

SEQ ID NO: 88525 - DNA, 2358 bp, Artificial Sequence
  Description of Artificial Sequence: Synthetic coding sequence
atggacagcgtgcccgccaccgtgcccagcatcgccgccacccccggcgaccccgagctggtgggccccctgagcgtgctgtacgccgccttcatcgccaagctgctggagctggtggccaccctgcccgacgacgtgcagcccggccccgacttctacggcctgccctggaagcccgtgttcatcaccgccttcctgggcatcgccagcttcgccatcttcctgtggagaaccgtgctggtggtgaccgacaccctggtgagcgtgaccgagcagcagatcagcgagaagctgaagaccatcatgaaggagaacaccgagctggtgcagaagctgagcaactacgagcagaagatcaaggagagcaagaagcacgtgcaggagaccagaaagcagaacatgatcctgagcgacgaggccatcaagtacaaggacaagatcaagaccctggagaagaaccaggagatcctggacgacaccgccaagaacctgagagtgatgctggagagcgagagagagcagaacgtgaagaaccaggacctgatcagcgagaacaagaagagcatcgagaagctgaaggacgtgatcagcatgaacgccagcgagttcagcgaggtgcagatcgccctgaacgaggccaagctgagcgaggagaaggtgaagagcgagtgccacagagtgcaggaggagaacgccagactgaagaagaagaaggagcagctgcagcaggagatcgaggactggagcaagctgcacgccgagctgagcgagcagatcaagagcttcgagaagagccagaaggacctggaggtggccctgacccacaaggacgacaacatcaacgccctgaccaactgcatcacccagctgaacctgctggagtgcgagagcgagagcgagggccagaacaagggcggcaacgacagcgacgagctggccaacggcgaggtgggcggcgacagaaacgagaagatgaagaaccagatcaagcagatgatggacgtgagcagaacccagaccgccatcagcgtggtggaggaggacctgaagctgctgcagctgaagctgagagccagcgtgagcaccaagtgcaacctggaggaccaggtgaagaagctggaggacgacagaaacagcctgcaggccgccaaggccggcctggaggacgagtgcaagaccctgagacagaaggtggagatcctgaacgagctgtaccagcagaaggagatggccctgcagaagaagctgagccaggaggagtacgagagacaggagagagagcacagactgagcgccgccgacgagaaggccgtgagcgccgccgaggaggtgaagacctacaagagaagaatcgaggagatggaggacgagctgcagaagaccgagagaagcttcaagaaccagatcgccacccacgagaagaaggcccacgagaactggctgaaggccagagccgccgagagagccatcgccgaggagaagagagaggccgccaacctgagacacaagctgctggagctgacccagaagatggccatgctgcaggaggagcccgtgatcgtgaagcccatgcccggcaagcccaacacccagaacccccccagaagaggccccctgagccagaacggcagcttcggccccagccccgtgagcggcggcgagtgcagcccccccctgaccgtggagccccccgtgagacccctgagcgccaccctgaacagaagagacatgcccagaagcgagttcggcagcgtggacggccccctgccccaccccagatggagcgccgaggccagcggcaagcccagccccagcgaccccggcagcggcaccgccaccatgatgaacagcagcagcagaggcagcagccccaccagagtgctggacgagggcaaggtgaacatggcccccaagggccccccccccttccccggcgtgcccctgatgagcacccccatgggcggccccgtgcccccccccatcagatacggcccccccccccagctgtgcggccccttcggccccagacccctgcccccccccttcggccccggcatgagaccccccctgggcctgagagagttcgcccccggcgtgccccccggcagaagagacctgcccctgcaccccagaggcttcctgcccggccacgcccccttcagacccctgggcagcctgggccccagagagtacttcatccccggcaccagactgcccccccccacccacggcccccaggagtacccccccccccccgccgtgagagacctgctgcccagcggcagcagagacgagcccccccccgccagccagagcaccagccaggactgcagccaggccctgaagcagagcccctag

SEQ ID NO: 88526 - DNA, 5547 bp, Artificial Sequence
  Description of Artificial Sequence: Synthetic coding sequence
atggccgccgcccccggcctgctggtgtggctgctggtgctgagactgccctggagagtgcccggccagctggaccccagcaccggcagaagattcagcgagcacaagctgtgcgccgacgacgagtgcagcatgctgatgtacagaggcgaggccctggaggacttcaccggccccgactgcagattcgtgaacttcaagaagggcgaccccgtgtacgtgtactacaagctggccagaggctggcccgaggtgtgggccggcagcgtgggcagaaccttcggctacttccccaaggacctgatccaggtggtgcacgagtacaccaaggaggagctgcaggtgcccaccgacgagaccgacttcgtgtgcttcgacggcggcagagacgacttccacaactacaacgtggaggagctgctgggcttcctggagctgtacaacagcgccgccaccgacagcgagaaggccgtggagaagaccctgcaggacatggagaagaaccccgagctgagcaaggagagagagcccgagcccgagcccgtggaggccaacagcgaggagagcgacagcgtgttcagcgagaacaccgaggacctgcaggagcagttcaccacccagaagcaccacagccacgccaacagccaggccaaccacgcccagggcgagcaggccagcttcgagagcttcgaggagatgctgcaggacaagctgaaggtgcccgagagcgagaacaacaagaccagcaacagcagccaggtgagcaacgagcaggacaagatcgacgcctacaagctgctgaagaaggagatgaccctggacctgaagaccaagttcggcagcaccgccgacgccctggtgagcgacgacgagaccaccagactggtgaccagcctggaggacgacttcgacgaggagctggacaccgagtactacgccgtgggcaaggaggacgaggagaaccaggaggacttcgacgagctgcccctgctgaccttcaccgacggcgaggacatgaagacccccgccaagagcggcgtggagaagtaccccaccgacaaggagcagaacagcaacgaggaggacaaggtgcagctgaccgtgccccccggcatcaagaacgacgacaagaacatcctgaccacctggggcgacaccatcttcagcatcgtgaccggcggcgaggagaccagagacaccatggacctggagagcagcagcagcgaggaggagaaggaggacgacgacgacgccctggtgcccgacagcaagcagggcaagccccagagcgccaccgactacagcgaccccgacaacgtggacgacggcctgttcatcgtggacatccccaagaccaacaacgacaaggaggtgaacgccgagcaccacatcaagggcaagggcagaggcgtgcaggagagcaagagaggcctggtgcaggacaagaccgagctggaggacgagaaccaggagggcatgaccgtgcacagcagcgtgcacagcaacaacctgaacagcatgcccgccgccgagaagggcaaggacaccctgaagagcgcctacgacgacaccgagaacgacctgaagggcgccgccatccacatcagcaagggcatgctgcacgaggagaagcccggcgagcagatcctggagggcggcagcgagagcgagagcgcccagaaggccgccggcaaccagatgaacgacagaaagatccagcaggagagcctgggcagcgcccccctgatgggcgacgaccaccccaacgccagcagagacagcgtggagggcgacgccctggtgaacggcgccaagctgcacaccctgagcgtggagcaccagagagaggagctgaaggaggagctggtgctgaagacccagaaccagcccagattcagcagccccgacgagatcgacctgcccagagagctggaggacgaggtgcccatcctgggcagaaacctgccctggcagcaggagagagacgtggccgccaccgccagcaagcagatgagcgagaagatcagactgagcgagggcgaggccaaggaggacagcctggacgaggagttcttccaccacaaggccatgcagggcaccgaggtgggccagaccgaccagaccgacagcaccggcggccccgccttcctgagcaaggtggaggaggacgactaccccagcgaggagctgctggaggacgagaacgccatcaacgccaagagaagcaaggagaagaaccccggcaaccagggcagacagttcgacgtgaacctgcaggtgcccgacagagccgtgctgggcaccatccaccccgaccccgagatcgaggagagcaagcaggagaccagcatgatcctggacagcgagaagaccagcgagaccgccgccaagggcgtgaacaccggcggcagagagcccaacaccatggtggagaaggagagacccctggccgacaagaaggcccagagacccttcgagagaagcgacttcagcgacagcatcaagatccagacccccgagctgggcgaggtgttccagaacaaggacagcgactacctgaagaacgacaaccccgaggagcacctgaagaccagcggcctggccggcgagcccgagggcgagctgagcaaggaggaccacgagaacaccgagaagtacatgggcaccgagagccagggcagcgccgccgccgagcccgaggacgacagcttccactggaccccccacaccagcgtggagcccggccacagcgacaagagagaggacctgctgatcatcagcagcttcttcaaggagcagcagagcctgcagagattccagaagtacttcaacgtgcacgagctggaggccctgctgcaggagatgagcagcaagctgaagagcgcccagcaggagagcctgccctacaacatggagaaggtgctggacaaggtgttcagagccagcgagagccagatcctgagcatcgccgagaagatgctggacaccagagtggccgagaacagagacctgggcatgaacgagaacaacatcttcgaggaggccgccgtgctggacgacatccaggacctgatctacttcgtgagatacaagcacagcaccgccgaggagaccgccaccctggtgatggccccccccctggaggagggcctgggcggcgccatggaggagatgcagcccctgcacgaggacaacttcagcagagagaagaccgccgagctgaacgtgcaggtgcccgaggagcccacccacctggaccagagagtgatcggcgacacccacgccagcgaggtgagccagaagcccaacaccgagaaggacctggaccccggccccgtgaccaccgaggacacccccatggacgccatcgacgccaacaagcagcccgagaccgccgccgaggagcccgccagcgtgacccccctggagaacgccatcctgctgatctacagcttcatgttctacctgaccaagagcctggtggccaccctgcccgacgacgtgcagcccggccccgacttctacggcctgccctggaagcccgtgttcatcaccgccttcctgggcatcgccagcttcgccatcttcctgtggagaaccgtgctggtggtgagcaacaccgtgtactacgtgaccgagcagcagatcagcgagaagctgaagaccatcatgaaggagaacaccgagctggtgcagaagctgagcaactacgagcagaagatcaaggagagcaagaagcacgtgcaggagaccagaaagcagaacatgatcctgagcgacgaggccatcaagtacaaggacaagatcaagaccctggagaagaaccaggagatcctggacgacaccgccaagaacctgagagtgatgctggagagcgagagagagcagaacgtgaagaaccaggacctgctgcagcaggagatcgaggactggagcaagctgcacgccgagctgagcgagcagatcaagagcttcgagaagagccagaaggacctggaggtggccctgacccacaaggacgacaacatcaacgccctgaccaactgcatcacccagctgaacctgctggagtgcgagagcgagagcgagggccagaacaagggcggcaacgacagcgacgagctggccaacggcgaggtgggcggcgacagaaacgagaagatgaagaaccagatcaagcagatgatggacgtgagcagaacccagaccgccatcagcgtggtggaggaggacctgaagctgctgcagctgaagctgagagccagcgtgagcaccaagtgcaacctggaggaccaggtgaagaagctggaggacgacagaaacagcctgcaggccgccaaggccggcctggaggacgagtgcaagaccctgagacagaaggtggagatcctgaacgagctgtaccagcagaaggagatggccctgcagaagaagctgagccaggaggagtacgagagacaggagagagagcacagactgagcgccgccgacgagaaggccgtgagcgccgccgaggaggtgaagacctacaagagaagaatcgaggagatggaggacgagctgcagaagaccgagagaagcttcaagaaccagatcgccacccacgagaagaaggcccacgagaactggctgaaggccagagccgccgagagagccatcgccgaggagaagagagaggccgccaacctgagacacaagctgctggagctgacccagaagatggccatgctgcaggaggagcccgtgatcgtgaagcccatgcccggcaagcccaacacccagaacccccccagaagaggccccctgagccagaacggcagcttcggccccagccccgtgagcggcggcgagtgcagcccccccctgaccgtggagccccccgtgagacccctgagcgccaccctgaacagaagagacatgcccagaagcgagttcggcagcgtggacggccccctgccccaccccagatggagcgccgaggccagcggcaagcccagccccagcgaccccggcagcggcaccgccaccatgatgaacagcagcagcagaggcagcagccccaccagagtgctggacgagggcaaggtgaacatggcccccaagggccccccccccttccccggcgtgcccctgatgagcacccccatgggcggccccgtgcccccccccatcagatacggcccccccccccagctgtgcggccccttcggccccagacccctgcccccccccttcggccccggcatgagaccccccctgggcctgagagagttcgcccccggcgtgccccccggcagaagagacctgcccctgcaccccagaggcttcctgcccggccacgcccccttcagacccctgggcagcctgggccccagagagtacttcatccccggcaccagactgcccccccccacccacggcccccaggagtacccccccccccccgccgtgagagacctgctgcccagcggcagcagagacgagcccccccccgccagccagagcaccagccaggactgcagccaggccctgaagcagagcccctag

SEQ ID NO: 88527 - DNA, 2358 bp, Artificial Sequence
  Description of Artificial Sequence: Synthetic coding sequence
atggacagcgtgcccgccaccgtgcccagcatcgccgccacccccggcgaccccgagctggtgggccccctgagcgtgctgtacgccgccttcatcgccaagctgctggagctggtggccaccctgcccgacgacgtgcagcccggccccgacttctacggcctgccctggaagcccgtgttcatcaccgccttcctgggcatcgccagcttcgccatcttcctgtggagaaccgtgctggtggtgaaggacagagtgtaccaggtgaccgagcagcagatcagcgagaagctgaagaccatcatgaaggagaacaccgagctggtgcagaagctgagcaactacgagcagaagatcaaggagagcaagaagcacgtgcaggagaccagaaagcagaacatgatcctgagcgacgaggccatcaagtacaaggacaagatcaagaccctggagaagaaccaggagatcctggacgacaccgccaagaacctgagagtgatgctggagagcgagagagagcagaacgtgaagaaccaggacctgatcagcgagaacaagaagagcatcgagaagctgaaggacgtgatcagcatgaacgccagcgagttcagcgaggtgcagatcgccctgaacgaggccaagctgagcgaggagaaggtgaagagcgagtgccacagagtgcaggaggagaacgccagactgaagaagaagaaggagcagctgcagcaggagatcgaggactggagcaagctgcacgccgagctgagcgagcagatcaagagcttcgagaagagccagaaggacctggaggtggccctgacccacaaggacgacaacatcaacgccctgaccaactgcatcacccagctgaacctgctggagtgcgagagcgagagcgagggccagaacaagggcggcaacgacagcgacgagctggccaacggcgaggtgggcggcgacagaaacgagaagatgaagaaccagatcaagcagatgatggacgtgagcagaacccagaccgccatcagcgtggtggaggaggacctgaagctgctgcagctgaagctgagagccagcgtgagcaccaagtgcaacctggaggaccaggtgaagaagctggaggacgacagaaacagcctgcaggccgccaaggccggcctggaggacgagtgcaagaccctgagacagaaggtggagatcctgaacgagctgtaccagcagaaggagatggccctgcagaagaagctgagccaggaggagtacgagagacaggagagagagcacagactgagcgccgccgacgagaaggccgtgagcgccgccgaggaggtgaagacctacaagagaagaatcgaggagatggaggacgagctgcagaagaccgagagaagcttcaagaaccagatcgccacccacgagaagaaggcccacgagaactggctgaaggccagagccgccgagagagccatcgccgaggagaagagagaggccgccaacctgagacacaagctgctggagctgacccagaagatggccatgctgcaggaggagcccgtgatcgtgaagcccatgcccggcaagcccaacacccagaacccccccagaagaggccccctgagccagaacggcagcttcggccccagccccgtgagcggcggcgagtgcagcccccccctgaccgtggagccccccgtgagacccctgagcgccaccctgaacagaagagacatgcccagaagcgagttcggcagcgtggacggccccctgccccaccccagatggagcgccgaggccagcggcaagcccagccccagcgaccccggcagcggcaccgccaccatgatgaacagcagcagcagaggcagcagccccaccagagtgctggacgagggcaaggtgaacatggcccccaagggccccccccccttccccggcgtgcccctgatgagcacccccatgggcggccccgtgcccccccccatcagatacggcccccccccccagctgtgcggccccttcggccccagacccctgcccccccccttcggccccggcatgagaccccccctgggcctgagagagttcgcccccggcgtgccccccggcagaagagacctgcccctgcaccccagaggcttcctgcccggccacgcccccttcagacccctgggcagcctgggccccagagagtacttcatccccggcaccagactgcccccccccacccacggcccccaggagtacccccccccccccgccgtgagagacctgctgcccagcggcagcagagacgagcccccccccgccagccagagcaccagccaggactgcagccaggccctgaagcagagcccctag

SEQ ID NO: 88528 - DNA, 5724 bp, Artificial Sequence
  Description of Artificial Sequence: Synthetic coding sequence
atggccgccgcccccggcctgctggtgtggctgctggtgctgagactgccctggagagtgcccggccagctggaccccagcaccggcagaagattcagcgagcacaagctgtgcgccgacgacgagtgcagcatgctgatgtacagaggcgaggccctggaggacttcaccggccccgactgcagattcgtgaacttcaagaagggcgaccccgtgtacgtgtactacaagctggccagaggctggcccgaggtgtgggccggcagcgtgggcagaaccttcggctacttccccaaggacctgatccaggtggtgcacgagtacaccaaggaggagctgcaggtgcccaccgacgagaccgacttcgtgtgcttcgacggcggcagagacgacttccacaactacaacgtggaggagctgctgggcttcctggagctgtacaacagcgccgccaccgacagcgagaaggccgtggagaagaccctgcaggacatggagaagaaccccgagctgagcaaggagagagagcccgagcccgagcccgtggaggccaacagcgaggagagcgacagcgtgttcagcgagaacaccgaggacctgcaggagcagttcaccacccagaagcaccacagccacgccaacagccaggccaaccacgcccagggcgagcaggccagcttcgagagcttcgaggagatgctgcaggacaagctgaaggtgcccgagagcgagaacaacaagaccagcaacagcagccaggtgagcaacgagcaggacaagatcgacgcctacaagctgctgaagaaggagatgaccctggacctgaagaccaagttcggcagcaccgccgacgccctggtgagcgacgacgagaccaccagactggtgaccagcctggaggacgacttcgacgaggagctggacaccgagtactacgccgtgggcaaggaggacgaggagaaccaggaggacttcgacgagctgcccctgctgaccttcaccgacggcgaggacatgaagacccccgccaagagcggcgtggagaagtaccccaccgacaaggagcagaacagcaacgaggaggacaaggtgcagctgaccgtgccccccggcatcaagaacgacgacaagaacatcctgaccacctggggcgacaccatcttcagcatcgtgaccggcggcgaggagaccagagacaccatggacctggagagcagcagcagcgaggaggagaaggaggacgacgacgacgccctggtgcccgacagcaagcagggcaagccccagagcgccaccgactacagcgaccccgacaacgtggacgacggcctgttcatcgtggacatccccaagaccaacaacgacaaggaggtgaacgccgagcaccacatcaagggcaagggcagaggcgtgcaggagagcaagagaggcctggtgcaggacaagaccgagctggaggacgagaaccaggagggcatgaccgtgcacagcagcgtgcacagcaacaacctgaacagcatgcccgccgccgagaagggcaaggacaccctgaagagcgcctacgacgacaccgagaacgacctgaagggcgccgccatccacatcagcaagggcatgctgcacgaggagaagcccggcgagcagatcctggagggcggcagcgagagcgagagcgcccagaaggccgccggcaaccagatgaacgacagaaagatccagcaggagagcctgggcagcgcccccctgatgggcgacgaccaccccaacgccagcagagacagcgtggagggcgacgccctggtgaacggcgccaagctgcacaccctgagcgtggagcaccagagagaggagctgaaggaggagctggtgctgaagacccagaaccagcccagattcagcagccccgacgagatcgacctgcccagagagctggaggacgaggtgcccatcctgggcagaaacctgccctggcagcaggagagagacgtggccgccaccgccagcaagcagatgagcgagaagatcagactgagcgagggcgaggccaaggaggacagcctggacgaggagttcttccaccacaaggccatgcagggcaccgaggtgggccagaccgaccagaccgacagcaccggcggccccgccttcctgagcaaggtggaggaggacgactaccccagcgaggagctgctggaggacgagaacgccatcaacgccaagagaagcaaggagaagaaccccggcaaccagggcagacagttcgacgtgaacctgcaggtgcccgacagagccgtgctgggcaccatccaccccgaccccgagatcgaggagagcaagcaggagaccagcatgatcctggacagcgagaagaccagcgagaccgccgccaagggcgtgaacaccggcggcagagagcccaacaccatggtggagaaggagagacccctggccgacaagaaggcccagagacccttcgagagaagcgacttcagcgacagcatcaagatccagacccccgagctgggcgaggtgttccagaacaaggacagcgactacctgaagaacgacaaccccgaggagcacctgaagaccagcggcctggccggcgagcccgagggcgagctgagcaaggaggaccacgagaacaccgagaagtacatgggcaccgagagccagggcagcgccgccgccgagcccgaggacgacagcttccactggaccccccacaccagcgtggagcccggccacagcgacaagagagaggacctgctgatcatcagcagcttcttcaaggagcagcagagcctgcagagattccagaagtacttcaacgtgcacgagctggaggccctgctgcaggagatgagcagcaagctgaagagcgcccagcaggagagcctgccctacaacatggagaaggtgctggacaaggtgttcagagccagcgagagccagatcctgagcatcgccgagaagatgctggacaccagagtggccgagaacagagacctgggcatgaacgagaacaacatcttcgaggaggccgccgtgctggacgacatccaggacctgatctacttcgtgagatacaagcacagcaccgccgaggagaccgccaccctggtgatggccccccccctggaggagggcctgggcggcgccatggaggagatgcagcccctgcacgaggacaacttcagcagagagaagaccgccgagctgaacgtgcaggtgcccgaggagcccacccacctggaccagagagtgatcggcgacacccacgccagcgaggtgagccagaagcccaacaccgagaaggacctggaccccggccccgtgaccaccgaggacacccccatggacgccatcgacgccaacaagcagcccgagaccgccgccgaggagcccgccagcgtgacccccctggagaacgccatcctgctgatctacagcttcatgttctacctgaccaagagcctggtggccaccctgcccgacgacgtgcagcccggccccgacttctacggcctgccctggaagcccgtgttcatcaccgccttcctgggcatcgccagcttcgccatcttcctgtggagaaccgtgctggtggtgagcaacaccgtgtactacgtgaccgagcagcagatcagcgagaagctgaagaccatcatgaaggagaacaccgagctggtgcagaagctgagcaactacgagcagaagatcaaggagagcaagaagcacgtgcaggagaccagaaagcagaacatgatcctgagcgacgaggccatcaagtacaaggacaagatcaagaccctggagaagaaccaggagatcctggacgacaccgccaagaacctgagagtgatgctggagagcgagagagagcagaacgtgaagaaccaggacctgatcagcgagaacaagaagagcatcgagaagctgaaggacgtgatcagcatgaacgccagcgagttcagcgaggtgcagatcgccctgaacgaggccaagctgagcgaggagaaggtgaagagcgagtgccacagagtgcaggaggagaacgccagactgaagaagaagaaggagcagctgcagcaggagatcgaggactggagcaagctgcacgccgagctgagcgagcagatcaagagcttcgagaagagccagaaggacctggaggtggccctgacccacaaggacgacaacatcaacgccctgaccaactgcatcacccagctgaacctgctggagtgcgagagcgagagcgagggccagaacaagggcggcaacgacagcgacgagctggccaacggcgaggtgggcggcgacagaaacgagaagatgaagaaccagatcaagcagatgatggacgtgagcagaacccagaccgccatcagcgtggtggaggaggacctgaagctgctgcagctgaagctgagagccagcgtgagcaccaagtgcaacctggaggaccaggtgaagaagctggaggacgacagaaacagcctgcaggccgccaaggccggcctggaggacgagtgcaagaccctgagacagaaggtggagatcctgaacgagctgtaccagcagaaggagatggccctgcagaagaagctgagccaggaggagtacgagagacaggagagagagcacagactgagcgccgccgacgagaaggccgtgagcgccgccgaggaggtgaagacctacaagagaagaatcgaggagatggaggacgagctgcagaagaccgagagaagcttcaagaaccagatcgccacccacgagaagaaggcccacgagaactggctgaaggccagagccgccgagagagccatcgccgaggagaagagagaggccgccaacctgagacacaagctgctggagctgacccagaagatggccatgctgcaggaggagcccgtgatcgtgaagcccatgcccggcaagcccaacacccagaacccccccagaagaggccccctgagccagaacggcagcttcggccccagccccgtgagcggcggcgagtgcagcccccccctgaccgtggagccccccgtgagacccctgagcgccaccctgaacagaagagacatgcccagaagcgagttcggcagcgtggacggccccctgccccaccccagatggagcgccgaggccagcggcaagcccagccccagcgaccccggcagcggcaccgccaccatgatgaacagcagcagcagaggcagcagccccaccagagtgctggacgagggcaaggtgaacatggcccccaagggccccccccccttccccggcgtgcccctgatgagcacccccatgggcggccccgtgcccccccccatcagatacggcccccccccccagctgtgcggccccttcggccccagacccctgcccccccccttcggccccggcatgagaccccccctgggcctgagagagttcgcccccggcgtgccccccggcagaagagacctgcccctgcaccccagaggcttcctgcccggccacgcccccttcagacccctgggcagcctgggccccagagagtacttcatccccggcaccagactgcccccccccacccacggcccccaggagtacccccccccccccgccgtgagagacctgctgcccagcggcagcagagacgagcccccccccgccagccagagcaccagccaggactgcagccaggccctgaagcagagcccctag

SEQ ID NO: 88529 - DNA, 1503 bp, Artificial Sequence
  Description of Artificial Sequence: Synthetic coding sequence
atggccgccgcccccggcctgctggtgtggctgctggtgctgagactgccctggagagtgcccggccagctggaccccagcaccggcagaagattcagcgagcacaagctgtgcgccgacgacgagtgcagcatgctgatgtacagaggcgaggccctggaggacttcaccggccccgactgcagattcgtgaacttcaagaagggcgaccccgtgtacgtgtactacaagctggccagaggctggcccgaggtgtgggccggcagcgtgggcagaaccttcggctacttccccaaggacctgatccaggtggtgcacgagtacaccaaggaggagctgcaggtgcccaccgacgagaccgacttcgtgtgcttcgacggcggcagagacgacttccacaactacaacgtggaggagctgctgggcttcctggagctgtacaacagcgccgccaccgacagcgagaaggccgtggagaagaccctgcaggacatggagaagaaccccgagctgagcaaggagagagagcccgagcccgagcccgtggaggccaacagcgaggagagcgacagcgtgttcagcgagaacaccgaggacctgcaggagcagttcaccacccagaagcaccacagccacgccaacagccaggccaaccacgcccagggcgagcaggccagcttcgagagcttcgaggagatgctgcaggacaagctgaaggtgcccgagagcgagaacaacaagaccagcaacagcagccaggtgagcaacgagcaggacaagatcgacgcctacaagctgctgaagaaggagatgaccctggacctgaagaccaagttcggcagcaccgccgacgccctggtgagcgacgacgagaccaccagactggtgaccagcctggaggacgacttcgacgaggagctggacaccgagtactacgccgtgggcaaggaggacgaggagaaccaggaggacttcgacgagctgcccctgctgaccttcaccgacggcgaggacatgaagacccccgccaagagcggcgtggagaagtaccccaccgacaaggagcagaacagcaacgaggaggacaaggtgcagctgaccgtgccccccggcatcaagaacgacgacaagaacatcctgaccacctggggcgacaccatcttcagcatcgtgaccggcggcgaggagaccagagacaccatggacctggagagcagcagcagcgaggaggagaaggaggacgacgacgacgccctggtgcccgacagcaagcagggcaagccccagagcgccaccgactacagcgaccccgacaacgtggacgacggcctgttcatcgtggacatccccaagaccaacaacgacaaggaggtgaacgccgagcaccacatcaagggcaagggcagaggcgtgcaggagagcaagagaggcctggtgcaggacaagaccgagctggaggacgagaaccaggagggcttcaagaccgagcccatcaagctgtag

SEQ ID NO: 88530 - DNA, 5724 bp, Artificial Sequence
  Description of Artificial Sequence: Synthetic coding sequence
atggccgccgcccccggcctgctggtgtggctgctggtgctgagactgccctggagagtgcccggccagctggaccccagcaccggcagaagattcagcgagcacaagctgtgcgccgacgacgagtgcagcatgctgatgtacagaggcgaggccctggaggacttcaccggccccgactgcagattcgtgaacttcaagaagggcgaccccgtgtacgtgtactacaagctggccagaggctggcccgaggtgtgggccggcagcgtgggcagaaccttcggctacttccccaaggacctgatccaggtggtgcacgagtacaccaaggaggagctgcaggtgcccaccgacgagaccgacttcgtgtgcttcgacggcggcagagacgacttccacaactacaacgtggaggagctgctgggcttcctggagctgtacaacagcgccgccaccgacagcgagaaggccgtggagaagaccctgcaggacatggagaagaaccccgagctgagcaaggagagagagcccgagcccgagcccgtggaggccaacagcgaggagagcgacagcgtgttcagcgagaacaccgaggacctgcaggagcagttcaccacccagaagcaccacagccacgccaacagccaggccaaccacgcccagggcgagcaggccagcttcgagagcttcgaggagatgctgcaggacaagctgaaggtgcccgagagcgagaacaacaagaccagcaacagcagccaggtgagcaacgagcaggacaagatcgacgcctacaagctgctgaagaaggagatgaccctggacctgaagaccaagttcggcagcaccgccgacgccctggtgagcgacgacgagaccaccagactggtgaccagcctggaggacgacttcgacgaggagctggacaccgagtactacgccgtgggcaaggaggacgaggagaaccaggaggacttcgacgagctgcccctgctgaccttcaccgacggcgaggacatgaagacccccgccaagagcggcgtggagaagtaccccaccgacaaggagcagaacagcaacgaggaggacaaggtgcagctgaccgtgccccccggcatcaagaacgacgacaagaacatcctgaccacctggggcgacaccatcttcagcatcgtgaccggcggcgaggagaccagagacaccatggacctggagagcagcagcagcgaggaggagaaggaggacgacgacgacgccctggtgcccgacagcaagcagggcaagccccagagcgccaccgactacagcgaccccgacaacgtggacgacggcctgttcatcgtggacatccccaagaccaacaacgacaaggaggtgaacgccgagcaccacatcaagggcaagggcagaggcgtgcaggagagcaagagaggcctggtgcaggacaagaccgagctggaggacgagaaccaggagggcatgaccgtgcacagcagcgtgcacagcaacaacctgaacagcatgcccgccgccgagaagggcaaggacaccctgaagagcgcctacgacgacaccgagaacgacctgaagggcgccgccatccacatcagcaagggcatgctgcacgaggagaagcccggcgagcagatcctggagggcggcagcgagagcgagagcgcccagaaggccgccggcaaccagatgaacgacagaaagatccagcaggagagcctgggcagcgcccccctgatgggcgacgaccaccccaacgccagcagagacagcgtggagggcgacgccctggtgaacggcgccaagctgcacaccctgagcgtggagcaccagagagaggagctgaaggaggagctggtgctgaagacccagaaccagcccagattcagcagccccgacgagatcgacctgcccagagagctggaggacgaggtgcccatcctgggcagaaacctgccctggcagcaggagagagacgtggccgccaccgccagcaagcagatgagcgagaagatcagactgagcgagggcgaggccaaggaggacagcctggacgaggagttcttccaccacaaggccatgcagggcaccgaggtgggccagaccgaccagaccgacagcaccggcggccccgccttcctgagcaaggtggaggaggacgactaccccagcgaggagctgctggaggacgagaacgccatcaacgccaagagaagcaaggagaagaaccccggcaaccagggcagacagttcgacgtgaacctgcaggtgcccgacagagccgtgctgggcaccatccaccccgaccccgagatcgaggagagcaagcaggagaccagcatgatcctggacagcgagaagaccagcgagaccgccgccaagggcgtgaacaccggcggcagagagcccaacaccatggtggagaaggagagacccctggccgacaagaaggcccagagacccttcgagagaagcgacttcagcgacagcatcaagatccagacccccgagctgggcgaggtgttccagaacaaggacagcgactacctgaagaacgacaaccccgaggagcacctgaagaccagcggcctggccggcgagcccgagggcgagctgagcaaggaggaccacgagaacaccgagaagtacatgggcaccgagagccagggcagcgccgccgccgagcccgaggacgacagcttccactggaccccccacaccagcgtggagcccggccacagcgacaagagagaggacctgctgatcatcagcagcttcttcaaggagcagcagagcctgcagagattccagaagtacttcaacgtgcacgagctggaggccctgctgcaggagatgagcagcaagctgaagagcgcccagcaggagagcctgccctacaacatggagaaggtgctggacaaggtgttcagagccagcgagagccagatcctgagcatcgccgagaagatgctggacaccagagtggccgagaacagagacctgggcatgaacgagaacaacatcttcgaggaggccgccgtgctggacgacatccaggacctgatctacttcgtgagatacaagcacagcaccgccgaggagaccgccaccctggtgatggccccccccctggaggagggcctgggcggcgccatggaggagatgcagcccctgcacgaggacaacttcagcagagagaagaccgccgagctgaacgtgcaggtgcccgaggagcccacccacctggaccagagagtgatcggcgacacccacgccagcgaggtgagccagaagcccaacaccgagaaggacctggaccccggccccgtgaccaccgaggacacccccatggacgccatcgacgccaacaagcagcccgagaccgccgccgaggagcccgccagcgtgacccccctggagaacgccatcctgctgatctacagcttcatgttctacctgaccaagagcctggtggccaccctgcccgacgacgtgcagcccggccccgacttctacggcctgccctggaagcccgtgttcatcaccgccttcctgggcatcgccagcttcgccatcttcctgtggagaaccgtgctggtggtgaaggacagagtgtaccaggtgaccgagcagcagatcagcgagaagctgaagaccatcatgaaggagaacaccgagctggtgcagaagctgagcaactacgagcagaagatcaaggagagcaagaagcacgtgcaggagaccagaaagcagaacatgatcctgagcgacgaggccatcaagtacaaggacaagatcaagaccctggagaagaaccaggagatcctggacgacaccgccaagaacctgagagtgatgctggagagcgagagagagcagaacgtgaagaaccaggacctgatcagcgagaacaagaagagcatcgagaagctgaaggacgtgatcagcatgaacgccagcgagttcagcgaggtgcagatcgccctgaacgaggccaagctgagcgaggagaaggtgaagagcgagtgccacagagtgcaggaggagaacgccagactgaagaagaagaaggagcagctgcagcaggagatcgaggactggagcaagctgcacgccgagctgagcgagcagatcaagagcttcgagaagagccagaaggacctggaggtggccctgacccacaaggacgacaacatcaacgccctgaccaactgcatcacccagctgaacctgctggagtgcgagagcgagagcgagggccagaacaagggcggcaacgacagcgacgagctggccaacggcgaggtgggcggcgacagaaacgagaagatgaagaaccagatcaagcagatgatggacgtgagcagaacccagaccgccatcagcgtggtggaggaggacctgaagctgctgcagctgaagctgagagccagcgtgagcaccaagtgcaacctggaggaccaggtgaagaagctggaggacgacagaaacagcctgcaggccgccaaggccggcctggaggacgagtgcaagaccctgagacagaaggtggagatcctgaacgagctgtaccagcagaaggagatggccctgcagaagaagctgagccaggaggagtacgagagacaggagagagagcacagactgagcgccgccgacgagaaggccgtgagcgccgccgaggaggtgaagacctacaagagaagaatcgaggagatggaggacgagctgcagaagaccgagagaagcttcaagaaccagatcgccacccacgagaagaaggcccacgagaactggctgaaggccagagccgccgagagagccatcgccgaggagaagagagaggccgccaacctgagacacaagctgctggagctgacccagaagatggccatgctgcaggaggagcccgtgatcgtgaagcccatgcccggcaagcccaacacccagaacccccccagaagaggccccctgagccagaacggcagcttcggccccagccccgtgagcggcggcgagtgcagcccccccctgaccgtggagccccccgtgagacccctgagcgccaccctgaacagaagagacatgcccagaagcgagttcggcagcgtggacggccccctgccccaccccagatggagcgccgaggccagcggcaagcccagccccagcgaccccggcagcggcaccgccaccatgatgaacagcagcagcagaggcagcagccccaccagagtgctggacgagggcaaggtgaacatggcccccaagggccccccccccttccccggcgtgcccctgatgagcacccccatgggcggccccgtgcccccccccatcagatacggcccccccccccagctgtgcggccccttcggccccagacccctgcccccccccttcggccccggcatgagaccccccctgggcctgagagagttcgcccccggcgtgccccccggcagaagagacctgcccctgcaccccagaggcttcctgcccggccacgcccccttcagacccctgggcagcctgggccccagagagtacttcatccccggcaccagactgcccccccccacccacggcccccaggagtacccccccccccccgccgtgagagacctgctgcccagcggcagcagagacgagcccccccccgccagccagagcaccagccaggactgcagccaggccctgaagcagagcccctag

SEQ ID NO: 88531 - DNA, 3051 bp, Artificial Sequence
  Description of Artificial Sequence: Synthetic coding sequence
tgactggtgcccgacagcaagcagggcaagccccagagcgccaccgactacagcgaccccgacaacgtggacgacggcctgttcatcgtggacatccccaagaccaacaacgacaaggaggtgaacgccgagcaccacatcaagggcaagggcagaggcgtgcaggagagcaagagaggcctggtgcaggacaagaccgagctggaggacgagaaccaggagggcatgaccgtgcacagcagcgtgcacagcaacaacctgaacagcatgcccgccgccgagaagggcaaggacaccctgaagagcgcctacgacgacaccgagaacgacctgaagggcgccgccatccacatcagcaagggcatgctgcacgaggagaagcccggcgagcagatcctggagggcggcagcgagagcgagagcgcccagaaggccgccggcaaccagatgaacgacagaaagatccagcaggagagcctgggcagcgcccccctgatgggcgacgaccaccccaacgccagcagagacagcgtggagggcgacgccctggtgaacggcgccaagctgcacaccctgagcgtggagcaccagagagaggagctgaaggaggagctggtgctgaagacccagaaccagcccagattcagcagccccgacgagatcgacctgcccagagagctggaggacgaggtgcccatcctgggcagaaacctgccctggcagcaggagagagacgtggccgccaccgccagcaagcagatgagcgagaagatcagactgagcgagggcgaggccaaggaggacagcctggacgaggagttcttccaccacaaggccatgcagggcaccgaggtgggccagaccgaccagaccgacagcaccggcggccccgccttcctgagcaaggtggaggaggacgactaccccagcgaggagctgctggaggacgagaacgccatcaacgccaagagaagcaaggagaagaaccccggcaaccagggcagacagttcgacgtgaacctgcaggtgcccgacagagccgtgctgggcaccatccaccccgaccccgagatcgaggagagcaagcaggagaccagcatgatcctggacagcgagaagaccagcgagaccgccgccaagggcgtgaacaccggcggcagagagcccaacaccatggtggagaaggagagacccctggccgacaagaaggcccagagacccttcgagagaagcgacttcagcgacagcatcaagatccagacccccgagctgggcgaggtgttccagaacaaggacagcgactacctgaagaacgacaaccccgaggagcacctgaagaccagcggcctggccggcgagcccgagggcgagctgagcaaggaggaccacgagaacaccgagaagtacatgggcaccgagagccagggcagcgccgccgccgagcccgaggacgacagcttccactggaccccccacaccagcgtggagcccggccacagcgacaagagagaggacctgctgatcatcagcagcttcttcaaggagcagcagagcctgcagagattccagaagtacttcaacgtgcacgagctggaggccctgctgcaggagatgagcagcaagctgaagagcgcccagcaggagagcctgccctacaacatggagaaggtgctggacaaggtgttcagagccagcgagagccagatcctgagcatcgccgagaagatgctggacaccagagtggccgagaacagagacctgggcatgaacgagaacaacatcttcgaggaggccgccgtgctggacgacatccaggacctgatctacttcgtgagatacaagcacagcaccgccgaggagaccgccaccctggtgatggccccccccctggaggagggcctgggcggcgccatggaggagatgcagcccctgcacgaggacaacttcagcagagagaagaccgccgagctgaacgtgcaggtgcccgaggagcccacccacctggaccagagagtgatcggcgacacccacgccagcgaggtgagccagaagcccaacaccgagaaggacctggaccccggccccgtgaccaccgaggacacccccatggacgccatcgacgccaacaagcagcccgagaccgccgccgaggagcccgccagcgtgacccccctggagaacgccatcctgctgatctacagcttcatgttctacctgaccaagagcctggtggccaccctgcccgacgacgtgcagcccggccccgacttctacggcctgccctggaagcccgtgttcatcaccgccttcctgggcatcgccagcttcgccatcttcctgtggagaaccgtgctggtggtgaaggacagagtgtaccaggtgaccgagcagcagatcagcgagaagctgaagaccatcatgaaggagaacaccgagctggtgcagaagctgagcaactacgagcagaagatcaaggagagcaagaagcacgtgcaggagaccagaaagcagaacatgatcctgagcgacgaggccatcaagtacaaggacaagatcaagaccctggagaagaaccaggagatcctggacgacaccgccaagaacctgagagtgatgctggagagcgagagagagcagaacgtgaagaaccaggacctgctgcagcaggagatcgaggactggagcaagctgcacgccgagctgagcgagcagatcaagagcttcgagaagagccagaaggacctggaggtggccctgacccacaaggacgacaacatcaacgccctgaccaactgcatcacccagctgaacctgctggagtgcgagagcgagagcgagggccagaacaagggcggcaacgacagcgacgagctggccaacggcgaggtgggcggcgacagaaacgagaagatgaagaaccagatcaagcagatgatggacgtgagcagaacccagaccgccatcagcgtggtggaggaggacctgaagctgctgcagctgaagctgagagccagcgtgagcaccaagtgcaacctggaggaccaggtgtag

SEQ ID NO: 88532 - DNA, 324 bp, Artificial Sequence
  Description of Artificial Sequence: Synthetic coding sequence
tgaagcgccgaggccagcggcaagcccagccccagcgaccccggcagcggcaccgccaccatgatgaacagcagcagcagaggcagcagccccaccagagtgctggacgagggcaaggtgaacatggcccccaagggccccccccccttccccggcgtgcccctgatgagcacccccatgggcggccccgtgcccccccccatcagatacggcccccccccccagctgtgcggccccttcggccccagacccctgcccccccccttcgacaaggacggcagacccggcaccgtggcccacgcctgcaaccccagcaccctgtag

SEQ ID NO: 88533 - DNA, 1803 bp, Artificial Sequence
  Description of Artificial Sequence: Synthetic coding sequence
atgggcaagaagctggacctgagcaagctgaccgacgaggaggcccagcacgtgctggaggtggtgcagagagacttcgacctgagaagaaaggaggaggagagactggaggccctgaagggcaagatcaagaaggagagcagcaagagagagctgctgagcgacaccgcccacctgaacgagacccactgcgccagatgcctgcagccctaccagctgctggtgaacagcaagagacagtgcctggagtgcggcctgttcacctgcaagagctgcggcagagtgcaccccgaggagcagggctggatctgcgacccctgccacctggccagagtggtgaagatcggcagcctggagtggtactacgagcacgtgaaggccagattcaagagattcggcagcgccaaggtgatcagaagcctgcacggcagactgcagggcggcgccggccccgagctgatcagcgaggagagaagcggcgacagcgaccagaccgacgaggacggcgagcccggcagcgaggcccaggcccaggcccagcccttcggcagcaagaagaagagactgctgagcgtgcacgacttcgacttcgagggcgacagcgacgacagcacccagccccagggccacagcctgcacctgagcagcgtgcccgaggccagagacagcccccagagcctgaccgacgagagctgcagcgagaaggccgccccccacaaggccgagggcctggaggaggccgacaccggcgccagcggctgccacagccaccccgaggagcagcccaccagcatcagccccagcagacacggcgccctggccgagctgtgcccccccggcggcagccacagaatggccctgggcaccgccgccgccctgggcagcaacgtgatcagaaacgagcagctgcccctgcagtacctggccgacgtggacaccagcgacgaggagagcatcagagcccacgtgatggccagccaccacagcaagagaagaggcagagccagcagcgagagccagatcttcgagctgaacaagcacatcagcgccgtggagtgcctgctgacctacctggagaacaccgtggtgccccccctggccaagggcctgggcgccggcgtgagaaccgaggccgacgtggaggaggaggccctgagaagaaagctggaggagctgaccagcaacgtgagcgaccaggagaccagcagcgaggaggaggaggccaaggacgagaaggccgagcccaacagagacaagagcgtgggccccctgccccaggccgaccccgaggtgggcaccgccgcccaccagaccaacagacaggagaagagcccccaggaccccggcgaccccgtgcagtacaacagaaccaccgacgaggagctgagcgagctggaggacagagtggccgtgaccgccagcgaggtgcagcaggccgagagcgaggtgagcgacatcgagagcagaatcgccgccctgagagccgccggcctgaccgtgaagcccagcggcaagcccagaagaaagagcaacctgcccatcttcctgcccagagtggccggcaagctgggcaagagacccgaggaccccaacgccgaccccagcagcgaggccaaggccatggccgtgccctacctgctgagaagaaagttcagcaacagcctgaagagccagggcaaggacgacgacagcttcgacagaaagagcgtgtacagaggcagcctgacccagagaaaccccaacgccagaaagggcatggccagccacaccttcgccaagcccgtggtggcccaccagagctag

SEQ ID NO: 88534 - DNA, 1719 bp, Artificial Sequence
  Description of Artificial Sequence: Synthetic coding sequence
atgggcaagaagctggacctgagcaagctgaccgacgaggaggcccagcacgtgctggaggtggtgcagagagacttcgacctgagaagaaaggaggaggagagactggaggccctgaagggcaagatcaagaaggagagcagcaagagagagctgctgagcgacaccgcccacctgaacgagacccactgcgccagatgcctgcagccctaccagctgctggtgaacagcaagagacagtgcctggagtgcggcctgttcacctgcaagagctgcggcagagtgcaccccgaggagcagggctggatctgcgacccctgccacctggccagagtggtgaagatcggcagcctggagtggtactacgagcacgtgaaggccagattcaagagattcggcagcgccaaggtgatcagaagcctgcacggcagactgcagggcggcgccggccccgagctgatcagcgaggagagaagcggcgacagcgaccagaccgacgaggacggcgagcccggcagcgaggcccaggcccaggcccagcccttcggcagcaagaagaagagactgctgagcgtgcacgacttcgacttcgagggcgacagcgacgacagcacccagccccagggccacagcctgcacctgagcagcgtgcccgaggccagagacagcccccagagcctgaccgacgagagctgcagcgagaaggccgccccccacaaggccgagggcctggaggaggccgacaccggcgccagcggctgccacagccaccccgaggagcagcccaccagcatcagccccagcagacacggcgccctggccgagctgtgcccccccggcggcagccacagaatggccctgggcaccgccgccgccctgggcagcaacgtgatcagaaacgagcagctgcccctgcagtacctggccgacgtggacaccagcgacgaggagagcatcagagcccacgtgatggccagccaccacagcaagagaagaggcagagccagcagcgagagccagggcctgggcgccggcgtgagaaccgaggccgacgtggaggaggaggccctgagaagaaagctggaggagctgaccagcaacgtgagcgaccaggagaccagcagcgaggaggaggaggccaaggacgagaaggccgagcccaacagagacaagagcgtgggccccctgccccaggccgaccccgaggtgggcaccgccgcccaccagaccaacagacaggagaagagcccccaggaccccggcgaccccgtgcagtacaacagaaccaccgacgaggagctgagcgagctggaggacagagtggccgtgaccgccagcgaggtgcagcaggccgagagcgaggtgagcgacatcgagagcagaatcgccgccctgagagccgccggcctgaccgtgaagcccagcggcaagcccagaagaaagagcaacctgcccatcttcctgcccagagtggccggcaagctgggcaagagacccgaggaccccaacgccgaccccagcagcgaggccaaggccatggccgtgccctacctgctgagaagaaagttcagcaacagcctgaagagccagggcaaggacgacgacagcttcgacagaaagagcgtgtacagaggcagcctgacccagagaaaccccaacgccagaaagggcatggccagccacaccttcgccaagcccgtggtggcccaccagagctag

SEQ ID NO: 88535 - DNA, 396 bp, Artificial Sequence
  Description of Artificial Sequence: Synthetic coding sequence
atgggcaagaagctggacctgagcaagctgaccgacgaggaggcccagcacgtgctggaggtggtgcagagagacttcgacctgagaagaaaggaggaggagagactggaggccctgaagggcaagatcaagaaggagagcagcaagagagagctgctgagcgacaccgcccacctgaacgagacccactgcgccagatgcctgcagccctaccagctgctggtgaacagcaagagacagtgcctggagtgcggcctgttcacctgcaagagctgcggcagagtgcaccccgaggagcagggctggatctgcgacccctgccacctggccagagtggtgaagatcggcagcctggagtggtactacgagcacgtgaaggccagattcaagagatag

SEQ ID NO: 88536 - DNA, 213 bp, Artificial Sequence
  Description of Artificial Sequence: Synthetic coding sequence
atgggcaagaagctggacctgagcaagctgaccgacgaggaggcccagcacgtgctggaggtggtgcagagagacttcgacctgagaagaaaggaggaggagagactggaggccctgaagggcaagatcaagaaggagagcagcaagagagagctgctgagcgacaccgcccacctgaacgagacccactgcgccagatgcctgcagccctag

SEQ ID NO: 88537 - DNA, 1656 bp, Artificial Sequence
  Description of Artificial Sequence: Synthetic coding sequence
atgggcaagaagctggacctgagcaagctgaccgacgaggaggcccagcacgtgctggaggtggtgcagagagacttcgacctgagaagaaaggaggaggagagactggaggccctgaagggcaagatcaagaaggagagcagcaagagagagctgctgagcgacaccgcccacctgaacgagacccactgcgccagatgcctgcagccctaccagctgctggtgaacagcaagagacagtgcctggagtgcggcctgttcacctgcaagagctgcggcagagtgcaccccgaggagcagggctggatctgcgacccctgccacctggccagagtggtgaagatcggcagcctggagtggtactacgagcacgtgaaggccagattcaagagattcggcagcgccaaggtgatcagaagcctgcacggcagactgcagggcggcgccggccccgagctgatcagcgaggagagaagcggcgacagcgaccagaccgacgaggacggcgagcccggcagcgaggcccaggcccaggcccagcccttcggcagcaagaagaagagactgctgagcgtgcacgacttcgacttcgagggcgacagcgacgacagcacccagccccagggccacagcctgcacctgagcagcgtgcccgaggccagagacagcccccagagcctgaccgacgagagctgcagcgagaaggccgccccccacaaggccgagggcctggaggaggccgacaccggcgccagcggctgccacagccaccccgaggagcagcccaccagcatcagccccagcagacacggcgccctggccgagctgtgcccccccggcggcagccacagaatggccctgggcaccgccgccgccctgggcagcaacgtgatcagaaacgagcagctgcccctgcagtacctggccgacgtggacaccagcgacgaggagagcatcagagcccacgtgatggccagccaccacagcaagagaagaggcagagccagcagcgagagccagatcttcgagctgaacaagcacatcagcgccgtggagtgcctgctgacctacctggagaacaccgtggtgccccccctggccaagggcctgggcgccggcgtgagaaccgaggccgacgtggaggaggaggccctgagaagaaagctggaggagctgaccagcaacgtgagcgaccaggagaccagcagcgaggaggaggaggccaaggacgagaaggccgagcccaacagagacaagagcgtgggccccctgccccaggccgaccccgaggtgggcaccgccgcccaccagaccaacagacaggagaagagcccccaggaccccggcgaccccgtgcagtacaacagaaccaccgacgaggagctgagcgagctggaggacagagtggccgtgaccgccagcgaggtgcagcaggccgagagcgaggtgagcgacatcgagagcagaatcgccgccctgagagccgccggcctgaccgtgaagcccagcggcaagcccagaagaaagagcaacctgcccgccctgtacgagggcaccctgagcctgtgcagcgaggacctgaagcacacccaccccgacagcgtgaagagcaagagaagcagactgaaccacgtggccagctgcggcaacccctag

SEQ ID NO: 88538 - DNA, 675 bp, Artificial Sequence
  Description of Artificial Sequence: Synthetic coding sequence
atgggcctgagagactggctgagaaccgtgtgctgctgctgcggctgcgagtgcctggaggagagagccctgcccgagaaggagcccctggtgagcgacaacaacccctacagcagcttcggcgccaccctggtgagagacgacgagaagaacctgtggagcatgccccacgacgtgagccacaccgaggccgacgacgacagaaccctgtacaacctgatcgtgatcagaaaccagcaggccaaggacagcgaggagtggcagaagctgaactacgacatccacaccctgagacaggtgagaagagaggtgagaaacagatggaagtgcatcctggaggacctgggcttccagaaggaggccgacagcctgctgagcgtgaccaagctgagcaccatcagcgacagcaagaacaccagaaaggccagagagatgctgctgaagctggccgaggagaccaacatcttccccaccagctgggagctgagcgagagatacctgttcgtggtggacagactgatcgccctggacgccgccgaggagttcttcaagctggccagaagaacctaccccaagaagcccggcgtgccctgcctggccgacggccagaaggagctgcacctgtggggcgacctgagctgcagactggcccacatgcagggcgtgctgcactag

SEQ ID NO: 88539 - DNA, 645 bp, Artificial Sequence
  Description of Artificial Sequence: Synthetic coding sequence
atgggcctgagagactggctgagaaccgtgtgctgctgctgcggctgcgagtgcctggaggagagagccctgcccgagaaggagcccctggtgagcgacaacaacccctacagcagcttcggcgccaccctggtgagagacgacgagaagaacctgtggagcatgccccacgacgtgagccacaccgaggccgacgacgacagaaccctgtacaacctgatcgtgatcagaaaccagcaggccaaggacagcgaggagtggcagaagctgaactacgacatccacaccctgagacaggtgagaagagaggtgagaaacagatggaagtgcatcctggaggacctgggcttccagaaggaggccgacagcctgctgagcgtgaccaagctgagcaccatcagcgacagcaagaacaccagaaaggccagagagatgctgctgaagctggccgaggagaccaacatcttccccaccagctgggagctgagcgagagatacctgttcgtggtggacagactgatcgccctggacgccgccgaggagttcttcaagctggccagaagaacctaccccaagaagcccggcgtgccctgcctggccgacggccagaaggagctgcactacctgcccttccccagcccctag

SEQ ID NO: 88540 - DNA, 645 bp, Artificial Sequence; identical to SEQ ID NO: 88539
  Description of Artificial Sequence: Synthetic coding sequence

SEQ ID NO: 88541 - DNA, 1053 bp, Artificial Sequence
  Description of Artificial Sequence: Synthetic coding sequence
atgcagggcaacggcagcgccctgcccaacgccagccagcccgtgctgagaggcgacggcgccagacccagctggctggccagcgccctggcctgcgtgctgatcttcaccatcgtggtggacatcctgggcaacctgctggtgatcctgagcgtgtacagaaacaagaagctgagaaacgccggcaacatcttcgtggtgagcctggccgtggccgacctggtggtggccatctacccctaccccctggtgctgatgagcatcttcaacaacggctggaacctgggctacctgcactgccaggtgagcggcttcctgatgggcctgagcgtgatcggcagcatcttcaacatcaccggcatcgccatcaacagatactgctacatctgccacagcctgaagtacgacaagctgtacagcagcaagaacagcctgtgctacgtgctgctgatctggctgctgaccctggccgccgtgctgcccaacctgagagccggcaccctgcagtacgaccccagaatctacagctgcaccttcgcccagagcgtgagcagcgcctacaccatcgccgtggtggtgttccacttcctggtgcccatgatcatcgtgatcttctgctacctgagaatctggatcctggtgctgcaggtgagacagagagtgaagcccgacagaaagcccaagctgaagccccaggacttcagaaacttcgtgaccatgttcgtggtgttcgtgctgttcgccatctgctgggcccccctgaacttcatcggcctggccgtggccagcgaccccgccagcatggtgcccagaatccccgagtggctgttcgtggccagctactacatggcctacttcaacagctgcctgaacgccatcatctacggcctgctgaaccagaacttcagaaaggagtacagaagaatcatcgtgagcctgtgcaccgccagagtgttcttcgtggacagcagcaacgacgtggccgacagagtgaagtggaagcccagccccctgatgaccaacaacaacgtggtgaaggtggacagcgtgtag

SEQ ID NO: 88542 - DNA, 1089 bp, Artificial Sequence
  Description of Artificial Sequence: Synthetic coding sequence
atgagcgagaacggcagcttcgccaactgctgcgaggccggcggctgggccgtgagacccggctggagcggcgccggcagcgccagacccagcagaacccccagacccccctgggtggcccccgccctgagcgccgtgctgatcgtgaccaccgccgtggacgtggtgggcaacctgctggtgatcctgagcgtgctgagaaacagaaagctgagaaacgccggcaacctgttcctggtgagcctggccctggccgacctggtggtggccttctacccctaccccctgatcctggtggccatcttctacgacggctgggccctgggcgaggagcactgcaaggccagcgccttcgtgatgggcctgagcgtgatcggcagcgtgttcaacatcaccgccatcgccatcaacagatactgctacatctgccacagcatggcctaccacagaatctacagaagatggcacacccccctgcacatctgcctgatctggctgctgaccgtggtggccctgctgcccaacttcttcgtgggcagcctggagtacgaccccagaatctacagctgcaccttcatccagaccgccagcacccagtacaccgccgccgtggtggtgatccacttcctgctgcccatcgccgtggtgagcttctgctacctgagaatctgggtgctggtgctgcaggccagaagaaaggccaagcccgagagcagactgtgcctgaagcccagcgacctgagaagcttcctgaccatgttcgtggtgttcgtgatcttcgccatctgctgggcccccctgaactgcatcggcctggccgtggccatcaacccccaggagatggccccccagatccccgagggcctgttcgtgaccagctacctgctggcctacttcaacagctgcctgaacgccatcgtgtacggcctgctgaaccagaacttcagaagagagtacaagagaatcctgctggccctgtggaaccccagacactgcatccaggacgccagcaagggcagccacgccgagggcctgcagagccccgccccccccatcatcggcgtgcagcaccaggccgacgccctgtag

SEQ ID NO: 88543 - DNA, 3864 bp, Artificial Sequence
  Description of Artificial Sequence: Synthetic coding sequence
atgagcaaggtgatccagaagaagaaccactggaccagcagagtgcacgagtgcaccgtgaagagaggcccccagggcgagctgggcgtgaccgtgctgggcggcgccgagcacggcgagttcccctacgtgggcgccgtggccgccgtggaggccgccggcctgcccggcggcggcgagggccccagactgggcgagggcgagctgctgctggaggtgcagggcgtgagagtgagcggcctgcccagatacgacgtgctgggcgtgatcgacagctgcaaggaggccgtgaccttcaaggccgtgagacagggcggcagactgaacaaggacctgagacacttcctgaaccagagattccagaagggcagccccgaccacgagctgcagcagaccatcagagacaacctgtacagacacgccgtgccctgcaccaccagaagccccagagagggcgaggtgcccggcgtggactacaacttcctgaccgtgaaggagttcctggacctggagcagagcggcaccctgctggaggtgggcacctacgagggcaactactacggcacccccaagccccccagccagcccgtgagcggcaaggtgatcaccaccgacgccctgcacagcctgcagagcggcagcaagcagagcacccccaagagaaccaagagctacaacgacatgcagaacgccggcatcgtgcacgccgagaacgaggaggaggacgacgtgcccgagatgaacagcagcttcaccgccgacagcggcgagcaggaggagcacaccctgcaggagaccgccctgccccccgtgaacagcagcatcatcgccgcccccatcaccgaccccagccagaagttcccccagtacctgcccctgagcgccgaggacaacctgggccccctgcccgagaactgggagatggcctacaccgagaacggcgaggtgtacttcatcgaccacaacaccaagaccaccagctggctggaccccagatgcctgaacaagcagcagaagcccctggaggagtgcgaggacgacgagggcgtgcacaccgaggagctggacagcgagctggagctgcccgccggctgggagaagatcgaggaccccgtgtacggcatctactacgtggaccacatcaacagaaagacccagtacgagaaccccgtgctggaggccaagagaaagaagcagctggagcagcagcagcagcagcagcagcagcagcagcagcagcagcagcagcagcagcagcagcagaccgaggagtggaccgaggaccacagcgccctggtgccccccgtgatccccaaccacccccccagcaaccccgagcccgccagagaggtgcccctgcagggcaagcccttcttcaccagaaaccccagcgagctgaagggcaagttcatccacaccaagctgagaaagagcagcagaggcttcggcttcaccgtggtgggcggcgacgagcccgacgagttcctgcagatcaagagcctggtgctggacggccccgccgccctggacggcaagatggagaccggcgacgtgatcgtgagcgtgaacgacacctgcgtgctgggccacacccacgcccaggtggtgaagatcttccagagcatccccatcggcgccagcgtggacctggagctgtgcagaggctaccccctgcccttcgaccccgacgaccccaacaccagcctggtgaccagcgtggccatcctggacaaggagcccatcatcgtgaacggccaggagacctacgacagccccgccagccacagcagcaagaccggcaaggtgaacggcatgaaggacgccagacccagcagccccgccgacgtggccagcaacagcagccacggctaccccaacgacaccgtgagcctggccagcagcatcgccacccagcccgagctgatcaccgtgcacatcgtgaagggccccatgggcttcggcttcaccatcgccgacagccccggcggcggcggccagagagtgaagcagatcgtggacagccccagatgcagaggcctgaaggagggcgacctgatcgtggaggtgaacaagaagaacgtgcaggccctgacccacaaccaggtggtggacatgctggtggagtgccccaagggcagcgaggtgaccctgctggtgcagagaggcggcctgcccgtgcccaagaagagccccaagagccagcccctggagagaaaggacagccagaacagcagccagcacagcgtgagcagccacagaagcctgcacaccgccagccccagccacagcacccaggtgctgcccgagttcccccccgccgaggcccaggcccccgaccagaccgacagcagcggccagaagaagcccgaccccttcaagatctgggcccagagcagaagcatgtacgagaacagacccatgagccccagccccgccagcggcctgagcaagggcgagagagagagagagatcaacagcaccaacttcggcgagtgccccatccccgactaccaggagcaggacatcttcctgtggagaaaggagaccggcttcggcttcagaatcctgggcggcaacgagcccggcgagcccatctacatcggccacatcgtgcccctgggcgccgccgacaccgacggcagactgagaagcggcgacgagctgatctgcgtggacggcacccccgtgatcggcaagagccaccagctggtggtgcagctgatgcagcaggccgccaagcagggccacgtgaacctgaccgtgagaagaaaggtggtgttcgccgtgcccaagaccgagaacgaggtgcccagccccgccagcagccaccacagcagcaaccagcccgccagcctgaccgaggagaagagaaccccccagggcagccagaacagcctgaacaccgtgagcagcggcagcggcagcaccagcggcatcggcagcggcggcggcggcggcagcggcgtggtgagcaccgtggtgcagccctacgacgtggagatcagaagaggcgagaacgagggcttcggcttcgtgatcgtgagcagcgtgagcagacccgaggccggcaccaccttcggcaacgcctgcgtggccatgccccacaagatcggcagaatcatcgagggcagccccgccgacagatgcggcaagctgaaggtgggcgacagaatcctggccgtgaacggctgcagcatcaccaacaagagccacagcgacatcgtgaacctgatcaaggaggccggcaacaccgtgaccctgagaatcatccccggcgacgagagcagcaacgccaccctgctgaccaacgccgagaagatcgccaccatcaccaccacccacacccccagccagcagggcacccaggagaccagaaacaccaccaagcccaagcaggagagccagttcgagttcaaggccccccaggccacccaggagcaggacttctacaccgtggagctggagagaggcgccaagggcttcggcttcagcctgagaggcggcagagagtacaacatggacctgtacgtgctgagactggccgaggacggccccgccgagagatgcggcaagatgagaatcggcgacgagatcctggagatcaacggcgagaccaccaagaacatgaagcacagcagagccatcgagctgatcaagaacggcggcagaagagtgagactgttcctgaagagaggcgacggcagcgtgcccgagtacgccatgatcccccccaacatcgccgcctgcatgagaaacgagaagctgggcgaggcctgcttctacctgatgggccacaaccagaccaccacccccgccgccaccgccaccgcccccccccccgtgcacaaggtgttcagaaagtag

SEQ ID NO: 88544 - DNA, 4389 bp, Artificial Sequence
  Description of Artificial Sequence: Synthetic coding sequence
atgagcaaggtgatccagaagaagaaccactggaccagcagagtgcacgagtgcaccgtgaagagaggcccccagggcgagctgggcgtgaccgtgctgggcggcgccgagcacggcgagttcccctacgtgggcgccgtggccgccgtggaggccgccggcctgcccggcggcggcgagggccccagactgggcgagggcgagctgctgctggaggtgcagggcgtgagagtgagcggcctgcccagatacgacgtgctgggcgtgatcgacagctgcaaggaggccgtgaccttcaaggccgtgagacagggcggcagactgaacaaggacctgagacacttcctgaaccagagattccagaagggcagccccgaccacgagctgcagcagaccatcagagacaacctgtacagacacgccgtgccctgcaccaccagaagccccagagagggcgaggtgcccggcgtggactacaacttcctgaccgtgaaggagttcctggacctggagcagagcggcaccctgctggaggtgggcacctacgagggcaactactacggcacccccaagccccccagccagcccgtgagcggcaaggtgatcaccaccgacgccctgcacagcctgcagagcggcagcaagcagagcacccccaagagaaccaagagctacaacgacatgcagaacgccggcatcgtgcacgccgagaacgaggaggaggacgacgtgcccgagatgaacagcagcttcaccgccgacagcggcgagcaggaggagcacaccctgcaggagaccgccctgccccccgtgaacagcagcatcatcgccgcccccatcaccgaccccagccagaagttcccccagtacctgcccctgagcgccgaggacaacctgggccccctgcccgagaactgggagatggcctacaccgagaacggcgaggtgtacttcatcgaccacaacaccaagaccaccagctggctggaccccagatgcctgaacaagcagcagaagcccctggaggagtgcgaggacgacgagggcgtgcacaccgaggagctggacagcgagctggagctgcccgccggctgggagaagatcgaggaccccgtgtacggcatctactacgtggaccacatcaacagaaagacccagtacgagaaccccgtgctggaggccaagagaaagaagcagctggagcagcagcagcagcagcagcagcagcagcagcagcagcagcagcagcagcagcagcagcagaccgaggagtggaccgaggaccacagcgccctggtgccccccgtgatccccaaccacccccccagcaaccccgagcccgccagagaggtgcccctgcagggcaagcccttcttcaccagaaaccccagcgagctgaagggcaagttcatccacaccaagctgagaaagagcagcagaggcttcggcttcaccgtggtgggcggcgacgagcccgacgagttcctgcagatcaagagcctggtgctggacggccccgccgccctggacggcaagatggagaccggcgacgtgatcgtgagcgtgaacgacacctgcgtgctgggccacacccacgcccaggtggtgaagatcttccagagcatccccatcggcgccagcgtggacctggagctgtgcagaggctaccccctgcccttcgaccccgacgaccccaacaccagcctggtgaccagcgtggccatcctggacaaggagcccatcatcgtgaacggccaggagacctacgacagccccgccagccacagcagcaagaccggcaaggtgaacggcatgaaggacgccagacccagcagccccgccgacgtggccagcaacagcagccacggctaccccaacgacaccgtgagcctggccagcagcatcgccacccagcccgagctgatcaccgtgcacatcgtgaagggccccatgggcttcggcttcaccatcgccgacagccccggcggcggcggccagagagtgaagcagatcgtggacagccccagatgcagaggcctgaaggagggcgacctgatcgtggaggtgaacaagaagaacgtgcaggccctgacccacaaccaggtggtggacatgctggtggagtgccccaagggcagcgaggtgaccctgctggtgcagagaggcggcctgcccgtgcccaagaagagccccaagagccagcccctggagagaaaggacagccagaacagcagccagcacagcgtgagcagccacagaagcctgcacaccgccagccccagccacagcacccaggtgctgcccgagttcccccccgccgaggcccaggcccccgaccagaccgacagcagcggccagaagaagcccgaccccttcaagatctgggcccagagcagaagcatgtacgagaacagactgcccgactaccaggagcaggacatcttcctgtggagaaaggagaccggcttcggcttcagaatcctgggcggcaacgagcccggcgagcccatctacatcggccacatcgtgcccctgggcgccgccgacaccgacggcagactgagaagcggcgacgagctgatctgcgtggacggcacccccgtgatcggcaagagccaccagctggtggtgcagctgatgcagcaggccgccaagcagggccacgtgaacctgaccgtgagaagaaaggtggtgttcgccgtgcccaagaccgagaacgaggtgcccagccccgccagcagccaccacagcagcaaccagcccgccagcctgaccgaggagaagagaaccccccagggcagccagaacagcctgaacaccgtgagcagcggcagcggcagcaccagcggcatcggcagcggcggcggcggcggcagcggcgtggtgagcaccgtggtgcagccctacgacgtggagatcagaagaggcgagaacgagggcttcggcttcgtgatcgtgagcagcgtgagcagacccgaggccggcaccaccttcggcaacgcctgcgtggccatgccccacaagatcggcagaatcatcgagggcagccccgccgacagatgcggcaagctgaaggtgggcgacagaatcctggccgtgaacggctgcagcatcaccaacaagagccacagcgacatcgtgaacctgatcaaggaggccggcaacaccgtgaccctgagaatcatccccggcgacgagagcagcaacgccaccctgctgaccaacgccgagaagatcgccaccatcaccaccacccacacccccagccagcagggcacccaggagaccagaaacaccaccaagcccaagcaggagagccagttcgagttcaaggccccccaggccacccaggagcaggacttctacaccgtggagctggagagaggcgccaagggcttcggcttcagcctgagaggcggcagagagtacaacatggacctgtacgtgctgagactggccgaggacggccccgccgagagatgcggcaagatgagaatcggcgacgagatcctggagatcaacggcgagaccaccaagaacatgaagcacagcagagccatcgagctgatcaagaacggcggcagaagagtgagactgttcctgaagagaggcgacggcagcgtgcccgagtacgaccccagcagcgacagacacggccccgccaccggcccccagggcgtgcccgaggtgagagccggccccgacagaagacagcaccccagcctggagagcagctacccccccgacctgcacaagagcagcccccacggcgagaagagagcccacgccagagaccccaagggcagcagagagtacagcagacagcccaacgagcaccacacctggaacggcaccagcagaaagcccgacagcggcgcctgcagacccaaggacagagcccccgagggcagaagagacgcccaggccgagagagccgccgccgccaacggccccaagagaagaagccccgagaagagaagagagggcaccagaagcgccgacaacaccctggagagaagagagaagcacgagaagagaagagacgtgagccccgagagaagaagagagagaagccccaccagaagaagagacggcagccccagcagaagaagaagaagcctggagagactgctggagcagagaagaagccccgagagaagaagaggcggcagccccgagagaagagccaagagcaccgacagaagaagagccagaagccccgagagaagaagagagagaagcctggacaagagaaacagagaggacagagccagccacagagagagagaggaggccaacctgaagcaggacgccggcagaagcagcagacacccccccgagcagagaagaagaccctacaaggagtgcagcaccgacctgagcatctag

SEQ ID NO: 88545 - DNA, 3552 bp, Artificial Sequence
  Description of Artificial Sequence: Synthetic coding sequence
ggcggcagactgaacaaggacctgagacacttcctgaaccagagattccagaagggcagccccgaccacgagctgcagcagaccatcagagacaacctgtacagacacgccgtgccctgcaccaccagaagccccagagagggcgaggtgcccggcgtggactacaacttcctgaccgtgaaggagttcctggacctggagcagagcggcaccctgctggaggtgggcacctacgagggcaactactacggcacccccaagccccccagccagcccgtgagcggcaaggtgatcaccaccgacgccctgcacagcctgcagagcggcagcaagcagagcacccccaagagaaccaagagctacaacgacatgcagaacgccggcatcgtgcacgccgagaacgaggaggaggacgacgtgcccgagatgaacagcagcttcaccgccgacagcggcgagcaggaggagcacaccctgcaggagaccgccctgccccccgtgaacagcagcatcatcgccgcccccatcaccgaccccagccagaagttcccccagtacctgcccctgagcgccgaggacaacctgggccccctgcccgagaactgggagatggcctacaccgagaacggcgaggtgtacttcatcgaccacaacaccaagaccaccagctggctggaccccagatgcctgaacaagcagcagaagcccctggaggagtgcgaggacgacgagggcgtgcacaccgaggagctggacagcgagctggagctgcccgccggctgggagaagatcgaggaccccgtgtacggcatctactacgtggaccacatcaacagaaagacccagtacgagaaccccgtgctggaggccaagagaaagaagcagctggagcagcagcagcagcagcagcagcagcagcagcagcagcagcagcagcagcagcagcagcagaccgaggagtggaccgaggaccacagcgccctggtgccccccgtgatccccaaccacccccccagcaaccccgagcccgccagagaggtgcccctgcagggcaagcccttcttcaccagaaaccccagcgagctgaagggcaagttcatccacaccaagctgagaaagagcagcagaggcttcggcttcaccgtggtgggcggcgacgagcccgacgagttcctgcagatcaagagcctggtgctggacggccccgccgccctggacggcaagatggagaccggcgacgtgatcgtgagcgtgaacgacacctgcgtgctgggccacacccacgcccaggtggtgaagatcttccagagcatccccatcggcgccagcgtggacctggagctgtgcagaggctaccccctgcccttcgaccccgacgaccccaacaccagcctggtgaccagcgtggccatcctggacaaggagcccatcatcgtgaacggccaggagacctacgacagccccgccagccacagcagcaagaccggcaaggtgaacggcatgaaggacgccagacccagcagccccgccgacgtggccagcaacagcagccacggctaccccaacgacaccgtgagcctggccagcagcatcgccacccagcccgagctgatcaccgtgcacatcgtgaagggccccatgggcttcggcttcaccatcgccgacagccccggcggcggcggccagagagtgaagcagatcgtggacagccccagatgcagaggcctgaaggagggcgacctgatcgtggaggtgaacaagaagaacgtgcaggccctgacccacaaccaggtggtggacatgctggtggagtgccccaagggcagcgaggtgaccctgctggtgcagagaggcggcctgcccgtgcccaagaagagccccaagagccagcccctggagagaaaggacagccagaacagcagccagcacagcgtgagcagccacagaagcctgcacaccgccagccccagccacagcacccaggtgctgcccgagttcccccccgccgaggcccaggcccccgaccagaccgacagcagcggccagaagaagcccgaccccttcaagatctgggcccagagcagaagcatgtacgagaacagacccatgagccccagccccgccagcggcctgagcaagggcgagagagagagagagatcaacagcaccaacttcggcgagtgccccatccccgactaccaggagcaggacatcttcctgtggagaaaggagaccggcttcggcttcagaatcctgggcggcaacgagcccggcgagcccatctacatcggccacatcgtgcccctgggcgccgccgacaccgacggcagactgagaagcggcgacgagctgatctgcgtggacggcacccccgtgatcggcaagagccaccagctggtggtgcagctgatgcagcaggccgccaagcagggccacgtgaacctgaccgtgagaagaaaggtggtgttcgccgtgcccaagaccgagaacgaggtgcccagccccgccagcagccaccacagcagcaaccagcccgccagcctgaccgaggagaagagaaccccccagggcagccagaacagcctgaacaccgtgagcagcggcagcggcagcaccagcggcatcggcagcggcggcggcggcggcagcggcgtggtgagcaccgtggtgcagccctacgacgtggagatcagaagaggcgagaacgagggcttcggcttcgtgatcgtgagcagcgtgagcagacccgaggccggcaccaccttcggcaacgcctgcgtggccatgccccacaagatcggcagaatcatcgagggcagccccgccgacagatgcggcaagctgaaggtgggcgacagaatcctggccgtgaacggctgcagcatcaccaacaagagccacagcgacatcgtgaacctgatcaaggaggccggcaacaccgtgaccctgagaatcatccccggcgacgagagcagcaacgccaccctgctgaccaacgccgagaagatcgccaccatcaccaccacccacacccccagccagcagggcacccaggagaccagaaacaccaccaagcccaagcaggagagccagttcgagttcaaggccccccaggccacccaggagcaggacttctacaccgtggagctggagagaggcgccaagggcttcggcttcagcctgagaggcggcagagagtacaacatggacctgtacgtgctgagactggccgaggacggccccgccgagagatgcggcaagatgagaatcggcgacgagatcctggagatcaacggcgagaccaccaagaacatgaagcacagcagagccatcgagctgatcaagaacggcggcagaagagtgagactgttcctgaagagaggcgacggcagcgtgcccgagtacgccatgatcccccccaacatcgccgcctgcatgagaaacgagaagctgggcgaggcctgcttctacctgatgggccacaaccagaccaccacccccgccgccaccgccaccgcccccccccccgtgcacaaggtgttcagaaagtag

SEQ ID NO: 88546 - DNA, 3771 bp, Artificial Sequence
  Description of Artificial Sequence: Synthetic coding sequence
atgagcaaggtgatccagaagaagaaccactggaccagcagagtgcacgagtgcaccgtgaagagaggcccccagggcgagctgggcgtgaccgtgctgggcggcgccgagcacggcgagttcccctacgtgggcgccgtggccgccgtggaggccgccggcctgcccggcggcggcgagggccccagactgggcgagggcgagctgctgctggaggtgcagggcgtgagagtgagcggcctgcccagatacgacgtgctgggcgtgatcgacagctgcaaggaggccgtgaccttcaaggccgtgagacagggcggcagactgaacaaggacctgagacacttcctgaaccagagattccagaagggcagccccgaccacgagctgcagcagaccatcagagacaacctgtacagacacgccgtgccctgcaccaccagaagccccagagagggcgaggtgcccggcgtggactacaacttcctgaccgtgaaggagttcctggacctggagcagagcggcaccctgctggaggtgggcacctacgagggcaactactacggcacccccaagccccccagccagcccgtgagcggcaaggtgatcaccaccgacgccctgcacagcctgcagagcggcagcaagcagagcacccccaagagaaccaagagctacaacgacatgcagaacgccggcatcgtgcacgccgagaacgaggaggaggacgacgtgcccgagatgaacagcagcttcaccgccgacagcggcgagcaggaggagcacaccctgcaggagaccgccctgccccccgtgaacagcagcatcatcgccgcccccatcaccgaccccagccagaagttcccccagtacctgcccctgagcgccgaggacaacctgggccccctgcccgagaactgggagatggcctacaccgagaacggcgaggtgtacttcatcgaccacaacaccaagaccaccagctggctggaccccagatgcctgaacaagcagcagaagcccctggaggagtgcgaggacgacgagggcgtgcacaccgaggagctggacagcgagctggagctgcccgccggctgggagaagatcgaggaccccgtgtacggcatctactacgtggaccacatcaacagaaagacccagtacgagaaccccgtgctggaggccaagagaaagaagcagctggagcagcagcagcagcagcagcagcagcagcagcagcagcagcagcagcagcagcagcagcagaccgaggagtggaccgaggaccacagcgccctggtgccccccgtgatccccaaccacccccccagcaaccccgagcccgccagagaggtgcccctgcagggcaagcccttcttcaccagaaaccccagcgagctgaagggcaagttcatccacaccaagctgagaaagagcagcagaggcttcggcttcaccgtggtgggcggcgacgagcccgacgagttcctgcagatcaagagcctggtgctggacggccccgccgccctggacggcaagatggagaccggcgacgtgatcgtgagcgtgaacgacacctgcgtgctgggccacacccacgcccaggtggtgaagatcttccagagcatccccatcggcgccagcgtggacctggagctgtgcagaggctaccccctgcccttcgaccccgacgaccccaacaccagcctggtgaccagcgtggccatcctggacaaggagcccatcatcgtgaacggccaggagacctacgacagccccgccagccacagcagcaagaccggcaaggtgaacggcatgaaggacgccagacccagcagccccgccgacgtggccagcaacagcagccacggctaccccaacgacaccgtgagcctggccagcagcatcgccacccagcccgagctgatcaccgtgcacatcgtgaagggccccatgggcttcggcttcaccatcgccgacagccccggcggcggcggccagagagtgaagcagatcgtggacagccccagatgcagaggcctgaaggagggcgacctgatcgtggaggtgaacaagaagaacgtgcaggccctgacccacaaccaggtggtggacatgctggtggagtgccccaagggcagcgaggtgaccctgctggtgcagagaggcggcctgcccgtgcccaagaagagccccaagagccagcccctggagagaaaggacagccagaacagcagccagcacagcgtgagcagccacagaagcctgcacaccgccagccccagccacagcacccaggtgctgcccgagttcccccccgccgaggcccaggcccccgaccagaccgacagcagcggccagaagaagcccgaccccttcaagatctgggcccagagcagaagcatgtacgagaacagacccatgagccccagccccgccagcggcctgagcaagggcgagagagagagagagatcaacagcaccaacttcggcgagtgccccatccccgactaccaggagcaggacatcttcctgtggagaaaggagaccggcttcggcttcagaatcctgggcggcaacgagcccggcgagcccatctacatcggccacatcgtgcccctgggcgccgccgacaccgacggcagactgagaagcggcgacgagctgatctgcgtggacggcacccccgtgatcggcaagagccaccagctggtggtgcagctgatgcagcaggccgccaagcagggccacgtgaacctgaccgtgagaagaaaggtggtgttcgccgtgcccaagaccgagaacgaggtgcccagccccgccagcagccaccacagcagcaaccagcccgccagcctgaccgaggagaagagaaccccccagggcagccagaacagcctgaacaccgtgagcagcggcagcggcagcaccagcggcatcggcagcggcggcggcggcggcagcggcgtggtgagcaccgtggtgcagccctacgacgtggagatcagaagaggcgagaacgagggcttcggcttcgtgatcgtgagcagcgtgagcagacccgaggccggcaccaccttcgccggcaacgcctgcgtggccatgccccacaagatcggcagaatcatcgagggcagccccgccgacagatgcggcaagctgaaggtgggcgacagaatcctggccgtgaacggctgcagcatcaccaacaagagccacagcgacatcgtgaacctgatcaaggaggccggcaacaccgtgaccctgagaatcatccccggcgacgagagcagcaacgccaccctgctgaccaacgccgagaagatcgccaccatcaccaccacccacacccccagccagcagggcacccaggagaccagaaacaccaccaagcccaagcaggagagccagttcgagttcaaggccccccaggccacccaggagcaggacttctacaccgtggagctggagagaggcgccaagggcttcggcttcagcctgagaggcggcagagagtacaacatggacctgtacgtgctgagactggccgaggacggccccgccgagagatgcggcaagatgagaatcggcgacgagatcctggagatcaacggcgagaccaccaagaacatgaagcacagcagagccatcgagctgatcaagaacggcggcagaagagtgagactgttcctgaagagaggcgacggcagcgtgcccgagtacggcggcagcaactacgagaacatccccagcttccccggcatgaccccctag

SEQ ID NO: 88547 - DNA, 1488 bp, Artificial Sequence
  Description of Artificial Sequence: Synthetic coding sequence
atggccgccgagccccagcccagcagcctgagctacagaaccaccggcagcacctacctgcaccccctgagcgagctgctgggcatccccctggaccaggtgaacttcgtggtgtgccagctggtggccctgttcgccgccttctggttcagaatctacctgagacccggcaccaccagcagcgacgtgagacacgccgtggccaccatcttcggcatctacttcgtgatcttctgcttcggctggtacagcgtgcacctgttcgtgctggtgctgatgtgctacgccatcatggtgaccgccagcgtgagcaacatccacagatacagcttcttcgtggccatgggctacctgaccatctgccacatcagcagaatctacatcttccactacggcatcctgaccaccgacttcagcggccccctgatgatcgtgacccagaagatcaccaccctggccttccaggtgcacgacggcctgggcagaagagccgaggacctgagcgccgagcagcacagactggccatcaaggtgaagcccagcttcctggagtacctgagctacctgctgaacttcatgagcgtgatcgccggcccctgcaacaacttcaaggactacatcgccttcatcgagggcaagcacatccacatgaagctgctggaggtgaactggaagagaaagggcttccacagcctgcccgagcccagccccaccggcgccgtgatccacaagctgggcatcaccctggtgagcctgctgctgttcctgaccctgaccaagaccttccccgtgacctgcctggtggacgactggttcgtgcacaaggccagcttccccgccagactgtgctacctgtacgtggtgatgcaggccagcaagcccaagtactacttcgcctggaccctggccgacgccgtgaacaacgccgccggcttcggcttcagcggcgtggacaagaacggcaacttctgctgggacctgctgagcaacctgaacatctggaagatcgagaccgccaccagcttcaagatgtacctggagaactggaacatccagaccgccacctggctgaagtgcgtgtgctaccagagagtgccctggtaccccaccgtgctgaccttcatcctgagcgccctgtggcacggcgtgtaccccggctactacttcaccttcctgaccggcatcctggtgaccctggccgccagagccgtgagaaacaactacagacactacttcctgagcagcagagccctgaaggccgtgtacgacgccggcacctgggccgtgacccagctggccgtgagctacaccgtggcccccttcgtgatgctggccgtggagcccaccatcagcctgtacaagagcatgtacttctacctgcacatcatcagcctgctgatcatcctgttcctgcccatgaagccccaggcccacacccagagaagaccccagaccctgaacagcatcaacaagagaaagaccgactag

SEQ ID NO: 88548 - DNA, 726 bp, Artificial Sequence
  Description of Artificial Sequence: Synthetic coding sequence
atggccgccgagccccagcccagcagcctgagctacagaaccaccggcagcacctacctgcaccccctgagcgagctgctgggcatccccctggaccaggtgaacttcgtggtgtgccagctggtggccctgttcgccgccttctggttcagaatctacctgagacccggcaccaccagcagcgacgtgagacacgccgtggccaccatcttcggcatctacttcgtgatcttctgcttcggctggtacagcgtgcacctgttcgtgctggtgctgatgtgctacgccatcatggtgaccgccagcgtgagcaacatccacagatacagcttcttcgtggccatgggctacctgaccatctgccacatcagcagaatctacatcttccactacggcatcctgaccaccgacttcagcggccccctgatgatcgtgacccagaagatcaccaccctggccttccaggtgcacgacggcctgggcagaagagccgaggacctgagcgccgagcagcacagactggccatcaaggtgaagcccagcttcctggagtacctgagctacctgctgaacttcatgagcgtgatcgccggcccctgcaacaacttcaaggactacatcgccttcatcgagggcaagcacatccacatgaagctgctggaggtgaactggaagagaaagggcttccacagcctgcccgagcccagccccaccggccacctgtag

SEQ ID NO: 88549 - DNA, 1041 bp, Artificial Sequence
  Description of Artificial Sequence: Synthetic coding sequence
atggagttcagcctgagaatcttcctgggcctgggcagaagagccgaggacctgagcgccgagcagcacagactggccatcaaggtgaagcccagcttcctggagtacctgagctacctgctgaacttcatgagcgtgatcgccggcccctgcaacaacttcaaggactacatcgccttcatcgagggcaagcacatccacatgaagctgctggaggtgaactggaagagaaagggcttccacagcctgcccgagcccagccccaccggcgccgtgatccacaagctgggcatcaccctggtgagcctgctgctgttcctgaccctgaccaagaccttccccgtgacctgcctggtggacgactggttcgtgcacaaggccagcttccccgccagactgtgctacctgtacgtggtgatgcaggccagcaagcccaagtactacttcgcctggaccctggccgacgccgtgaacaacgccgccggcttcggcttcagcggcgtggacaagaacggcaacttctgctgggacctgctgagcaacctgaacatctggaagatcgagaccgccaccagcttcaagatgtacctggagaactggaacatccagaccgccacctggctgaagtgcgtgtgctaccagagagtgccctggtaccccaccgtgctgaccttcatcctgagcgccctgtggcacggcgtgtaccccggctactacttcaccttcctgaccggcatcctggtgaccctggccgccagagccgtgagaaacaactacagacactacttcctgagcagcagagccctgaaggccgtgtacgacgccggcacctgggccgtgacccagctggccgtgagctacaccgtggcccccttcgtgatgctggccgtggagcccaccatcagcctgtacaagagcatgtacttctacctgcacatcatcagcctgctgatcatcctgttcctgcccatgaagccccaggcccacacccagagaagaccccagaccctgaacagcatcaacaagagaaagaccgactag

SEQ ID NO: 88550 - DNA, 1563 bp, Artificial Sequence
  Description of Artificial Sequence: Synthetic coding sequence
atggccaccaccagcaccaccggcagcaccctgctgcagcccctgagcaacgccgtgcagctgcccatcgaccaggtgaacttcgtggtgtgccagctgttcgccctgctggccgccatctggttcagaacctacctgcacagcagcaagaccagcagcttcatcagacacgtggtggccaccctgctgggcctgtacctggccctgttctgcttcggctggtacgccctgcacttcctggtgcagagcggcatcagctactgcatcatgatcatcatcggcgtggagaacatgcacaactactgcttcgtgttcgccctgggctacctgaccgtgtgccaggtgaccagagtgtacatcttcgactacggccagtacagcgccgacttcagcggccccatgatgatcatcacccagaagatcaccagcctggcctgcgagatccacgacggcatgttcagaaaggacgaggagctgaccagcagccagagagacctggccgtgagaagaatgcccagcctgctggagtacctgagctacaactgcaacttcatgggcatcctggccggccccctgtgcagctacaaggactacatcaccttcatcgagggcagaagctaccacatcacccagagcggcgagaacggcaaggaggagacccagtacgagagaaccgagcccagccccaacaccgccgtggtgcagaagctgctggtgtgcggcctgagcctgctgttccacctgaccatctgcaccaccctgcccgtggagtacaacatcgacgagcacttccaggccaccgccagctggcccaccaagatcatctacctgtacatcagcctgctggccgccagacccaagtactacttcgcctggaccctggccgacgccatcaacaacgccgccggcttcggcttcagaggctacgacgagaacggcgccgccagatgggacctgatcagcaacctgagaatccagcagatcgagatgagcaccagcttcaagatgttcctggacaactggaacatccagaccgccctgtggctgaagagagtgtgctacgagagaaccagcttcagccccaccatccagaccttcatcctgagcgccatctggcacggcgtgtaccccggctactacctgaccttcctgaccggcgtgctgatgaccctggccgccagagccatgagaaacaacttcagacactacttcatcgagcccagccagctgaagctgttctacgacgtgatcacctggatcgtgacccaggtggccatcagctacaccgtggtgcccttcgtgctgctgagcatcaagcccagcctgaccttctacagcagctggtactactgcctgcacatcctgggcatcctggtgctgctgctgctgcccgtgaagaagacccagagaagaaagaacacccacgagaacatccagctgagccagagcaagaagttcgacgagggcgagaacagcctgggccagaacagcttcagcaccaccaacaacgtgtgcaaccagaaccaggagatcgccagcagacacagcagcctgaagcagtag

SEQ ID NO: 88551 - DNA, 1308 bp, Artificial Sequence
  Description of Artificial Sequence: Synthetic coding sequence
atggagtggctgtggctgttcttcctgcaccccatcagcttctaccagggcgccgccttccccttcgccctgctgttcaactacctgtgcatcatggacagcttcagcaccagagccagatacctgttcctgctgaccggcggcggcgccctggccgtggccgccatgggcagctacgccgtgctggtgttcacccccgccgtgtgcgccgtggccctgctgtgcagcctggccccccagcaggtgcacagatggaccttctgcttccagatgagctggcagaccctgtgccacctgggcctgcactacaccgagtactacctgcacgagccccccagcgtgagattctgcatcaccctgagcagcctgatgctgctgacccagagagtgaccagcctgagcctggacatctgcgagggcaaggtgaaggccgccagcggcggcttcagaagcagaagcagcctgagcgagcacgtgtgcaaggccctgccctacttcagctacctgctgttcttccccgccctgctgggcggcagcctgtgcagcttccagagattccaggccagagtgcagggcagcagcgccctgcaccccagacacagcttctgggccctgagctggagaggcctgcagatcctgggcctggagtgcctgaacgtggccgtgagcagagtggtggacgccggcgccggcctgaccgactgccagcagttcgagtgcatctacgtggtgtggaccaccgccggcctgttcaagctgacctactacagccactggatcctggacgacagcctgctgcacgccgccggcttcggccccgagctgggccagagccccggcgaggagggctacgtgcccgacgccgacatctggaccctggagagaacccacagaatcagcgtgttcagcagaaagtggaaccagagcaccgccagatggctgagaagactggtgttccagcacagcagagcctggcccctgctgcagaccttcgccttcagcgcctggtggcacggcctgcaccccggccaggtgttcggcttcgtgtgctgggccgtgatggtggaggccgactacctgatccacagcttcgccaacgagttcatcagaagctggcccatgagactgttctacagaaccctgacctgggcccacacccagctgatcatcgcctacatcatgctggccgtggaggtgagaagcctgagcagcctgtggctgctgtgcaacagctacaacagcgtgttccccatggtgtactgcatcctgctgctgctgctggccaagagaaagcacaagtgcaactag

SEQ ID NO: 88552 - DNA, 1341 bp, Artificial Sequence
  Description of Artificial Sequence: Synthetic coding sequence
atgaccctgaaggccagcgagggcgagagcggcggcagcatgcacaccgccctgagcgacctgtacctggagcacctgctgcagaagagaagcagacccgaggccgtgagccaccccctgaacaccgtgaccgaggacatgtacaccaacggcagccccgcccccggcagccccgcccaggtgaagggccaggaggtgagaaaggtgagactgatccagttcgagaaggtgaccgaggagcccatgggcatcaccctgaagctgaacgagaagcagagctgcaccgtggccagaatcctgcacggcggcatgatccacagacagggcagcctgcacgtgggcgacgagatcctggagatcaacggcaccaacgtgaccaaccacagcgtggaccagctgcagaaggccatgaaggagaccaagggcatgatcagcctgaaggtgatccccaaccagcagagcagactgcccgccctgcaggaggccggcctgaagttcgccaccggcgacatcatccagatcatcaacaaggacgacagcaactggtggcagggcagagtggagggcagcagcaaggagagcgccggcctgatccccagccccgagctgcaggagtggagagtggccagcatggcccagagcgcccccagcgaggcccccagctgcagccccttcggcaagaagaagaagtacaaggacaagtacctggccaagcacagcagcatcttcgaccagctggacgtggtgagctacgaggaggtggtgagactgcccgccttcaagagaaagaccctggtgctgatcggcgccagcggcgtgggcagaagccacatcaagaacgccctgctgagccagaaccccgagaagttcgtgtaccccgtgccctacaccaccagaccccccagaaagagcgaggaggacggcaaggagtaccacttcatcagcaccgaggagatgaccagaaacatcagcgccaacgagttcctggagttcggcagctaccagggcaacatgttcggcaccaagttcgagaccgtgcaccagatccacaagcagaacaagatcgccatcctggacatcgagccccagaccctgaagatcgtgagaaccgccgagctgagccccttcatcgtgttcatcgcccccaccgaccagggcacccagaccgaggccctgcagcagctgcagaaggacagcgaggccatcagaagccagtacgcccactacttcgacctgagcctggtgaacaacggcgtggacgagaccctgaagaagctgcaggaggccttcgaccaggcctgcagcagcccccagtgggtgcccgtgagctgggtgtactag

SEQ ID NO: 88553 - DNA, 1401 bp, Artificial Sequence
  Description of Artificial Sequence: Synthetic coding sequence
atgaccctgaaggccagcgagggcgagagcggcggcagcatgcacaccgccctgagcgacctgtacctggagcacctgctgcagaagagaagcagacccgaggccgtgagccaccccctgaacaccgtgaccgaggacatgtacaccaacggcagccccgcccccggcagccccgcccaggtgaagggccaggaggtgagaaaggtgagactgatccagttcgagaaggtgaccgaggagcccatgggcatcaccctgaagctgaacgagaagcagagctgcaccgtggccagaatcctgcacggcggcatgatccacagacagggcagcctgcacgtgggcgacgagatcctggagatcaacggcaccaacgtgaccaaccacagcgtggaccagctgcagaaggccatgaaggagaccaagggcatgatcagcctgaaggtgatccccaaccagcagagcagactgcccgccctgcagatgttcatgagagcccagttcgactacgaccccaagaaggacaacctgatcccctgcaaggaggccggcctgaagttcgccaccggcgacatcatccagatcatcaacaaggacgacagcaactggtggcagggcagagtggagggcagcagcaaggagagcgccggcctgatccccagccccgagctgcaggagtggagagtggccagcatggcccagagcgcccccagcgaggcccccagctgcagccccttcggcaagaagaagaagtacaaggacaagtacctggccaagcacagcagcatcttcgaccagctggacgtggtgagctacgaggaggtggtgagactgcccgccttcaagagaaagaccctggtgctgatcggcgccagcggcgtgggcagaagccacatcaagaacgccctgctgagccagaaccccgagaagttcgtgtaccccgtgccctacaccaccagaccccccagaaagagcgaggaggacggcaaggagtaccacttcatcagcaccgaggagatgaccagaaacatcagcgccaacgagttcctggagttcggcagctaccagggcaacatgttcggcaccaagttcgagaccgtgcaccagatccacaagcagaacaagatcgccatcctggacatcgagccccagaccctgaagatcgtgagaaccgccgagctgagccccttcatcgtgttcatcgcccccaccgaccagggcacccagaccgaggccctgcagcagctgcagaaggacagcgaggccatcagaagccagtacgcccactacttcgacctgagcctggtgaacaacggcgtggacgagaccctgaagaagctgcaggaggccttcgaccaggcctgcagcagcccccagtgggtgcccgtgagctgggtgtactag

SEQ ID NO: 88554 - DNA, 1311 bp, Artificial Sequence
  Description of Artificial Sequence: Synthetic coding sequence
atggagagctgggccgtgagccaccccctgaacaccgtgaccgaggacatgtacaccaacggcagccccgcccccggcagccccgcccaggtgaagggccaggaggtgagaaaggtgagactgatccagttcgagaaggtgaccgaggagcccatgggcatcaccctgaagctgaacgagaagcagagctgcaccgtggccagaatcctgcacggcggcatgatccacagacagggcagcctgcacgtgggcgacgagatcctggagatcaacggcaccaacgtgaccaaccacagcgtggaccagctgcagaaggccatgaaggagaccaagggcatgatcagcctgaaggtgatccccaaccagcagagcagactgcccgccctgcagatgttcatgagagcccagttcgactacgaccccaagaaggacaacctgatcccctgcaaggaggccggcctgaagttcgccaccggcgacatcatccagatcatcaacaaggacgacagcaactggtggcagggcagagtggagggcagcagcaaggagagcgccggcctgatccccagccccgagctgcaggagtggagagtggccagcatggcccagagcgcccccagcgaggcccccagctgcagccccttcggcaagaagaagaagtacaaggacaagtacctggccaagcacagcagcatcttcgaccagctggacgtggtgagctacgaggaggtggtgagactgcccgccttcaagagaaagaccctggtgctgatcggcgccagcggcgtgggcagaagccacatcaagaacgccctgctgagccagaaccccgagaagttcgtgtaccccgtgccctacaccaccagaccccccagaaagagcgaggaggacggcaaggagtaccacttcatcagcaccgaggagatgaccagaaacatcagcgccaacgagttcctggagttcggcagctaccagggcaacatgttcggcaccaagttcgagaccgtgcaccagatccacaagcagaacaagatcgccatcctggacatcgagccccagaccctgaagatcgtgagaaccgccgagctgagccccttcatcgtgttcatcgcccccaccgaccagggcacccagaccgaggccctgcagcagctgcagaaggacagcgaggccatcagaagccagtacgcccactacttcgacctgagcctggtgaacaacggcgtggacgagaccctgaagaagctgcaggaggccttcgaccaggcctgcagcagcccccagtgggtgcccgtgagctgggtgtactag

SEQ ID NO: 88555 - DNA, 1659 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctggacctgatcttcctgagaggcatcatggagagccccatcgtgagaagcctggccaaggcccacgagagactggaggagaccaagctggaggccgtgagagacaacaacctggagctggtgcaggagatcctgagagacctggcccacgtggccgagcagagcagcaccgccgccgagctggcccacatcctgcaggagccccacttccagagcctgctggagacccacgacagcgtggccagcaagacctacgagacccccccccccagccccggcctggaccccaccttcagcaaccagcccgtgccccccgacgccgtgagaatggtgggcatcagaaagaccgccggcgagcacctgggcgtgaccttcagagtggagggcggcgagctggtgatcgccagaatcctgcacggcggcatggtggcccagcagggcctgctgcacgtgggcgacatcatcaaggaggtgaacggccagcccgtgggcagcgaccccagagccctgcaggagctgctgagaaacgccagcggcagcgtgatcctgaagatcctgcccagctaccaggagccccacctgcccagacaggtgttcgtgaagtgccacttcgactacgaccccgccagagacagcctgatcccctgcaaggaggccggcctgagattcaacgccggcgacctgctgcagatcgtgaaccaggacgacgccaactggtggcaggcctgccacgtggagggcggcagcgccggcctgatccccagccagctgctggaggagaagagaaaggccttcgtgaagagagacctggagctgacccccaacagcggcaccctgtgcggcagcctgagcggcaagaagaagaagagaatgatgtacctgaccaccaagaacgccgagttcgacagacacgagctgctgatctacgaggaggtggccagaatgccccccttcagaagaaagaccctggtgctgatcggcgcccagggcgtgggcagaagaagcctgaagaacaagctgatcatgtgggaccccgacagatacggcaccaccgtgccctacaccagcagaagacccaaggacagcgagagagagggccagggctacagcttcgtgagcagaggcgagatggaggccgacgtgagagccggcagatacctggagcacggcgagtacgagggcaacctgtacggcaccagaatcgacagcatcagaggcgtggtggccgccggcaaggtgtgcgtgctggacgtgaacccccaggccgtgaaggtgctgagaaccgccgagttcgtgccctacgtggtgttcatcgaggcccccgacttcgagaccctgagagccatgaacagagccgccctggagagcggcatcagcaccaagcagctgaccgaggccgacctgagaagaaccgtggaggagagcagcagaatccagagaggctacggccactacttcgacctgtgcctggtgaacagcaacctggagagaaccttcagagagctgcagaccgccatggagaagctgagaaccgagccccagtgggtgcccgtgagctgggtgtactag

SEQ ID NO: 88556 - DNA, 1731 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctggacctgatcttcctgagaggcatcatggagagccccatcgtgagaagcctggccaaggtgatcatggtgctgtggttcatgcagcagaacgtgttcgtgcccatgaagtacatgctgaagtacttcggcgcccacgagagactggaggagaccaagctggaggccgtgagagacaacaacctggagctggtgcaggagatcctgagagacctggcccacgtggccgagcagagcagcaccgccgccgagctggcccacatcctgcaggagccccacttccagagcctgctggagacccacgacagcgtggccagcaagacctacgagacccccccccccagccccggcctggaccccaccttcagcaaccagcccgtgccccccgacgccgtgagaatggtgggcatcagaaagaccgccggcgagcacctgggcgtgaccttcagagtggagggcggcgagctggtgatcgccagaatcctgcacggcggcatggtggcccagcagggcctgctgcacgtgggcgacatcatcaaggaggtgaacggccagcccgtgggcagcgaccccagagccctgcaggagctgctgagaaacgccagcggcagcgtgatcctgaagatcctgcccagctaccaggagccccacctgcccagacaggtgttcgtgaagtgccacttcgactacgaccccgccagagacagcctgatcccctgcaaggaggccggcctgagattcaacgccggcgacctgctgcagatcgtgaaccaggacgacgccaactggtggcaggcctgccacgtggagggcggcagcgccggcctgatccccagccagctgctggaggagaagagaaaggccttcgtgaagagagacctggagctgacccccaacagcggcaccctgtgcggcagcctgagcggcaagaagaagaagagaatgatgtacctgaccaccaagaacgccgagttcgacagacacgagctgctgatctacgaggaggtggccagaatgccccccttcagaagaaagaccctggtgctgatcggcgcccagggcgtgggcagaagaagcctgaagaacaagctgatcatgtgggaccccgacagatacggcaccaccgtgccctacaccagcagaagacccaaggacagcgagagagagggccagggctacagcttcgtgagcagaggcgagatggaggccgacgtgagagccggcagatacctggagcacggcgagtacgagggcaacctgtacggcaccagaatcgacagcatcagaggcgtggtggccgccggcaaggtgtgcgtgctggacgtgaacccccaggccgtgaaggtgctgagaaccgccgagttcgtgccctacgtggtgttcatcgaggcccccgacttcgagaccctgagagccatgaacagagccgccctggagagcggcatcagcaccaagcagctgaccgaggccgacctgagaagaaccgtggaggagagcagcagaatccagagaggctacggccactacttcgacctgtgcctggtgaacagcaacctggagagaaccttcagagagctgcagaccgccatggagaagctgagaaccgagccccagtgggtgcccgtgagctgggtgtactag

SEQ ID NO: 88557 - DNA, 96 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctgtag

SEQ ID NO: 88558 - DNA, 456 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctggacctgatcttcctgagaggcatcatggagagccccatcgtgagaagcctggccaaggcccacgagagactggaggagaccaagctggaggccgtgagagacaacaacctggagctggtgcaggagatcctgagagacctggcccacgtggccgagcagagcagcaccgccgccgagctggcccacatcctgcaggagccccacttccagagcctgctggagacccacgacagcgtggccagcaagacctacgagacccccccccccagccccggcctggaccccaccttcagcaaccagcccgtgccccccgacgccgtgagaatggtgggcatcagaaagaccgccggcgagcacctgtag

SEQ ID NO: 88559 - DNA, 381 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctggacctgatcttcctgagaggcatcatggagagccccatcgtgagaagcctggccaaggcccacgagagactggaggagaccaagctggaggccgtgagagacaacaacctggagctggtgcaggagatcctgagagacctggcccacgtggccgagcagagcagcaccgccgccgagctggcccacatcctgcaggagccccacttccagagcctgctggagacccacgacagcgtggccagcaagacctacgagacccccccccccagccccggcctggacccctag

SEQ ID NO: 88560 - DNA, 222 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctggacctgatcttcctgagaggcatcatggagagccccatcgtgagaagcctggccaaggcccacgagagactggaggagaccaagctggaggccgtgagagacaacaacctggagctggtgcaggagtag

SEQ ID NO: 88561 - DNA, 447 bp, Artificial Sequence
  Description of Artificial Sequence: Synthetic coding sequence
atgcccgtggccgccaccaacagcgagaccgccatgcagcaggtgctggacaacctgggcagcctgcccagcgccaccggcgccgccgagctggacctgatcttcctgagaggcatcatggagagccccatcgtgagaagcctggccaaggcccacgagagactggaggagaccaagctggaggccgtgagagacaacaacctggagctggtgcaggagatcctgagagacctggcccacgtggccgagcagagcagcaccgccgccgagctggcccacatcctgcaggagccccacttccagagcctgctggagacccacgacagcgtggccagcaagacctacgagacccccccccccagccccggcctggaccccaccttcagcaaccagcccgtgccccccgacgccgtgagaatggtgggcatcagaaagaccgccggctag

SEQ ID NO: 88562 - DNA, 1626 bp, Artificial Sequence
  Description of Artificial Sequence: Synthetic coding sequence
atgcagcaggtgctggacaacctgggcagcctgcccagcgccaccggcgccgccgagctggacctgatcttcctgagaggcatcatggagagccccatcgtgagaagcctggccaaggcccacgagagactggaggagaccaagctggaggccgtgagagacaacaacctggagctggtgcaggagatcctgagagacctggcccacgtggccgagcagagcagcaccgccgccgagctggcccacatcctgcaggagccccacttccagagcctgctggagacccacgacagcgtggccagcaagacctacgagacccccccccccagccccggcctggaccccaccttcagcaaccagcccgtgccccccgacgccgtgagaatggtgggcatcagaaagaccgccggcgagcacctgggcgtgaccttcagagtggagggcggcgagctggtgatcgccagaatcctgcacggcggcatggtggcccagcagggcctgctgcacgtgggcgacatcatcaaggaggtgaacggccagcccgtgggcagcgaccccagagccctgcaggagctgctgagaaacgccagcggcagcgtgatcctgaagatcctgcccagctaccaggagccccacctgcccagacaggtgttcgtgaagtgccacttcgactacgaccccgccagagacagcctgatcccctgcaaggaggccggcctgagattcaacgccggcgacctgctgcagatcgtgaaccaggacgacgccaactggtggcaggcctgccacgtggagggcggcagcgccggcctgatccccagccagctgctggaggagaagagaaaggccttcgtgaagagagacctggagctgacccccaacagcggcaccctgtgcggcagcctgagcggcaagaagaagaagagaatgatgtacctgaccaccaagaacgccgagttcgacagacacgagctgctgatctacgaggaggtggccagaatgccccccttcagaagaaagaccctggtgctgatcggcgcccagggcgtgggcagaagaagcctgaagaacaagctgatcatgtgggaccccgacagatacggcaccaccgtgccctacaccagcagaagacccaaggacagcgagagagagggccagggctacagcttcgtgagcagaggcgagatggaggccgacgtgagagccggcagatacctggagcacggcgagtacgagggcaacctgtacggcaccagaatcgacagcatcagaggcgtggtggccgccggcaaggtgtgcgtgctggacgtgaacccccaggccgtgaaggtgctgagaaccgccgagttcgtgccctacgtggtgttcatcgaggcccccgacttcgagaccctgagagccatgaacagagccgccctggagagcggcatcagcaccaagcagctgaccgaggccgacctgagaagaaccgtggaggagagcagcagaatccagagaggctacggccactacttcgacctgtgcctggtgaacagcaacctggagagaaccttcagagagctgcagaccgccatggagaagctgagaaccgagccccagtgggtgcccgtgagctgggtgtactag

SEQ ID NO: 88563 - DNA, 1167 bp, Artificial Sequence
  Description of Artificial Sequence: Synthetic coding sequence
atggagctgcagtaccccccccccccccccagccccagaatctgcagagagagaagcggcggcgacaacgccagcatgcccgtgctgagcgaggacagcggcctgcacgagaccctggccctgctgaccagccagctgagacccgacagcaaccacaaggaggagatgggcttcctgagagacgtgttcagcgagaagagcctgagctacctgatgaagatccacgagaagctgagatactacgagagacagagccccacccccgtgctgcacagcgccgtggccctggccgaggacgtgatggaggagctgcaggccgccagcgtgcacagcgacgagagagagctgctgcagctgctgagcaccccccacctgagagccgtgctgatggtgcacgacaccgtggcccagaagaacttcgaccccgtgctgccccccctgcccgacaacatcgacgaggacttcgacgaggagagcgtgaagatcgtgagactggtgaagaacaaggagcccctgggcgccaccatcagaagagacgagcacagcggcgccgtggtggtggccagaatcatgagaggcggcgccgccgacagaagcggcctggtgcacgtgggcgacgagctgagagaggtgaacggcatcgccgtgctgcacaagagacccgacgagatcagccagatcctggcccagagccagggcagcatcaccctgaagatcatccccgccacccaggaggaggacagactgaaggagagcaaggtgttcatgagagccctgttccactacaaccccagagaggacagagccatcccctgccaggaggccggcctgcccttccagagaagacaggtgctggaggtggtgagccaggacgaccccacctggtggcaggccaagagagtgggcgacaccaacctgagagccggcctgatccccagcaagggcttccaggagagaagactgagctacagaagagcctacggcacccccatcagcccccagttcagccagcccaagcaggagctgagcctgcccagacactgggcccccacccagctgctgcccagctgcggcgcccactgccccggcggcaagggcacccacacccccaccctgatccccatcctgctgagccccagcctgcagctggagttcatccagtactag

SEQ ID NO: 88564 - DNA, 1758 bp, Artificial Sequence
  Description of Artificial Sequence: Synthetic coding sequence
atgcccgtgctgagcgaggacagcggcctgcacgagaccctggccctgctgaccagccagctgagacccgacagcaaccacaaggaggagatgggcttcctgagagacgtgttcagcgagaagagcctgagctacctgatgaagatccacgagaagctgagatactacgagagacagagccccacccccgtgctgcacagcgccgtggccctggccgaggacgtgatggaggagctgcaggccgccagcgtgcacagcgacgagagagagctgctgcagctgctgagcaccccccacctgagagccgtgctgatggtgcacgacaccgtggcccagaagaacttcgaccccgtgctgccccccctgcccgacaacatcgacgaggacttcgacgaggagagcgtgaagatcgtgagactggtgaagaacaaggagcccctgggcgccaccatcagaagagacgagcacagcggcgccgtggtggtggccagaatcatgagaggcggcgccgccgacagaagcggcctggtgcacgtgggcgacgagctgagagaggtgaacggcatcgccgtgctgcacaagagacccgacgagatcagccagatcctggcccagagccagggcagcatcaccctgaagatcatccccgccacccaggaggaggacagactgaaggagagcaaggtgttcatgagagccctgttccactacaaccccagagaggacagagccatcccctgccaggaggccggcctgcccttccagagaagacaggtgctggaggtggtgagccaggacgaccccacctggtggcaggccaagagagtgggcgacaccaacctgagagccggcctgatccccagcaagggcttccaggagagaagactgagctacagaagagccgccggcaccctgcccagcccccagagcctgagaaagcccccctacgaccagccctgcgacaaggagacctgcgactgcgagggctacctgaagggccactacgtggccggcctgagaagaagcttcagactgggctgcagagagagactgggcggcagccaggagggcaagatgagcagcggcgccgagagccccgagctgctgacctacgaggaggtggccagataccagcaccagcccggcgagagacccagactggtggtgctgatcggcagcctgggcgccagactgcacgagctgaagcagaaggtggtggccgagaacccccagcacttcggcgtggccgtgccccacaccaccagacccagaaagagccacgagaaggagggcgtggagtaccacttcgtgagcaagcaggccttcgaggccgacctgcaccacaacaagttcctggagcacggcgagtacaaggagaacctgtacggcaccagcctggaggccatccaggccgtgatggccaagaacaaggtgtgcctggtggacgtggagcccgaggccctgaagcagctgagaaccagcgagttcaagccctacatcatcttcgtgaagcccgccatccaggagaagagaaagaccccccccatgagccccgcctgcgaggacaccgccgcccccttcgacgagcagcagcaggagatggccgccagcgccgccttcatcgacagacactacggccacctggtggacgccgtgctggtgaaggaggacctgcagggcgcctacagccagctgaaggtggtgctggagaagctgagcaaggacacccactgggtgcccgtgagctgggtgagatag

SEQ ID NO: 88565 - DNA, 1833 bp, Artificial Sequence
  Description of Artificial Sequence: Synthetic coding sequence
atggagctgcagtaccccccccccccccccagccccagaatctgcagagagagaagcggcggcgacaacgccagcatgcccgtgctgagcgaggacagcggcctgcacgagaccctggccctgctgaccagccagctgagacccgacagcaaccacaaggaggagatgggcttcctgagagacgtgttcagcgagaagagcctgagctacctgatgaagatccacgagaagctgagatactacgagagacagagccccacccccgtgctgcacagcgccgtggccctggccgaggacgtgatggaggagctgcaggccgccagcgtgcacagcgacgagagagagctgctgcagctgctgagcaccccccacctgagagccgtgctgatggtgcacgacaccgtggcccagaagaacttcgaccccgtgctgccccccctgcccgacaacatcgacgaggacttcgacgaggagagcgtgaagatcgtgagactggtgaagaacaaggagcccctgggcgccaccatcagaagagacgagcacagcggcgccgtggtggtggccagaatcatgagaggcggcgccgccgacagaagcggcctggtgcacgtgggcgacgagctgagagaggtgaacggcatcgccgtgctgcacaagagacccgacgagatcagccagatcctggcccagagccagggcagcatcaccctgaagatcatccccgccacccaggaggaggacagactgaaggagagcaaggtgttcatgagagccctgttccactacaaccccagagaggacagagccatcccctgccaggaggccggcctgcccttccagagaagacaggtgctggaggtggtgagccaggacgaccccacctggtggcaggccaagagagtgggcgacaccaacctgagagccggcctgatccccagcaagggcttccaggagagaagactgagctacagaagagccgccggcaccctgcccagcccccagagcctgagaaagcccccctacgaccagccctgcgacaaggagacctgcgactgcgagggctacctgaagggccactacgtggccggcctgagaagaagcttcagactgggctgcagagagagactgggcggcagccaggagggcaagatgagcagcggcgccgagagccccgagctgctgacctacgaggaggtggccagataccagcaccagcccggcgagagacccagactggtggtgctgatcggcagcctgggcgccagactgcacgagctgaagcagaaggtggtggccgagaacccccagcacttcggcgtggccgtgccccacaccaccagacccagaaagagccacgagaaggagggcgtggagtaccacttcgtgagcaagcaggccttcgaggccgacctgcaccacaacaagttcctggagcacggcgagtacaaggagaacctgtacggcaccagcctggaggccatccaggccgtgatggccaagaacaaggtgtgcctggtggacgtggagcccgaggccctgaagcagctgagaaccagcgagttcaagccctacatcatcttcgtgaagcccgccatccaggagaagagaaagaccccccccatgagccccgcctgcgaggacaccgccgcccccttcgacgagcagcagcaggagatggccgccagcgccgccttcatcgacagacactacggccacctggtggacgccgtgctggtgaaggaggacctgcagggcgcctacagccagctgaaggtggtgctggagaagctgagcaaggacacccactgggtgcccgtgagctgggtgagatag

SEQ ID NO: 88566 - DNA, 1782 bp, Artificial Sequence
  Description of Artificial Sequence: Synthetic coding sequence
atgatccagagcgacaagggcgccgacccccccgacaagaaggacatgaagctgagcaccgccaccaacccccagaacggcctgagccagatcctgagactggtgctgcaggagctgagcctgttctacggcagagacgtgaacggcgtgtgcctgctgtacgacctgctgcacagcccctggctgcaggccctgctgaagatctacgactgcctgcaggagttcaaggagaagaagctggtgcccgccaccccccacgcccaggtgctgagctacgaggtggtggagctgctgagagagacccccaccagccccgagatccaggagctgagacagatgctgcaggccccccacttcaaggccctgctgagcgcccacgacaccatcgcccagaaggacttcgagcccctgctgccccccctgcccgacaacatccccgagagcgaggaggccatgagaatcgtgtgcctggtgaagaaccagcagcccctgggcgccaccatcaagagacacgagatgaccggcgacatcctggtggccagaatcatccacggcggcctggccgagagaagcggcctgctgtacgccggcgacaagctggtggaggtgaacggcgtgagcgtggagggcctggaccccgagcaggtgatccacatcctggccatgagcagaggcaccatcatgttcaaggtggtgcccgtgagcgacccccccgtgaacagccagcagatggaccccgacatcccctgcatggacgccggcctgcccttccagaagggcgacatcctgcagatcgtggaccagaacgacgccctgtggtggcaggccagaaagatcagcgaccccgccacctgcgccggcctggtgcccagcaaccacctgctgaagagaaagcagagagagttctggtggagccagccctaccagccccacacctgcctgaagagcaccctgtacaaggaggagttcgtgggctacggccagaagttcttcatcgccggcttcagaagaagcatgagactgtgcagaagaaagagccacctgagccccctgcacgccagcgtgtgctgcaccggcagctgctacagcgccgtgggcgccccctacgaggaggtggtgagataccagagaagacccagcgacaagtacagactgatcgtgctgatgggccccagcggcgtgggcgtgaacgagctgagaagacagctgatcgagttcaaccccagccacttccagagcgccgtgccccacaccaccagaaccaagaagagctacgagatgaacggcagagagtaccactacgtgagcaaggagaccttcgagaacctgatctacagccacagaatgctggagtacggcgagtacaagggccacctgtacggcaccagcgtggacgccgtgcagaccgtgctggtggagggcaagatctgcgtgatggacctggagccccaggacatccagggcgtgagaacccacgagctgaagccctacgtgatcttcatcaagcccagcaacatgagatgcatgaagcagagcagaaagaacgccaaggtgatcaccgactactacgtggacatgaagttcaaggacgaggacctgcaggagatggagaacctggcccagagaatggagacccagttcggccagttcttcgaccacgtgatcgtgaacgacagcctgcacgacgcctgcgcccagctgctgagcgccatccagaaggcccaggaggagccccagtgggtgcccgccacctggatcagcagcgacaccgagagccagtag

SEQ ID NO: 88567 - DNA, 1809 bp, Artificial Sequence
  Description of Artificial Sequence: Synthetic coding sequence
atgatccagagcgacaagggcgccgacccccccgacaagaaggacatgaagctgagcaccgccaccaacccccagaacggcctgagccagatcctgagactggtgctgcaggagctgagcctgttctacggcagagacgtgaacggcgtgtgcctgctgtacgacctgctgcacagcccctggctgcaggccctgctgaagatctacgactgcctgcaggagttcaaggagaagaagctggtgcccgccaccccccacgcccaggtgctgagctacgaggtggtggagctgctgagagagacccccaccagccccgagatccaggagctgagacagatgctgcaggccccccacttcaagggcgccaccatcaagagacacgagatgaccggcgacatcctggtggccagaatcatccacggcggcctggccgagagaagcggcctgctgtacgccggcgacaagctggtggaggtgaacggcgtgagcgtggagggcctggaccccgagcaggtgatccacatcctggccatgagcagaggcaccatcatgttcaaggtggtgcccgtgagcgacccccccgtgaacagccagcagatggtgtacgtgagagccatgaccgagtactggccccaggaggaccccgacatcccctgcatggacgccggcctgcccttccagaagggcgacatcctgcagatcgtggaccagaacgacgccctgtggtggcaggccagaaagatcagcgaccccgccacctgcgccggcctggtgcccagcaaccacctgctgaagagatggagcttcgccctggtggcccaggccggcgtgcagtggcactacctggacagcctgcagcccctgccccccggcttcaagagattcagctgcctgagcctgcccagaagctgggactacatcgaggacgacatgaagatcgacgagaagtgcgtggaggccgagaaggagagcatcgagaccgacaaggaggagttcgtgggctacggccagaagttcttcatcgccggcttcagaagaagcatgagactgtgcagaagaaagagccacctgagccccctgcacgccagcgtgtgctgcaccggcagctgctacagcgccgtgggcgccccctacgaggaggtggtgagataccagagaagacccagcgacaagtacagactgatcgtgctgatgggccccagcggcgtgggcgtgaacgagctgagaagacagctgatcgagttcaaccccagccacttccagagcgccgtgccccacaccaccagaaccaagaagagctacgagatgaacggcagagagtaccactacgtgagcaaggagaccttcgagaacctgatctacagccacagaatgctggagtacggcgagtacaagggccacctgtacggcaccagcgtggacgccgtgcagaccgtgctggtggagggcaagatctgcgtgatggacctggagccccaggacatccagggcgtgagaacccacgagctgaagccctacgtgatcttcatcaagcccagcaacatgagatgcatgaagcagagcagaaagaacgccaaggtgatcaccgactactacgtggacatgaagttcaaggacgaggacctgcaggagatggagaacctggcccagagaatggagacccagttcggccagttcttcgaccacgtgatcgtgaacgacagcctgcacgacgcctgcgcccagctgctgagcgccatccagaaggcccaggaggagccccagtgggtgcccgccacctggatcagcagcgacaccgagagccagtag

SEQ ID NO: 88568 - DNA, 1914 bp, Artificial Sequence
  Description of Artificial Sequence: Synthetic coding sequence
atgatccagagcgacaagggcgccgacccccccgacaagaaggacatgaagctgagcaccgccaccaacccccagaacggcctgagccagatcctgagactggtgctgcaggagctgagcctgttctacggcagagacgtgaacggcgtgtgcctgctgtacgacctgctgcacagcccctggctgcaggccctgctgaagatctacgactgcctgcaggagttcaaggagaagaagctggtgcccgccaccccccacgcccaggtgctgagctacgaggtggtggagctgctgagagagacccccaccagccccgagatccaggagctgagacagatgctgcaggccccccacttcaaggccctgctgagcgcccacgacaccatcgcccagaaggacttcgagcccctgctgccccccctgcccgacaacatccccgagagcgaggaggccatgagaatcgtgtgcctggtgaagaaccagcagcccctgggcgccaccatcaagagacacgagatgaccggcgacatcctggtggccagaatcatccacggcggcctggccgagagaagcggcctgctgtacgccggcgacaagctggtggaggtgaacggcgtgagcgtggagggcctggaccccgagcaggtgatccacatcctggccatgagcagaggcaccatcatgttcaaggtggtgcccgtgagcgacccccccgtgaacagccagcagatggtgtacgtgagagccatgaccgagtactggccccaggaggaccccgacatcccctgcatggacgccggcctgcccttccagaagggcgacatcctgcagatcgtggaccagaacgacgccctgtggtggcaggccagaaagatcagcgaccccgccacctgcgccggcctggtgcccagcaaccacctgctgaagagaaagcagagagagttctggtggagccagccctaccagccccacacctgcctgaagagcaccctgagcatcagcctgaagggcgaggacgacatgaagatcgacgagaagtgcgtggaggccgagaacagcaccgccgagagcgaggagctgaacagcgacaaggaggagttcgtgggctacggccagaagttcttcatcgccggcttcagaagaagcatgagactgtgcagaagaaagagccacctgagccccctgcacgccagcgtgtgctgcaccggcagctgctacagcgccgtgggcgccccctacgaggaggtggtgagataccagagaagacccagcgacaagtacagactgatcgtgctgatgggccccagcggcgtgggcgtgaacgagctgagaagacagctgatcgagttcaaccccagccacttccagagcgccgtgccccacaccaccagaaccaagaagagctacgagatgaacggcagagagtaccactacgtgagcaaggagaccttcgagaacctgatctacagccacagaatgctggagtacggcgagtacaagggccacctgtacggcaccagcgtggacgccgtgcagaccgtgctggtggagggcaagatctgcgtgatggacctggagccccaggacatccagggcgtgagaacccacgagctgaagccctacgtgatcttcatcaagcccagcaacatgagatgcatgaagcagagcagaaagaacgccaaggtgatcaccgactactacgtggacatgaagttcaaggacgaggacctgcaggagatggagaacctggcccagagaatggagacccagttcggccagttcttcgaccacgtgatcgtgaacgacagcctgcacgacgcctgcgcccagctgctgagcgccatccagaaggcccaggaggagccccagtgggtgcccgccacctggatcagcagcgacaccgagagccagtag

SEQ ID NO: 88569 - DNA, 1701 bp, Artificial Sequence
  Description of Artificial Sequence: Synthetic coding sequence
atgatccagagcgacaagggcgccgacccccccgacaagaaggacatgaagctgagcaccgccaccaacccccagaacggcctgagccagatcctgagactggtgctgcaggagctgagcctgttctacggcagagacgtgaacggcgtgtgcctgctgtacgacctgctgcacagcccctggctgcaggccctgctgaagatctacgactgcctgcaggagttcaaggagaagaagctggtgcccgccaccccccacgcccaggtgctgagctacgagggcgccaccatcaagagacacgagatgaccggcgacatcctggtggccagaatcatccacggcggcctggccgagagaagcggcctgctgtacgccggcgacaagctggtggaggtgaacggcgtgagcgtggagggcctggaccccgagcaggtgatccacatcctggccatgagcagaggcaccatcatgttcaaggtggtgcccgtgagcgacccccccgtgaacagccagcagatggtgtacgtgagagccatgaccgagtactggccccaggaggaccccgacatcccctgcatggacgccggcctgcccttccagaagggcgacatcctgcagatcgtggaccagaacgacgccctgtggtggcaggccagaaagatcagcgaccccgccacctgcgccggcctggtgcccagcaaccacctgctgaagagaaagcagagagagttctggtggagccagccctaccagccccacacctgcctgaagagcaccctgagcatcagcctgaagggcgaggacgacatgaagatcgacgagaagtgcgtggaggccgagaacagcaccgccgagagcgaggagctgaacagcgacaaggaggagttcgtgggctacggccagaagttcttcatcgccggcttcagaagaagcatgagactgtgcagaagaaagagccacctgagccccctgcacgccagcgtgtgctgcaccggcagctgctacagcgccgtgggcgccccctacgaggaggtggtgagataccagagaagacccagcgacaagtacagactgatcgtgctgatgggccccagcggcgtgggcgtgaacgagctgagaagacagctgatcgagttcaaccccagccacttccagagcgccgtgccccacaccaccagaaccaagaagagctacgagatgaacggcagagagtaccactacgtgagcaaggagaccttcgagaacctgatctacagccacagaatgctggagtacggcgagtacaagggccacctgtacggcaccagcgtggacgccgtgcagaccgtgctggtggagggcaagatctgcgtgatggacctggagccccaggacatccagggcgtgagaacccacgagctgaagccctacgtgatcttcatcaagcccagcaacatgagatgcatgaagcagagcagaaagaacgccaaggtgatcaccgactactacgtggacatgaagttcaaggacgaggacctgcaggagatggagaacctggcccagagaatggagacccagttcggccagttcttcgaccacgtgatcgtgaacgacagcctgcacgacgcctgcgcccagctgctgagcgccatccagaaggcccaggaggagccccagtgggtgcccgccacctggatcagcagcgacaccgagagccagtag

SEQ ID NO: 88570 - DNA, 1914 bp, Artificial Sequence
  Description of Artificial Sequence: Synthetic coding sequence
atgatccagagcgacaagggcgccgacccccccgacaagaaggacatgaagctgagcaccgccaccaacccccagaacggcctgagccagatcctgagactggtgctgcaggagctgagcctgttctacggcagagacgtgaacggcgtgtgcctgctgtacgacctgctgcacagcccctggctgcaggccctgctgaagatctacgactgcctgcaggagttcaaggagaagaagctggtgcccgccaccccccacgcccaggtgctgagctacgaggtggtggagctgctgagagagacccccaccagccccgagatccaggagctgagacagatgctgcaggccccccacttcaaggccctgctgagcgcccacgacaccatcgcccagaaggacttcgagcccctgctgccccccctgcccgacaacatccccgagagcgaggaggccatgagaatcgtgtgcctggtgaagaaccagcagcccctgggcgccaccatcaagagacacgagatgaccggcgacatcctggtggccagaatcatccacggcggcctggccgagagaagcggcctgctgtacgccggcgacaagctggtggaggtgaacggcgtgagcgtggagggcctggaccccgagcaggtgatccacatcctggccatgagcagaggcaccatcatgttcaaggtggtgcccgtgagcgacccccccgtgaacagccagcagatggtgtacgtgagagccatgaccgagtactggccccaggaggaccccgacatcccctgcatggacgccggcctgcccttccagaagggcgacatcctgcagatcgtggaccagaacgacgccctgtggtggcaggccagaaagatcagcgaccccgccacctgcgccggcctggtgcccagcaaccacctgctgaagagaaagcagagagagttctggtggagccagccctaccagccccacacctgcctgaagagcaccctgagcatcagcatggaggaggaggacgacatgaagatcgacgagaagtgcgtggaggccgacgaggagaccttcgagagcgaggagctgagcgaggacaaggaggagttcgtgggctacggccagaagttcttcatcgccggcttcagaagaagcatgagactgtgcagaagaaagagccacctgagccccctgcacgccagcgtgtgctgcaccggcagctgctacagcgccgtgggcgccccctacgaggaggtggtgagataccagagaagacccagcgacaagtacagactgatcgtgctgatgggccccagcggcgtgggcgtgaacgagctgagaagacagctgatcgagttcaaccccagccacttccagagcgccgtgccccacaccaccagaaccaagaagagctacgagatgaacggcagagagtaccactacgtgagcaaggagaccttcgagaacctgatctacagccacagaatgctggagtacggcgagtacaagggccacctgtacggcaccagcgtggacgccgtgcagaccgtgctggtggagggcaagatctgcgtgatggacctggagccccaggacatccagggcgtgagaacccacgagctgaagccctacgtgatcttcatcaagcccagcaacatgagatgcatgaagcagagcagaaagaacgccaaggtgatcaccgactactacgtggacatgaagttcaaggacgaggacctgcaggagatggagaacctggcccagagaatggagacccagttcggccagttcttcgaccacgtgatcgtgaacgacagcctgcacgacgcctgcgcccagctgctgagcgccatccagaaggcccaggaggagccccagtgggtgcccgccacctggatcagcagcgacaccgagagccagtag

SEQ ID NO: 88571 - DNA, 2028 bp, Artificial Sequence
  Description of Artificial Sequence: Synthetic coding sequence
atgaccaccagccacatgaacggccacgtgaccgaggagagcgacagcgaggtgaagaacgtggacctggccagccccgaggagcaccagaagcacagagagatggccgtggactgccccggcgacctgggcaccagaatgatgcccatcagaagaagcgcccagctggagagaatcagacagcagcaggaggacatgagaagaagaagagaggaggagggcaagaagcaggagctggacctgaacagcagcatgagactgaagaagctggcccagatcccccccaagaccggcatcgacaaccccatgttcgacaccgaggagggcatcgtgctggagagcccccactacgccgtgaagatcctggagatcgaggacctgttcagcagcctgaagcacatccagcacaccctggtggacagccagagccaggaggacatcagcctgctgctgcagctggtgcagaacaaggacttccagaacgccttcaagatccacaacgccatcaccgtgcacatgaacaaggccagcccccccttccccctgatcagcaacgcccaggacctggcccaggaggtgcagaccgtgctgaagcccgtgcaccacaaggagggccaggagctgaccgccctgctgaacaccccccacatccaggccctgctgctggcccacgacaaggtggccgagcaggagatgcagctggagcccatcaccgacgagagagtgtacgagagcatcggccagtacggcggcgagaccgtgaagatcgtgagaatcgagaaggccagagacatccccctgggcgccaccgtgagaaacgagatggacagcgtgatcatcagcagaatcgtgaagggcggcgccgccgagaagagcggcctgctgcacgagggcgacgaggtgctggagatcaacggcatcgagatcagaggcaaggacgtgaacgaggtgttcgacctgctgagcgacatgcacggcaccctgaccttcgtgctgatccccagccagcagatcaagcccccccccgccaaggagaccgtgatccacgtgaaggcccacttcgactacgaccccagcgacgacccctacgtgccctgcagagagctgggcctgagcttccagaagggcgacatcctgcacgtgatcagccaggaggaccccaactggtggcaggcctacagagagggcgacgaggacaaccagcccctggccggcctggtgcccggcaagagcttccagcagcagagagaggccatgaagcagaccatcgaggaggacaaggagcccgagaagagcggcaagctgtggtgcgccaagaagaacaagaagaagagaaagaaggtgctgtacaacgccaacaagaacgacgactacgacaacgaggagatcctgacctacgaggagatgagcctgtaccaccagcccgccaacagaaagagacccatcatcctgatcggcccccagaactgcggccagaacgagctgagacagagactgatgaacaaggagaaggacagattcgccagcgccgtgccccacaccaccagaagcagaagagaccaggaggtggccggcagagactaccacttcgtgagcagacaggccttcgaggccgacatcgccgccggcaagttcatcgagcacggcgagttcgagaagaacctgtacggcaccagcatcgacagcgtgagacaggtgatcaacagcggcaagatctgcctgctgagcctgagaacccagagcctgaagaccctgagaaacagcgacctgaagccctacatcatcttcatcgccccccccagccaggagagactgagagccctgctggccaaggagggcaagaaccccaagcccgaggagctgagagagatcatcgagaagaccagagagatggagcagaacaacggccactacttcgacaccgccatcgtgaacagcgacctggacaaggcctaccaggagctgctgagactgatcaacaagctggacaccgagccccagtgggtgcccagcacctggctgagatag

SEQ ID NO: 88572 - DNA, 1926 bp, Artificial Sequence
  Description of Artificial Sequence: Synthetic coding sequence
atggccgtggactgccccggcgacctgggcaccagaatgatgcccatcagaagaagcgcccagctggagagaatcagacagcagcaggaggacatgagaagaagaagagaggaggagggcaagaagcaggagctggacctgaacagcagcatgagactgaagaagctggcccagatcccccccaagaccggcatcgacaaccccatgttcgacaccgaggagggcatcgtgctggagagcccccactacgccgtgaagatcctggagatcgaggacctgttcagcagcctgaagcacatccagcacaccctggtggacagccagagccaggaggacatcagcctgctgctgcagctggtgcagaacaaggacttccagaacgccttcaagatccacaacgccatcaccgtgcacatgaacaaggccagcccccccttccccctgatcagcaacgcccaggacctggcccaggaggtgcagaccgtgctgaagcccgtgcaccacaaggagggccaggagctgaccgccctgctgaacaccccccacatccaggccctgctgctggcccacgacaaggtggccgagcaggagatgcagctggagcccatcaccgacgagagagtgtacgagagcatcggccagtacggcggcgagaccgtgaagatcgtgagaatcgagaaggccagagacatccccctgggcgccaccgtgagaaacgagatggacagcgtgatcatcagcagaatcgtgaagggcggcgccgccgagaagagcggcctgctgcacgagggcgacgaggtgctggagatcaacggcatcgagatcagaggcaaggacgtgaacgaggtgttcgacctgctgagcgacatgcacggcaccctgaccttcgtgctgatccccagccagcagatcaagcccccccccgccaaggagaccgtgatccacgtgaaggcccacttcgactacgaccccagcgacgacccctacgtgccctgcagagagctgggcctgagcttccagaagggcgacatcctgcacgtgatcagccaggaggaccccaactggtggcaggcctacagagagggcgacgaggacaaccagcccctggccggcctggtgcccggcaagagcttccagcagcagagagaggccatgaagcagaccatcgaggaggacaaggagcccgagaagagcggcaagctgtggtgcgccaagaagaacaagaagaagagaaagaaggtgctgtacaacgccaacaagaacgacgactacgacaacgaggagatcctgacctacgaggagatgagcctgtaccaccagcccgccaacagaaagagacccatcatcctgatcggcccccagaactgcggccagaacgagctgagacagagactgatgaacaaggagaaggacagattcgccagcgccgtgccccacaccaccagaagcagaagagaccaggaggtggccggcagagactaccacttcgtgagcagacaggccttcgaggccgacatcgccgccggcaagttcatcgagcacggcgagttcgagaagaacctgtacggcaccagcatcgacagcgtgagacaggtgatcaacagcggcaagatctgcctgctgagcctgagaacccagagcctgaagaccctgagaaacagcgacctgaagccctacatcatcttcatcgccccccccagccaggagagactgagagccctgctggccaaggagggcaagaaccccaagcccgaggagctgagagagatcatcgagaagaccagagagatggagcagaacaacggccactacttcgacaccgccatcgtgaacagcgacctggacaaggcctaccaggagctgctgagactgatcaacaagctggacaccgagccccagtgggtgcccagcacctggctgagatag

SEQ ID NO: 88573 - DNA, 15 bp, Artificial Sequence
  Description of Artificial Sequence: Synthetic coding sequence
atggccgtggactag

SEQ ID NO: 88574 - DNA, 450 bp, Artificial Sequence
  Description of Artificial Sequence: Synthetic coding sequence
atggccgtggactgccccggcgacctgggcaccagaatgatgcccatcagaagaagcgcccagctggagagaatcagacagcagcaggaggacatgagaagaagaagagaggaggagggcaagaagcaggagctggacctgaacagcagcatgagactgaagaagctggcccagatcccccccaagaccggcatcgacaaccccatgttcgacaccgaggagggcatcgtgctggagagcccccactacgccgtgaagatcctggagatcgaggacctgttcagcagcctgaagcacatccagcacaccctggtggacagccagagccaggaggacatcagcctgctgctgcagctggtgcagaacaaggacttccagaacgccttcaagatccacaacgccatcaccgtgcacatgaacaaggccagcccccccttccccctgatctag

SEQ ID NO: 88575 - DNA, 870 bp, Artificial Sequence
  Description of Artificial Sequence: Synthetic coding sequence
atgaccggcgtgttcgacagaagagtgcccagcatcagaagcggcgacttccaggcccccttccagaccagcgccgccatgcaccaccccagccaggagagccccaccctgcccgagagcagcgccaccgacagcgactactacagccccaccggcggcgccccccacggctactgcagccccaccagcgccagctacggcaaggccctgaacccctaccagtaccagtaccacggcgtgaacggcagcgccggcagctaccccgccaaggcctacgccgactacagctacgccagcagctaccaccagtacggcggcgcctacaacagagtgcccagcgccaccaaccagcccgagaaggaggtgaccgagcccgaggtgagaatggtgaacggcaagcccaagaaggtgagaaagcccagaaccatctacagcagcttccagctggccgccctgcagagaagattccagaagacccagtacctggccctgcccgagagagccgagctggccgccagcctgggcctgacccagacccaggtgaagatctggttccagaacaagagaagcaagatcaagaagatcatgaagaacggcgagatgccccccgagcacagccccagcagcagcgaccccatggcctgcaacagcccccagagccccgccgtgtgggagccccagggcagcagcagaagcctgagccaccacccccacgcccacccccccaccagcaaccagagccccgccagcagctacctggagaacagcgccagctggtacaccagcgccgccagcagcatcaacagccacctgcccccccccggcagcctgcagcaccccctggccctggccagcggcaccctgtactag

SEQ ID NO: 88576 - DNA, 1623 bp, Artificial Sequence
  Description of Artificial Sequence: Synthetic coding sequence
atgcagcaggtgctggagaacctgaccgagctgcccagcagcaccggcgccgaggagatcgacctgatcttcctgaagggcatcatggagaaccccatcgtgaagagcctggccaaggcccacgagagactggaggacagcaagctggaggccgtgagcgacaacaacctggagctggtgaacgagatcctggaggacatcacccccctgatcaacgtggacgagaacgtggccgagctggtgggcatcctgaaggagccccacttccagagcctgctggaggcccacgacatcgtggccagcaagtgctacgacagcccccccagcagccccgagatgaacaacagcagcatcaacaaccagctgctgcccgtggacgccatcagaatcctgggcatccacaagagagccggcgagcccctgggcgtgaccttcagagtggagaacaacgacctggtgatcgccagaatcctgcacggcggcatgatcgacagacagggcctgctgcacgtgggcgacatcatcaaggaggtgaacggccacgaggtgggcaacaaccccaaggagctgcaggagctgctgaagaacatcagcggcagcgtgaccctgaagatcctgcccagctacagagacaccatcaccccccagcaggtgttcgtgaagtgccacttcgactacaacccctacaacgacaacctgatcccctgcaaggaggccggcctgaagttcagcaagggcgagatcctgcagatcgtgaacagagaggaccccaactggtggcaggccagccacgtgaaggagggcggcagcgccggcctgatccccagccagttcctggaggagaagagaaaggccttcgtgagaagagactgggacaacagcggccccttctgcggcaccatcagcagcaagaagaagaagaagatgatgtacctgaccaccagaaacgccgagttcgacagacacgagatccagatctacgaggaggtggccaagatgccccccttccagagaaagaccctggtgctgatcggcgcccagggcgtgggcagaagaagcctgaagaacagattcatcgtgctgaaccccaccagattcggcaccaccgtgcccttcaccagcagaaagcccagagaggacgagaaggacggccaggcctacaagttcgtgagcagaagcgagatggaggccgacatcaaggccggcaagtacctggagcacggcgagtacgagggcaacctgtacggcaccaagatcgacagcatcctggaggtggtgcagaccggcagaacctgcatcctggacgtgaacccccaggccctgaaggtgctgagaaccagcgagttcatgccctacgtggtgttcatcgccgcccccgagctggagaccctgagagccatgcacaaggccgtggtggacgccggcatcaccaccaagctgctgaccgacagcgacctgaagaagaccgtggacgagagcgccagaatccagagagcctacaaccactacttcgacctgatcatcatcaacgacaacctggacaaggccttcgagaagctgcagaccgccatcgagaagctgagaatggagccccagtgggtgcccatcagctgggtgtactag

SEQ ID NO: 88577 - DNA, 1287 bp, Artificial Sequence
  Description of Artificial Sequence: Synthetic coding sequence
atgaacaacagcagcatcaacaaccagctgctgcccgtggacgccatcagaatcctgggcatccacaagagagccggcgagcccctgggcgtgaccttcagagtggagaacaacgacctggtgatcgccagaatcctgcacggcggcatgatcgacagacagggcctgctgcacgtgggcgacatcatcaaggaggtgaacggccacgaggtgggcaacaaccccaaggagctgcaggagctgctgaagaacatcagcggcagcgtgaccctgaagatcctgcccagctacagagacaccatcaccccccagcaggtgttcgtgaagtgccacttcgactacaacccctacaacgacaacctgatcccctgcaaggaggccggcctgaagttcagcaagggcgagatcctgcagatcgtgaacagagaggaccccaactggtggcaggccagccacgtgaaggagggcggcagcgccggcctgatccccagccagttcctggaggagaagagaaaggccttcgtgagaagagactgggacaacagcggccccttctgcggcaccatcagcagcaagaagaagaagaagatgatgtacctgaccaccagaaacgccgagttcgacagacacgagatccagatctacgaggaggtggccaagatgccccccttccagagaaagaccctggtgctgatcggcgcccagggcgtgggcagaagaagcctgaagaacagattcatcgtgctgaaccccaccagattcggcaccaccgtgcccttcaccagcagaaagcccagagaggacgagaaggacggccaggcctacaagttcgtgagcagaagcgagatggaggccgacatcaaggccggcaagtacctggagcacggcgagtacgagggcaacctgtacggcaccaagatcgacagcatcctggaggtggtgcagaccggcagaacctgcatcctggacgtgaacccccaggccctgaaggtgctgagaaccagcgagttcatgccctacgtggtgttcatcgccgcccccgagctggagaccctgagagccatgcacaaggccgtggtggacgccggcatcaccaccaagctgctgaccgacagcgacctgaagaagaccgtggacgagagcgccagaatccagagagcctacaaccactacttcgacctgatcatcatcaacgacaacctggacaaggccttcgagaagctgcagaccgccatcgagaagctgagaatggagccccagtgggtgcccatcagctgggtgtactag

SEQ ID NO: 88578 - DNA, 924 bp, Artificial Sequence
  Description of Artificial Sequence: Synthetic coding sequence
atgcagcaggtgctggagaacctgaccgagctgcccagcagcaccggcgccgaggagatcgacctgatcttcctgaagggcatcatggagaaccccatcgtgaagagcctggccaaggcccacgagagactggaggacagcaagctggaggccgtgagcgacaacaacctggagctggtgaacgagatcctggaggacatcacccccctgatcaacgtggacgagaacgtggccgagctggtgggcatcctgaaggagccccacttccagagcctgctggaggcccacgacatcgtggccagcaagtgctacgacagcccccccagcagccccgagatgaacaacagcagcatcaacaaccagctgctgcccgtggacgccatcagaatcctgggcatccacaagagagccggcgagcccctgggcgtgaccttcagagtggagaacaacgacctggtgatcgccagaatcctgcacggcggcatgatcgacagacagggcctgctgcacgtgggcgacatcatcaaggaggtgaacggccacgaggtgggcaacaaccccaaggagctgcaggagctgctgaagaacatcagcggcagcgtgaccctgaagatcctgcccagctacagagacaccatcaccccccagcaggtgttcgtgaagtgccacttcgactacaacccctacaacgacaacctgatcccctgcaaggaggccggcctgaagttcagcaagggcgagatcctgcagatcgtgaacagagaggaccccaactggtggcaggccagccacgtgaaggagggcggcagcgccggcctgatccccagccagttcctggaggagaagagaaaggccttcgtgagaagagactgggacaacagcggccccttctgcggcaccatcagcagcaagaagaagaagtag

SEQ ID NO: 88579 - DNA, 654 bp, Artificial Sequence
  Description of Artificial Sequence: Synthetic coding sequence
atgcagcaggtgctggagaacctgaccgagctgcccagcagcaccggcgccgaggagatcgacctgatcttcctgaagggcatcatggagaaccccatcgtgaagagcctggccaaggcccacgagagactggaggacagcaagctggaggccgtgagcgacaacaacctggagctggtgaacgagatcctggaggacatcacccccctgatcaacgtggacgagaacgtggccgagctggtgggcatcctgaaggagccccacttccagagcctgctggaggcccacgacatcgtggccagcaagtgctacgacagcccccccagcagccccgagatgaacaacagcagcatcaacaaccagctgctgcccgtggacgccatcagaatcctgggcatccacaagagagccggcgagcccctgggcgtgaccttcagagtggagaacaacgacctggtgatcgccagaatcctgcacggcggcatgatcgacagacagggcctgctgcacgtgggcgacatcatcaaggaggtgaacggccacgaggtgggcaacaaccccaaggagctgcaggagctgctgaagaacatcagcggcagcgtgaccctgaagatcctgcccagctacagagacaccatcaccccccagcagtag

SEQ ID NO: 88580 - DNA, 1731 bp, Artificial Sequence
  Description of Artificial Sequence: Synthetic coding sequence
atgcccgccctgagcaccggcagcggcagcgacaccggcctgtacgagctgctggccgccctgcccgcccagctgcagccccacgtggacagccaggaggacctgaccttcctgtgggacatgttcggcgagaagagcctgcacagcctggtgaagatccacgagaagctgcactactacgagaagcagagccccgtgcccatcctgcacggcgccgccgccctggccgacgacctggccgaggagctgcagaacaagcccctgaacagcgagatcagagagctgctgaagctgctgagcaagcccaacgtgaaggccctgctgagcgtgcacgacaccgtggcccagaagaactacgaccccgtgctgccccccatgcccgaggacatcgacgacgaggaggacagcgtgaagatcatcagactggtgaagaacagagagcccctgggcgccaccatcaagaaggacgagcagaccggcgccatcatcgtggccagaatcatgagaggcggcgccgccgacagaagcggcctgatccacgtgggcgacgagctgagagaggtgaacggcatccccgtggaggacaagagacccgaggagatcatccagatcctggcccagagccagggcgccatcaccttcaagatcatccccggcagcaaggaggagacccccagcaaggagggcaagatgttcatcaaggccctgttcgactacaaccccaacgaggacaaggccatcccctgcaaggaggccggcctgagcttcaagaagggcgacatcctgcagatcatgagccaggacgacgccacctggtggcaggccaagcacgaggccgacgccaaccccagagccggcctgatccccagcaagcacttccaggagagaagactggccctgagaagacccgagatcctggtgcagcccctgaaggtgagcaacagaaagagcagcggcttcagaaagagcttcagactgagcagaaaggacaagaagaccaacaagagcatgtacgagtgcaagaagagcgaccagtacgacaccgccgacgtgcccacctacgaggaggtgaccccctacagaagacagaccaacgagaagtacagactggtggtgctggtgggccccgtgggcgtgggcctgaacgagctgaagagaaagctgctgatcagcgacacccagcactacggcgtgaccgtgccccacaccaccagagccagaagaagccaggagagcgacggcgtggagtacatcttcatcagcaagcacctgttcgagaccgacgtgcagaacaacaagttcatcgagtacggcgagtacaagaacaactactacggcaccagcatcgacagcgtgagaagcgtgctggccaagaacaaggtgtgcctgctggacgtgcagccccacaccgtgaagcacctgagaaccctggagttcaagccctacgtgatcttcatcaagccccccagcatcgagagactgagagagaccagaaagaacgccaagatcatcagcagcagagacgaccagggcgccgccaagcccttcaccgaggaggacttccaggagatgatcaagagcgcccagatcatggagagccagtacggccacctgttcgacaagatcatcatcaacgacgacctgaccgtggccttcaacgagctgaagaccaccttcgacaagctggagaccgagacccactgggtgcccgtgagctggctgcacagctag

SEQ ID NO: 88581 - DNA, 1731 bp, Artificial Sequence; identical to SEQ ID NO: 88580
  Description of Artificial Sequence: Synthetic coding sequence

SEQ ID NO: 88582 - DNA, 1731 bp, Artificial Sequence; identical to SEQ ID NO: 88580
  Description of Artificial Sequence: Synthetic coding sequence

SEQ ID NO: 88583 - DNA, 939 bp, Artificial Sequence
  Description of Artificial Sequence: Synthetic coding sequence
atgcccgccctgagcaccggcagcggcagcgacaccggcctgtacgagctgctggccgccctgcccgcccagctgcagccccacgtggacagccaggaggacctgaccttcctgtgggacatgttcggcgagaagagcctgcacagcctggtgaagcacttccaggagagaagactggccctgagaagacccgagatcctggtgcagcccctgaaggtgagcaacagaaagagcagcggcttcagaaagagcttcagactgagcagaaaggacaagaagaccaacaagagcatgtacgagtgcaagaagagcgaccagtacgacaccgccgacgtgcccacctacgaggaggtgaccccctacagaagacagaccaacgagaagtacagactggtggtgctggtgggccccgtgggcgtgggcctgaacgagctgaagagaaagctgctgatcagcgacacccagcactacggcgtgaccgtgccccacaccaccagagccagaagaagccaggagagcgacggcgtggagtacatcttcatcagcaagcacctgttcgagaccgacgtgcagaacaacaagttcatcgagtacggcgagtacaagaacaactactacggcaccagcatcgacagcgtgagaagcgtgctggccaagaacaaggtgtgcctgctggacgtgcagccccacaccgtgaagcacctgagaaccctggagttcaagccctacgtgatcttcatcaagccccccagcatcgagagactgagagagaccagaaagaacgccaagatcatcagcagcagagacgaccagggcgccgccaagcccttcaccgaggaggacttccaggagatgatcaagagcgcccagatcatggagagccagtacggccacctgttcgacaagatcatcatcaacgacgacctgaccgtggcctag

SEQ ID NO: 88584 - DNA, 1125 bp, Artificial Sequence
  Description of Artificial Sequence: Synthetic coding sequence
atgcccgaggacatcgacgacgaggaggacagcgtgaagatcatcagactggtgaagaacagagagcccctgggcgccaccatcaagaaggacgagcagaccggcgccatcatcgtggccagaatcatgagaggcggcgccgccgacagaagcggcctgatccacgtgggcgacgagctgagagaggtgaacggcatccccgtggaggacaagagacccgaggagatcatccagatcctggcccagagccagggcgccatcaccttcaagatcatccccggcagcaaggaggagacccccagcaaggagggcaagatgttcatcaaggccctgttcgactacaaccccaacgaggacaaggccatcccctgcaaggaggccggcctgagcttcaagaagggcgacatcctgcagatcatgagccaggacgacgccacctggtggcaggccaagcacgaggccgacgccaaccccagagccggcctgatccccagcaagcacttccaggagagaagactggccctgagaagacccgagatcctggtgcagcccctgaaggtgagcaacagaaagagcagcggcttcagaaagagcttcagactgagcagaaaggacaagaagaccaacaagagcatgtacgagtgcaagaagagcgaccagtacgacaccgccgacgtgcccacctacgaggaggtgaccccctacagaagacagaccaacgagaagtacagactggtggtgctggtgggccccgtgggcgtgggcctgaacgagctgaagagaaagctgctgatcagcgacacccagcactacggcgtgaccgtgccccacaccaccagagccagaagaagccaggagagcgacggcgtggagtacatcttcatcagcaagcacctgttcgagaccgacgtgcagaacaacaagttcatcgagtacggcgagtacaagaacaactactacggcaccagcatcgacagcgtgagaagcgtgctggccaagaacaaggtgtgcctgctggacgtgcagccccacggcccctggttcctgctgcccctgatggccgtgccctggggcgccaagccccccaacgccagaatgacctgcggcagccccctggacctgtag

SEQ ID NO: 88585 - DNA, 1731 bp, Artificial Sequence; identical to SEQ ID NO: 88580
  Description of Artificial Sequence: Synthetic coding sequence

SEQ ID NO: 88586 - DNA, 870 bp, Artificial Sequence
  Description of Artificial Sequence: Synthetic coding sequence
atgctgggctggtgcgaggccatcgccagaaacccccacagaatccccaacaacaccagaacccccgagatcagcggcgacctggccgacgccagccagaccagcaccctgaacgagaagagccccggcagaagcgccagcagaagcagcaacatcagcaaggccagcagccccaccaccggcaccgcccccagaagccagagcagactgagcgtgtgccccagcacccaggacatctgcagaatctgccactgcgagggcgacgaggagagccccctgatcaccccctgcagatgcaccggcaccctgagattcgtgcaccagagctgcctgcaccagtggatcaagagcagcgacaccagatgctgcgagctgtgcaagtacgacttcatcatggagaccaagctgaagcccctgagaaagtgggagaagctgcagatgaccaccagcgagagaagaaagatcttctgcagcgtgaccttccacgtgatcgccatcacctgcgtggtgtggagcctgtacgtgctgatcgacagaaccgccgaggagatcaagcagggcaacgacaacggcgtgctggagtggcccttctggaccaagctggtggtggtggccatcggcttcaccggcggcctggtgttcatgtacgtgcagtgcaaggtgtacgtgcagctgtggagaagactgaaggcctacaacagagtgatcttcgtgcagaactgccccgacaccgccaagaagctggagaagaacttcagctgcaacgtgaacaccgacatcaaggacgccgtggtggtgcccgtgccccagaccggcgccaacagcctgcccagcgccgagggcggcccccccgaggtggtgagcgtgtag

SEQ ID NO: 88587 - DNA, 819 bp, Artificial Sequence
  Description of Artificial Sequence: Synthetic coding sequence
atgaccagcagccacgtgtgctgcaacttcctgaacatgtggaagaagagcaagatcagcaccatgtactacctgaaccaggacgccaagctgagcaacctgttcctgcaggccagcagccccaccaccggcaccgcccccagaagccagagcagactgagcgtgtgccccagcacccaggacatctgcagaatctgccactgcgagggcgacgaggagagccccctgatcaccccctgcagatgcaccggcaccctgagattcgtgcaccagagctgcctgcaccagtggatcaagagcagcgacaccagatgctgcgagctgtgcaagtacgacttcatcatggagaccaagctgaagcccctgagaaagtgggagaagctgcagatgaccaccagcgagagaagaaagatcttctgcagcgtgaccttccacgtgatcgccatcacctgcgtggtgtggagcctgtacgtgctgatcgacagaaccgccgaggagatcaagcagggcaacgacaacggcgtgctggagtggcccttctggaccaagctggtggtggtggccatcggcttcaccggcggcctggtgttcatgtacgtgcagtgcaaggtgtacgtgcagctgtggagaagactgaaggcctacaacagagtgatcttcgtgcagaactgccccgacaccgccaagaagctggagaagaacttcagctgcaacgtgaacaccgacatcaaggacgccgtggtggtgcccgtgccccagaccggcgccaacagcctgcccagcgccgagggcggcccccccgaggtggtgagcgtgtag

SEQ ID NO: 88588 - DNA, 870 bp, Artificial Sequence; identical to SEQ ID NO: 88586
  Description of Artificial Sequence: Synthetic coding sequence

SEQ ID NO: 88589 - DNA, 426 bp, Artificial Sequence
  Description of Artificial Sequence: Synthetic coding sequence
atgctgggctggtgcgaggccatcgccagaaacccccacagaatccccaacaacaccagaacccccgagatcagcggcgacctggccgacgccagccagaccagcaccctgaacgagaagagccccggcagaagcgccagcagaagcagcaacatcagcaaggccagcagccccaccaccggcaccgcccccagaagccagagcagactgagcgtgtgccccagcacccaggacatctgcagaatctgccactgcgagggcgacgaggagagccccctgatcaccccctgcagatgcaccggcaccctgagattcgtgcaccagagctgcctgcaccagtggatcaagagcagcgacaccagatgctgcgagctgtgcaagtacgacttcatcatggagaccaagctgaagcccctgagaaagtag

SEQ ID NO: 88590 - DNA, 2427 bp, Artificial Sequence
  Description of Artificial Sequence: Synthetic coding sequence
atgctgcacgacgccagagacagacagaagttcttcagcgacgtgcagtacctgagagacatgcagcacaaggtggacagcgagtaccaggcctgcctgagaagacaggagtacagaagagaccccaacgagaagaagagagaccagttctggggccaggagaccagcttcgagagaagcagattcagcagcagaagcagcagcaagcagagcagcagcgaggaggacgccctgaccgagcccagaagcagcatcaagatcagcgccttcaagtgcgacagcaagctgcccgccatcgaccagaccagcgtgaagcagaagcacaagagcaccatgaccgtgagaaaggccgagaaggtggaccccagcgagcccagccccgccgaccaggcccccatggtgctgctgagaaagagaaagcccaacctgagaagattcaccgtgagccccgagagccacagccccagagccagcggcgacagaagcagacagaagcagcagtggcccgccaaggtgcccgtgcccagaggcgccgaccaggtggtgcagcaggagggcctgatgtgcaacaccaagctgaagagacccaaccaggagagaagaaacctggtgcccagcagccagcccatgaccgagaacgcccccgacagagccaagaagggcgaccccagcgcccccagccagagcgagctgcaccccgccctgagccaggccttccagggcaagaacagcccccaggtgctgagcgagttcagcggcccccccctgacccccaccaccgtgggcggccccagaaaggccagcttcagattcagagacgaggacttctacagcatcctgagcctgaacagcagaagagagagcgacgacaccgaggaggagacccagagcgaggagtgcctgtgggtgggcgtgagaagcccctgcagccccagccaccacaagagaagcagattcggcggcaccagcaccccccaggccaagaacaagaacttcgaggagaacgccgagaactgcagaggccacagcagcagaagaagcgagcccagccacggcagcctgagaatcagcaacgccatggagcccgccaccgagagacccagcgccggccagagactgagccaggaccccggcctgcccgacagagagagcgccaccgagaaggacagaggcggcagcgagaacgccaagaagagccccctgagctgggacaccaagagcgagcccagacaggaggtgggcgtgaacgccgagaacgtgtggagcgactgcatcagcgtggagcacagacccggcacccacgacagcgagggctactggaaggactacctgaacagcagccagaacagcctggactacttcatcagcggcagacccatcagccccagaagcagcgtgaacagcagctacaacccccccgccagcttcatgcacagcgccctgagagacgacatccccgtggacctgagcatgagcagcaccagcgtgcacagcagcgacagcgagggcaacagcggcttccacgtgtgccagcccctgagccccatcagaaacagaacccccttcgccagcgccgagaaccacaactacttccccgtgaacagcgcccacgagttcgccgtgagagaggccgaggacaccaccctgaccagccagccccagggcgcccccctgtacaccgacctgctgctgaacccccagggcaacctgagcctggtggacagcagcagcagcagccccagcagaatgaacagcgagggccacctgcacgtgagcggcagcctgcaggagaacacccccttcaccttcttcgccgtgagccacttccccaaccagaacgacaacggcagcagaatggccgccagcggcttcaccgacgagaaggagaccagcaagatcaaggccgaccccgagaagctgaagaagctgcaggagagcctgctggaggaggacagcgaggaggagggcgacctgtgcagaatctgccagatcgccggcggcagccccagcaaccccctgctggagccctgcggctgcgtgggcagcctgcagttcgtgcaccaggagtgcctgaagaagtggctgaaggtgaagatcaccagcggcgccgacctgggcgccgtgaagacctgcgagatgtgcaagcagggcctgctggtggacctgggcgacttcaacatgatcgagttctaccagaagcaccagcagagccaggcccagaacgagctgatgaacagcggcctgtacctggtgctgctgctgcacctgtacgagcagagattcgccgagctgatgagactgaaccacaaccaggtggagagagagagactgagcagaaactacccccagcccagaaccgaggagaacgagaacagcgagctgggcgacggcaacgagggcagcatcagccagagccaggtggtgtag

SEQ ID NO: 88591 - DNA, 2427 bp, Artificial Sequence; identical to SEQ ID NO: 88590
  Description of Artificial Sequence: Synthetic coding sequence

SEQ ID NO: 88592 - DNA, 2400 bp, Artificial Sequence
  Description of Artificial Sequence: Synthetic coding sequence
atgctgcacgacgccagagacagacagaagttcttcagcgacgtgcagtacctgagagacatgcagcacaaggtggacagcgagtaccaggcctgcctgagaagacaggagtacagaagagaccccaacgagaagaagagagaccagttctggggccaggagaccagcttcgagagaagcagattcagcagcagaagcagcagcaagcagagcagcagcgaggaggacgccctgaccgagcccagaagcagcatcaagatcagcgccttcaagtgcgacagcaagctgcccgccatcgaccagaccagcgtgaagcagaagcacaagagcaccatgaccgtgagaaaggccgagaaggtggaccccagcgagcccagccccgaccaggcccccatggtgctgctgagaaagagaaagcccaacctgagaagattcaccgtgagccccgagagccacagccccagagccagcggcgacagaagcagacagaagcagcagtggcccgccaaggtgcccgtgcccagaggcgccgaccaggtggtgcagcaggagggcctgatgtgcaacaccaagctgaagagacccaaccaggagagaagaaacctggtgcccagcagccagcccatgaccgagaacgcccccgacagagccaagaagggcgaccccagcgcccccagccagagcgagctgcaccccgccctgagccaggccttccagggcaagaacagcccccaggtgctgagcgagttcagcggcccccccctgacccccaccaccgtgggcggccccagaaaggccagcttcagattcagagacgaggacttctacagcatcctgagcctgaacagcagaagagagagcgacgacaccgaggaggagacccagagcgaggagtgcctgtgggtgggcgtgagaagcccctgcagccccagccaccacaagagaagcagattcggcggcaccagcaccccccaggccaagaacaagaacttcgaggagaacgccgagaactgcagaggccacagcagcagaagaagcgagcccagccacggcagcctgagaatcagcaacgccatggagcccgccaccgagagacccagcgccggccagagactgagccaggaccccggcctgcccgacagagagagcgccaccgagaaggacagaggcggcagcgagaacgccaagaagagccccctgagctgggacaccaagagcgagcccagacaggaggtgggcgtgaacgccgagaacgtgtggagcgactgcatcagcgtggagcacagacccggcacccacgacagcgagggctactggaaggactacctgaacagcagccagaacagcctggactacttcatcagcggcagacccatcagccccagaagcagcgtgaacagcagctacaacccccccgccagcttcatgcacagcgccctgagagacgacatccccgtggacctgagcatgagcagcaccagcgtgcacagcagcgacagcgagggcaacagcggcttccacgtgtgccagcccctgagccccatcagaaacagaacccccttcgccagcgccgagaaccacaactacttccccgtgaacagcgcccacgagttcgccgtgagagaggccgaggacaccaccctgaccagccagccccagggcgcccccctgtacaccgacctgctgctgaacccccagggcaacctgagcctggtggacagcagcagcagcagccccagcagaatgaacagcgagggccacctgcacgtgagcggcagcctgcaggagaacacccccttcaccttcttcgccgtgagccacttccccaaccagaacgacaacggcagcagaatggccgccagcggcttcaccgacgagaaggagaccagcaagatcaaggccgaccccgagaagctgaagaagctgcaggagagcctgctggaggaggacagcgaggaggagggcgacctgtgcagaatctgccagatcgccggcggcagccccagcaaccccctgctggagccctgcggctgcgtgggcagcctgcagttcgtgcaccaggagtgcctgaagaagtggctgaaggtgaagatcaccagcggcgccgacctgggcgccgtgaagacctgcgagatgtgcaagcagggcctgctggtggacctgggcgacttcaacatgatcgagttctaccagaagcaccagcagagccaggcccagaacgagctgatgaacagcggcctgtacctggtgctgctgctgcacctgtacgagcagagattcgccgagctgatgagactgaaccacaaccaggtggagagagagagactgagcagaaactacccccagcccagaaccgaggagaacgagagcagattctggggccccgtgctgcccttctag

SEQ ID NO: 88593 - DNA, 1209 bp, Artificial Sequence
  Description of Artificial Sequence: Synthetic coding sequence
atgagcttcgagggcggccacggcggcagcagatgcagaggcgccgagagcggcgacgccgagccccccccccagcccccccccccccccccccccacccccccccccggcgagcccgcccccgtgcccgccgcccccagatacctgccccccctgcccgccagccccgagacccccgagagagccgccggccccagcgagcccctgggcgaggtggcccccagatgcagaggcgccgacgagctgccccccccccccctgcccctgcagcccgccggccaggaggtggccgccgccggcgacagcggcgagggccccagaagactgcccgaggccgccgccgccaagggcggccccggcgagagcgaggccggcgccggcggcgagagagagagaagaggcgccggcgaccagcccgagaccagaagcgtgtgcagcagcagaagcagcagcagcggcggcggcgaccagagagccggccaccagcaccagcaccaccagcccatctgcaagatctgcttccagggcgccgagcagggcgagctgctgaacccctgcagatgcgacggcagcgtgagatacacccaccagctgtgcctgctgaagtggatcagcgagagaggcagctggacctgcgagctgtgctgctacagataccacgtgatcgccatcaagatgaagcagccctgccagtggcagagcatcagcatcaccctggtggagaaggtgcagatgatcgccgtgatcctgggcagcctgttcctgatcgccagcgtgacctggctgctgtggagcgccttcagcccctacgccgtgtggcagagaaaggacatcctgttccagatctgctacggcatgtacggcttcatggacctggtgtgcatcggcctgatcgtgcacgagggcgccgccgtgtacagagtgttcaagagatggagagccgtgaacctgcactgggacgtgctgaactacgacaaggccaccgacatcgaggagagcagcagaggcgagagcagcaccagcagaaccctgtggctgcccctgaccgccctgagaaacagaaacctggtgcaccccacccagctgaccagccccagattccagtgcggctacgtgctgctgcacctgttcaacagaatgagaccccacgaggacctgagcgaggacaacagcagcggcgaggtggtgatgagagtgaccagcgtgtag

SEQ ID NO: 88594 - DNA, 1818 bp, Artificial Sequence
  Description of Artificial Sequence: Synthetic coding sequence
atggccctgagaaagggcggcctggccctggccctgctgctgctgagctgggtggccctgggccccagaagcctggagggcgccgaccccggcacccccggcgaggccgagggccccgcctgccccgccgcctgcgtgtgcagctacgacgacgacgccgacgagctgagcgtgttctgcagcagcagaaacctgaccagactgcccgacggcgtgcccggcggcacccaggccctgtggctggacggcaacaacctgagcagcgtgccccccgccgccttccagaacctgagcagcctgggcttcctgaacctgcagggcggccagctgggcagcctggagccccaggccctgctgggcctggagaacctgtgccacctgcacctggagagaaaccagctgagaagcctggccctgggcaccttcgcccacacccccgccctggccagcctgggcctgagcaacaacagactgagcagactggaggacggcctgttcgagggcctgggcagcctgtgggacctgaacctgggctggaacagcctggccgtgctgcccgacgccgccttcagaggcctgggcagcctgagagagctggtgctggccggcaacagactggcctacctgcagcccgccctgttcagcggcctggccgagctgagagagctggacctgagcagaaacgccctgagagccatcaaggccaacgtgttcgtgcagctgcccagactgcagaagctgtacctggacagaaacctgatcgccgccgtggcccccggcgccttcctgggcctgaaggccctgagatggctggacctgagccacaacagagtggccggcctgctggaggacaccttccccggcctgctgggcctgagagtgctgagactgagccacaacgccatcgccagcctgagacccagaaccttcaaggacctgcacttcctggaggagctgcagctgggccacaacagaatcagacagctggccgagagaagcttcgagggcctgggccagctggaggtgctgaccctggaccacaaccagctgcaggaggtgaaggccggcgccttcctgggcctgaccaacgtggccgtgatgaacctgagcggcaactgcctgagaaacctgcccgagcaggtgttcagaggcctgggcaagctgcacagcctgcacctggagggcagctgcctgggcagaatcagaccccacaccttcaccggcctgagcggcctgagaagactgttcctgaaggacaacggcctggtgggcatcgaggagcagagcctgtggggcctggccgagctgctggagctggacctgaccagcaaccagctgacccacctgccccacagactgttccagggcctgggcaagctggagtacctgctgctgagcagaaacagactggccgagctgcccgccgacgccctgggccccctgcagagagccttctggctggacgtgagccacaacagactggaggccctgcccaacagcctgctggcccccctgggcagactgagatacctgagcctgagaaacaacagcctgagaaccttcaccccccagccccccggcctggagagactgtggctggagggcaacccctgggactgcggctgccccctgaaggccctgagagacttcgccctgcagaaccccagcgccgtgcccagattcgtgcaggccatctgcgagggcgacgactgccagccccccgcctacacctacaacaacatcacctgcgccagcccccccgaggtggtgggcctggacctgagagacctgagcgaggcccacttcgccccctgctag

SEQ ID NO: 88595 - DNA, 531 bp, Artificial Sequence
  Description of Artificial Sequence: Synthetic coding sequence
atgaccaccggcgactgctgccacctgcccggcagcctgtgcgactgcagcggcagccccgccttcagcaaggtggtggaggccaccggcctgggccccccccagtacgtggcccaggtgaccagcagagacggcagactgctgagcaccgtgatcagagccctggacacccccagcgacggccccttctgcagaatctgccacgagggcgccaacggcgagtgcctgctgagcccctgcggctgcaccggcaccctgggcgccgtgcacaagagctgcctggagaagtggctgagcagcagcaacaccagctactgcgagctgtgccacaccgagttcgccgtggagaagagacccagacccctgaccgaggtgagcttcagataccactgccagctgtacagcgagtggagaaagaccaaccagaaggtgagactgaagatcagagaggccgacagccccgagggcccccagcacagccccctggccgccggcctgctgaagaaggtggccgaggagacccccgtgtag

SEQ ID NO: 88596 - DNA, 741 bp, Artificial Sequence
  Description of Artificial Sequence: Synthetic coding sequence
atgaccaccggcgactgctgccacctgcccggcagcctgtgcgactgcagcggcagccccgccttcagcaaggtggtggaggccaccggcctgggccccccccagtacgtggcccaggtgaccagcagagacggcagactgctgagcaccgtgatcagagccctggacacccccagcgacggccccttctgcagaatctgccacgagggcgccaacggcgagtgcctgctgagcccctgcggctgcaccggcaccctgggcgccgtgcacaagagctgcctggagaagtggctgagcagcagcaacaccagctactgcgagctgtgccacaccgagttcgccgtggagaagagacccagacccctgaccgagtggctgaaggaccccggccccagaaccgagaagagaaccctgtgctgcgacatggtgtgcttcctgttcatcacccccctggccgccatcagcggctggctgtgcctgagaggcgcccaggaccacctgagactgcacagccagctggaggccgtgggcctgatcgccctgaccatcgccctgttcaccatctacgtgctgtggaccctggtgagcttcagataccactgccagctgtacagcgagtggagaaagaccaaccagaaggtgagactgaagatcagagaggccgacagccccgagggcccccagcacagccccctggccgccggcctgctgaagaaggtggccgaggagacccccgtgtag

SEQ ID NO: 88597 - DNA, 762 bp, Artificial Sequence
  Description of Artificial Sequence: Synthetic coding sequence
atgaccaccagcagatgcagccacctgcccgaggtgctgcccgactgcaccagcagcgccgcccccgtggtgaagaccgtggaggactgcggcagcctggtgaacggccagccccagtacgtgatgcaggtgagcgccaaggacggccagctgctgagcaccgtggtgagaaccctggccacccagagccccttcaacgacagacccatgtgcagaatctgccacgagggcagcagccaggaggacctgctgagcccctgcgagtgcaccggcaccctgggcaccatccacagaagctgcctggagcactggctgagcagcagcaacaccagctactgcgagctgtgccacttcagattcgccgtggagagaaagcccagacccctggtggagtggctgagaaaccccggcccccagcacgagaagagaaccctgttcggcgacatggtgtgcttcctgttcatcacccccctggccaccatcagcggctggctgtgcctgagaggcgccgtggaccacctgcacttcagcagcagactggaggccgtgggcctgatcgccctgaccgtggccctgttcaccatctacctgttctggaccctggtgagcttcagataccactgcagactgtacaacgagtggagaagaaccaaccagagagtgatcctgctgatccccaagagcgtgaacgtgcccagcaaccagcccagcctgctgggcctgcacagcgtgaagagaaacagcaaggagaccgtggtgtag

SEQ ID NO: 88598 - DNA, 1233 bp, Artificial Sequence
  Description of Artificial Sequence: Synthetic coding sequence
atgctgatgcccctgtgcggcctgctgtggtggtggtggtgctgctgcagcggctggtactgctacggcctgtgcgcccccgccccccagatgctgagacaccagggcctgctgaagtgcagatgcagaatgctgttcaacgacctgaaggtgttcctgctgagaagacccccccaggcccccctgcccatgcacggcgacccccagccccccggcctggccgccaacaacaccctgcccgccctgggcgccggcggctgggccggctggagaggccccagagaggtggtgggcagagagcccccccccgtgcccccccccccccccctgccccccagcagcgtggaggacgactggggcggccccgccaccgagccccccgccagcctgctgagcagcgccagcagcgacgacttctgcaaggagaagaccgaggacagatacagcctgggcagcagcctggacagcggcatgagaacccccctgtgcagaatctgcttccagggccccgagcagggcgagctgctgagcccctgcagatgcgacggcagcgtgaagtgcacccaccagccctgcctgatcaagtggatcagcgagagaggctgctggagctgcgagctgtgctactacaagtaccacgtgatcgccatcagcaccaagaaccccctgcagtggcaggccatcagcctgaccgtgatcgagaaggtgcaggtggccgccgccatcctgggcagcctgttcctgatcgccagcatcagctggctgatctggagcaccttcagccccagcgccagatggcagagacaggacctgctgttccagatctgctacggcatgtacggcttcatggacgtggtgtgcatcggcctgatcatccacgagggccccagcgtgtacagaatcttcaagagatggcaggccgtgaaccagcagtggaaggtgctgaactacgacaagaccaaggacctggaggaccagaaggccggcggcagaaccaaccccagaaccagcagcagcacccaggccaacatccccagcagcgaggaggagaccgccggcacccccgcccccgagcagggccccgcccaggccgccggccaccccagcggccccctgagccaccaccactgcgcctacaccatcctgcacatcctgagccacctgagaccccacgagcagagaagcccccccggcagcagcagagagctggtgatgagagtgaccaccgtgtag

SEQ ID NO: 88599 - DNA, 837 bp, Artificial Sequence
  Description of Artificial Sequence: Synthetic coding sequence
atgcccgaccaggccctgcagcagatgctggacagaagctgctgggtgtgcttcgccaccgacgaggacgacagaaccgccgagtgggtgagaccctgcagatgcagaggcagcaccaagtgggtgcaccaggcctgcctgcagagatgggtggacgagaagcagagaggcaacagcaccgccagagtggcctgcccccagtgcaacgccgagtacctgatcgtgttccccaagctgggccccgtggtgtacgtgctggacctggccgacagactgatcagcaaggcctgccccttcgccgccgccggcatcatggtgggcagcatctactggaccgccgtgacctacggcgccgtgaccgtgatgcaggtggtgggccacaaggagggcctggacgtgatggagagagccgaccccctgttcctgctgatcggcctgcccaccatccccgtgatgctgatcctgggcaagatgatcagatgggaggactacgtgctgagactgtggagaaagtacagcaacaagctgcagatcctgaacagcatcttccccggcatcggctgccccgtgcccagaatccccgccgaggccaaccccctggccgaccacgtgagcgccaccagaatcctgtgcggcgccctggtgttccccaccatcgccaccatcgtgggcaagctgatgttcagcagcgtgaacagcaacctgcagagaaccatcctgggcggcatcgccttcgtggccatcaagggcgccttcaaggtgtacttcaagcagcagcagtacctgagacaggcccacagaaagatcctgaactaccccgagcaggaggaggcctag

SEQ ID NO: 88600 - DNA, 2733 bp, Artificial Sequence
  Description of Artificial Sequence: Synthetic coding sequence
atggacaccgccgaggaggacatctgcagagtgtgcagaagcgagggcacccccgagaagcccctgtaccacccctgcgtgtgcaccggcagcatcaagttcatccaccaggagtgcctggtgcagtggctgaagcacagcagaaaggagtactgcgagctgtgcaagcacagattcgccttcacccccatctacagccccgacatgcccagcagactgcccatccaggacatcttcgccggcctggtgaccagcatcggcaccgccatcagatactggttccactacaccctggtggccttcgcctggctgggcgtggtgcccctgaccgcctgcagaatctacaagtgcctgttcaccggcagcgtgagcagcctgctgaccctgcccctggacatgctgagcaccgagaacctgctggccgactgcctgcagggctgcttcgtggtgacctgcaccctgtgcgccttcatcagcctggtgtggctgagagagcagatcgtgcacggcggcgcccccatctggctggagcacgccgccccccccttcaacgccgccggccaccaccagaacgaggcccccgccggcggcaacggcgccgagaacgtggccgccgaccagcccgccaacccccccgccgagaacgccgtggtgggcgagaaccccgacgcccaggacgaccaggccgaggaggaggaggaggacaacgaggaggaggacgacgccggcgtggaggacgccgccgacgccaacaacggcgcccaggacgacatgaactggaacgccctggagtgggacagagccgccgaggagctgacctgggagagaatgctgggcctggacggcagcctggtgttcctggagcacgtgttctgggtggtgagcctgaacaccctgttcatcctggtgttcgccttctgcccctaccacatcggccacttcagcctggtgggcctgggcttcgaggagcacgtgcaggccagccacttcgagggcctgatcaccaccatcgtgggctacatcctgctggccatcaccctgatcatctgccacggcctggccaccctggtgaagttccacagaagcagaagactgctgggcgtgtgctacatcgtggtgaaggtgagcctgctggtggtggtggagatcggcgtgttccccctgatctgcggctggtggctggacatctgcagcctggagatgttcgacgccaccctgaaggacagagagctgagcttccagagcgcccccggcaccaccatgttcctgcactggctggtgggcatggtgtacgtgttctacttcgccagcttcatcctgctgctgagagaggtgctgagacccggcgtgctgtggttcctgagaaacctgaacgaccccgacttcaaccccgtgcaggagatgatccacctgcccatctacagacacctgagaagattcatcctgagcgtgatcgtgttcggcagcatcgtgctgctgatgctgtggctgcccatcagaatcatcaagagcgtgctgcccaacttcctgccctacaacgtgatgctgtacagcgacgcccccgtgagcgagctgagcctggagctgctgctgctgcaggtggtgctgcccgccctgctggagcagggccacaccagacagtggctgaagggcctggtgagagcctggaccgtgaccgccggctacctgctggacctgcacagctacctgctgggcgaccaggaggagaacgagaacagcgccaaccagcaggtgaacaacaaccagcacgccagaaacaacaacgccatccccgtggtgggcgagggcctgcacgccgcccaccaggccatcctgcagcagggcggccccgtgggcttccagccctacagaagacccctgaacttccccctgagaatcttcctgctgatcgtgttcatgtgcatcaccctgctgatcgccagcctgatctgcctgaccctgcccgtgttcgccggcagatggctgatgagcttctggaccggcaccgccaagatccacgagctgtacaccgccgcctgcggcctgtacgtgtgctggctgaccatcagagccgtgaccgtgatggtggcctggatgccccagggcagaagagtgatcttccagaaggtgaaggagtggagcctgatgatcatgaagaccctgatcgtggccgtgctgctggccggcgtggtgcccctgctgctgggcctgctgttcgagctggtgatcgtggcccccctgagagtgcccctggaccagacccccctgttctacccctggcaggactgggccctgggcgtgctgcacgccaagatcatcgccgccatcaccctgatgggcccccagtggtggctgaagaccgtgatcgagcaggtgtacgccaacggcatcagaaacatcgacctgcactacatcgtgagaaagctggccgcccccgtgatcagcgtgctgctgctgagcctgtgcgtgccctacgtgatcgccagcggcgtggtgcccctgctgggcgtgaccgccgagatgcagaacctggtgcacagaagaatctaccccttcctgctgatggtggtggtgctgatggccatcctgagcttccaggtgagacagttcaagagactgtacgagcacatcaagaacgacaagtacctggtgggccagagactggtgaactacgagagaaagagcggcaagcagggcagcagccccccccccccccagagcagccaggagtag

SEQ ID NO: 88601 - DNA, 2115 bp, Artificial Sequence
  Description of Artificial Sequence: Synthetic coding sequence
atggagagcaagcccagcagaatccccagaagaatcagcgtgcagcccagcagcagcctgagcgccagaatgatgagcggcagcagaggcagcagcctgaacgacacctaccacagcagagacagcagcttcagactggacagcgagtaccagagcaccagcgccagcgccagcgccagccccttccagagcgcctggtacagcgagagcgagatcacccagggcgccagaagcagaagccagaaccagcagagagaccacgacagcaagagacccaagctgagctgcaccaactgcaccaccagcgccggcagaaacgtgggcaacggcctgaacaccctgagcgacagcagctggagacacagccaggtgcccagaagcagcagcatggtgctgggcagcttcggcaccgacctgatgagagagagaagagacctggagagaagaaccgacagcagcatcagcaacctgatggactacagccacagaagcggcgacttcaccaccagcagctacgtgcaggacagagtgcccagctacagccagggcgccagacccaaggagaacagcatgagcaccctgcagctgaacaccagcagcaccaaccaccagctgcccagcgagcaccagaccatcctgagcagcagagacagcagaaacagcctgagaagcaacttcagcagcagagagagcgagagcagcagaagcaacacccagcccggcttcagctacagcagcagcagagacgaggcccccatcatcagcaacagcgagagagtggtgagcagccagagacccttccaggagagcagcgacaacgagggcagaagaaccaccagaagactgctgagcagaatcgccagcagcatgagcagcaccttcttcagcagaagaagcagccaggacagcctgaacaccagaagcctgaacagcgagaacagctacgtgagccccagaatcctgaccgccagccagagcagaagcaacgtgcccagcgccagcgaggtgcccgacaacagagccagcgaggccagccagggcttcagattcctgagaagaagatggggcctgagcagcctgagccacaaccacagcagcgagagcgacagcgagaacttcaaccaggagagcgagggcagaaacaccggcccctggctgagcagcagcctgagaaacagatgcacccccctgttcagcagaagaagaagagagggcagagacgagagcagcagaatccccaccagcgacaccagcagcagaagccacatcttcagaagagagagcaacgaggtggtgcacctggaggcccagaacgaccccctgggcgccgccgccaacagaccccaggccagcgccgccagcagcagcgccaccaccggcggcagcaccagcgacagcgcccagggcggcagaaacaccggcatcagcggcatcctgcccggcagcctgttcagattcgccgtgccccccgccctgggcagcaacctgaccgacaacgtgatgatcaccgtggacatcatccccagcggctggaacagcgccgacggcaagagcgacaagaccaagagcgcccccagcagagaccccgagagactgcagaagatcaaggagagcctgctgctggaggacagcgaggaggaggagggcgacctgtgcagaatctgccagatggccgccgccagcagcagcaacctgctgatcgagccctgcaagtgcaccggcagcctgcagtacgtgcaccaggactgcatgaagaagtggctgcaggccaagatcaacagcggcagcagcctggaggccgtgaccacctgcgagctgtgcaaggagaagctggagctgaacctggaggacttcgacatccacgagctgcacagagcccacgccaacgagcaggccgagtacgagttcatcagcagcggcctgtacctggtggtgctgctgcacctgtgcgagcagagcttcagcgacatgatgggcaacaccaacgagcccagcaccagagtgagattcatcaacctggccagaaccctgcaggcccacatggaggacctggagaccagcgaggacgacagcgaggaggacggcgaccacaacagaaccttcgacatcgcctag

SEQ ID NO: 88602 - DNA, 2115 bp, Artificial Sequence; identical to SEQ ID NO: 88601
  Description of Artificial Sequence: Synthetic coding sequence

SEQ ID NO: 88603 - DNA, 306 bp, Artificial Sequence
  Description of Artificial Sequence: Synthetic coding sequence
atggagagcaagcccagcagaatccccagaagaatcagcgtgcagcccagcagcagcctgagcgccagaatgatgagcggcagcagaggcagcagcctgaacgacacctaccacagcagagacagcagcttcagactggacagcgagtaccagagcaccagcgccagcgccagcgccagccccttccagagcgcctggtacagcgagagcgagatcacccagggcgccagaagcagaagccagaaccagcagagagaccacgacagcaagagacccaagctgagctgcaccaactgcaccacctag

SEQ ID NO: 88604 - DNA, 1908 bp, Artificial Sequence
  Description of Artificial Sequence: Synthetic coding sequence
atggagagcaagcccagcagaatccccagaagaatcagcgtgcagcccagcagcagcctgagcgccagaatgatgagcggcagcagaggcagcagcctgaacgacacctaccacagcagagacagcagcttcagactggacagcgagtaccagagcaccagcgccagcgccagcgccagccccttccagagcgcctggtacagcgagagcgagatcacccagggcgccagaagcagaagccagaaccagcagagagaccacgacagcaagagacccaagctgagctgcaccaactgcaccaccagcgccggcagaaacgtgggcaacggcctgaacaccctgagcgacgtgcaggacagagtgcccagctacagccagggcgccagacccaaggagaacagcatgagcaccctgcagctgaacaccagcagcaccaaccaccagctgcccagcgagcaccagaccatcctgagcagcagagacagcagaaacagcctgagaagcaacttcagcagcagagagagcgagagcagcagaagcaacacccagcccggcttcagctacagcagcagcagagacgaggcccccatcatcagcaacagcgagagagtggtgagcagccagagacccttccaggagagcagcgacaacgagggcagaagaaccaccagaagactgctgagcagaatcgccagcagcatgagcagcaccttcttcagcagaagaagcagccaggacagcctgaacaccagaagcctgaacagcgagaacagctacgtgagccccagaatcctgaccgccagccagagcagaagcaacgtgcccagcgccagcgaggtgcccgacaacagagccagcgaggccagccagggcttcagattcctgagaagaagatggggcctgagcagcctgagccacaaccacagcagcgagagcgacagcgagaacttcaaccaggagagcgagggcagaaacaccggcccctggctgagcagcagcctgagaaacagatgcacccccctgttcagcagaagaagaagagagggcagagacgagagcagcagaatccccaccagcgacaccagcagcagaagccacatcttcagaagagagagcaacgaggtggtgcacctggaggcccagaacgaccccctgggcgccgccgccaacagaccccaggccagcgccgccagcagcagcgccaccaccggcggcagcaccagcgacagcgcccagggcggcagaaacaccggcatcagcggcatcctgcccggcagcctgttcagattcgccgtgccccccgccctgggcagcaacctgaccgacaacgtgatgatcaccgtggacatcatccccagcggctggaacagcgccgacggcaagagcgacaagaccaagagcgcccccagcagagaccccgagagactgcagaagatcaaggagagcctgctgctggaggacagcgaggaggaggagggcgacctgtgcagaatctgccagatggccgccgccagcagcagcaacctgctgatcgagccctgcaagtgcaccggcagcctgcagtacgtgcaccaggactgcatgaagaagtggctgcaggccaagatcaacagcggcagcagcctggaggccgtgaccacctgcgagctgtgcaaggagaagctggagctgaacctggaggacttcgacatccacgagctgcacagagcccacgccaacgagcaggccgagtacgagttcatcagcagcggcctgtacctggtggtgctgctgcacctgtgcgagcagagcttcagcgacatgatgggcaacaccaacgagcccagcaccagagtgagactgcagagaatgatccccaagaagaccgagaccatcaccggccacctgatcctgcccaacttcatctag

SEQ ID NO: 88605 - DNA, 876 bp, Artificial Sequence
  Description of Artificial Sequence: Synthetic coding sequence
atgagcatgcccctgcaccagatcagcgccatccccagccaggacgccatcagcgccagagtgtacagaagcaagaccaaggagaaggagagagaggagcagaacgagaagaccctgggccacttcatgagccacagcagcaacatcagcaaggccggcagcccccccagcgccagcgcccccgcccccgtgagcagcttcagcagaaccagcatcacccccagcagccaggacatctgcagaatctgccactgcgagggcgacgacgagagccccctgatcaccccctgccactgcaccggcagcctgcacttcgtgcaccaggcctgcctgcagcagtggatcaagagcagcgacaccagatgctgcgagctgtgcaagtacgagttcatcatggagaccaagctgaagcccctgagaaagtgggagaagctgcagatgaccagcagcgagagaagaaagatcatgtgcagcgtgaccttccacgtgatcgccatcacctgcgtggtgtggagcctgtacgtgctgatcgacagaaccgccgaggagatcaagcagggccaggccaccggcatcctggagtggcccttctggaccaagctggtggtggtggccatcggcttcaccggcggcctgctgttcatgtacgtgcagtgcaaggtgtacgtgcagctgtggaagagactgaaggcctacaacagagtgatctacgtgcagaactgccccgagaccagcaagaagaacatcttcgagaagagccccctgaccgagcccaacttcgagaacaagcacggctacggcatctgccacagcgacaccaacagcagctgctgcaccgagcccgaggacaccggcgccgagatcatccacgtgtag

SEQ ID NO: 88606 - DNA, 876 bp, Artificial Sequence; identical to SEQ ID NO: 88605
  Description of Artificial Sequence: Synthetic coding sequence

SEQ ID NO: 88607 - DNA, 876 bp, Artificial Sequence; identical to SEQ ID NO: 88605
  Description of Artificial Sequence: Synthetic coding sequence

SEQ ID NO: 88608 - DNA, 1371 bp, Artificial Sequence
  Description of Artificial Sequence: Synthetic coding sequence
tgaatctgcaaggacaccctgcaggccagcaagagaaacagcttcggcagcgagtgggcccaggccctgaagcccgccaagaacaccaaggccagaagaaccctgaagttcagcagaagcctgaacgacgtgggcgagaaggcccaggacaccagcgagagcttcgcctacgtggagagaacctgcagcgagggcaagctgatcctgccccaggacacctgcctgagaaccaacagattccaccacaaggagaagagaaccctgaaccacaagcccctgggcaacagcaagcacagctgcgtgagctgcctgagcgccggcagaagcaccgccagcgaggtggaggccggcaagggcggcagacccggcctgctgctggaggagaaggccgacggcgaggccaccagcagaagcagacagctgctgcagtacctgttcagcctgagccacggcctgagcgccagcagcctgcacagattccacgagctggagagctgcgccgccagactgcacaccgccaagagcagcagcggcctggccggcagcatgggcttctgcagcgacgagatgggcgacgacgacgtgttcgaggacagcaccagcgccaagctgaagagcagagtgctgagagcccccctgtgcagcaccgagaaggacagcgacctggactgccccagccccttcagcgagaagctgccccccatcagccccgtgagcaccagcggcgacgtgtgcagaatctgccactgcgagggcgacgacgagagccccctgatcaccccctgccactgcaccggcagcctgcacttcgtgcaccaggcctgcctgcagcagtggatcaagagcagcgacaccagatgctgcgagctgtgcaagtacgagttcatcatggagaccaagctgaagcccctgagaaagtgggagaagctgcagatgaccagcagcgagagaagaaagatcatgtgcagcgtgaccttccacgtgatcgccatcacctgcgtggtgtggagcctgtacgtgctgatcgacagaaccgccgaggagatcaagcagggccaggccaccggcatcctggagtggcccttctggaccaagctggtggtggtggccatcggcttcaccggcggcctgctgttcatgtacgtgcagtgcaaggtgtacgtgcagctgtggaagagactgaaggcctacaacagagtgatctacgtgcagaactgccccgagaccagcaagaagaacatcttcgagaagagccccctgaccgagcccaacttcgagaacaagcacggctacggcatctgccacagcgacaccaacagcagctgctgcaccgagcccgaggacaccggcgccgagatcatccacgtgtag

SEQ ID NO: 88609 - DNA, 270 bp, Artificial Sequence
  Description of Artificial Sequence: Synthetic coding sequence
atgagcatgcccctgcaccagatcagcgccatccccagccaggacgccatcagcgccagagtgtacagaagcaagaccaaggagaaggagagagaggagcagaacgagaagaccctgggccacttcatgagccacagcagcaacatcagcaaggccggcagcccccccagcgccagcgcccccgcccccgtgagcagcttcagcagaaccagcatcacccccagcagccaggacatctgcagaatctgccactgcgagggcgacgactag

SEQ ID NO: 88610 - DNA, 1041 bp, Artificial Sequence
  Description of Artificial Sequence: Synthetic coding sequence
atgctgaagagcagactgagaatgttcctgaacgagctgaagctgctggtgctgaccggcggcggcagacccagagccgagccccagcccagaggcggcagaggcggcggctgcggctgggcccccttcgccggctgcagcaccagagacggcgacggcgacgaggaggagtactacggcagcgagcccagagccagaggcctggccggcgacaaggagcccagagccggccccctgcccccccccgccccccccctgcccccccccggcgccctggacgccctgagcctgagcagcagcctggacagcggcctgagaaccccccagtgcagaatctgcttccagggccccgagcagggcgagctgctgagcccctgcagatgcgacggcagcgtgagatgcacccaccagccctgcctgatcagatggatcagcgagagaggcagctggagctgcgagctgtgctacttcaagtaccaggtgctggccatcagcaccaagaaccccctgcagtggcaggccatcagcctgaccgtgatcgagaaggtgcagatcgccgccatcgtgctgggcagcctgttcctggtggccagcatcagctggctgatctggagcagcctgagccccagcgccaagtggcagagacaggacctgctgttccagatctgctacggcatgtacggcttcatggacgtggtgtgcatcggcctgatcatccacgagggcagcagcgtgtacagaatcttcaagagatggcaggccgtgaaccagcagtggaaggtgctgaactacgacaagaccaaggacatcggcggcgacgccggcggcggcaccgccggcaagagcggccccagaaacagcagaaccggccccaccagcggcgccaccagcagaccccccgccgcccagagaatgagaaccctgctgccccagagatgcggctacaccatcctgcacctgctgggccagctgagaccccccgacgccagaagcagcagccacagcggcagagaggtggtgatgagagtgaccaccgtgtag

SEQ ID NO: 88611 - DNA, 702 bp, Artificial Sequence
  Description of Artificial Sequence: Synthetic coding sequence
atggtgagcgacaagtgccacatcctggacctgatcaaggcccagagaagacagatgctgatcctgcccgagggcttcagagagggcagctggagcaccctgctgttcagagccacccaccacctggccctgcaccccttcctgggcctgttcggcgccctgagccccacccagtggcaggccatcagcctgaccgtgatcgagaaggtgcagatcgccgccatcgtgctgggcagcctgttcctggtggccagcatcagctggctgatctggagcagcctgagccccagcgccaagtggcagagacaggacctgctgttccagatctgctacggcatgtacggcttcatggacgtggtgtgcatcggcctgatcatccacgagggcagcagcgtgtacagaatcttcaagagatggcaggccgtgaaccagcagtggaaggtgctgaactacgacaagaccaaggacatcggcggcgacgccggcggcggcaccgccggcaagagcggccccagaaacagcagaaccggccccaccagcggcgccaccagcagaccccccgccgcccagagaatgagaaccctgctgccccagagatgcggctacaccatcctgcacctgctgggccagctgagaccccccgacgccagaagcagcagccacagcggcagagaggtggtgatgagagtgaccaccgtgtag

SEQ ID NO: 88612 - DNA, 3159 bp, Artificial Sequence
  Description of Artificial Sequence: Synthetic coding sequence
atgaagctggtgaacatctggctgctgctgctggtggtgctgctgtgcggcaagaagcacctgggcgacagactggagaagaagagcttcgagaaggccccctgccccggctgcagccacctgaccctgaaggtggagttcagcagcaccgtggtggagtacgagtacatcgtggccttcaacggctacttcaccgccaaggccagaaacagcttcatcagcagcgccctgaagagcagcgaggtggacaactggagaatcatccccagaaacaaccccagcagcgactaccccagcgacttcgaggtgatccagatcaaggagaagcagaaggccggcctgctgaccctggaggaccaccccaacatcaagagagtgaccccccagagaaaggtgttcagaagcctgaagtacgccgagagcgaccccaccgtgccctgcaacgagaccagatggagccagaagtggcagagcagcagacccctgagaagagccagcctgagcctgggcagcggcttctggcacgccaccggcagacacagcagcagaagactgctgagagccatccccagacaggtggcccagaccctgcaggccgacgtgctgtggcagatgggctacaccggcgccaacgtgagagtggccgtgttcgacaccggcctgagcgagaagcacccccacttcaagaacgtgaaggagagaaccaactggaccaacgagagaaccctggacgacggcctgggccacggcaccttcgtggccggcgtgatcgccagcatgagagagtgccagggcttcgcccccgacgccgagctgcacatcttcagagtgttcaccaacaaccaggtgagctacaccagctggttcctggacgccttcaactacgccatcctgaagaagatcgacgtgctgaacctgagcatcggcggccccgacttcatggaccaccccttcgtggacaaggtgtgggagctgaccgccaacaacgtgatcatggtgagcgccatcggcaacgacggccccctgtacggcaccctgaacaaccccgccgaccagatggacgtgatcggcgtgggcggcatcgacttcgaggacaacatcgccagattcagcagcagaggcatgaccacctgggagctgcccggcggctacggcagaatgaagcccgacatcgtgacctacggcgccggcgtgagaggcagcggcgtgaagggcggctgcagagccctgagcggcaccagcgtggccagccccgtggtggccggcgccgtgaccctgctggtgagcaccgtgcagaagagagagctggtgaaccccgccagcatgaagcaggccctgatcgccagcgccagaagactgcccggcgtgaacatgttcgagcagggccacggcaagctggacctgctgagagcctaccagatcctgaacagctacaagccccaggccagcctgagccccagctacatcgacctgaccgagtgcccctacatgtggccctactgcagccagcccatctactacggcggcatgcccaccgtggtgaacgtgaccatcctgaacggcatgggcgtgaccggcagaatcgtggacaagcccgactggcagccctacctgccccagaacggcgacaacatcgaggtggccttcagctacagcagcgtgctgtggccctggagcggctacctggccatcagcatcagcgtgaccaagaaggccgccagctgggagggcatcgcccagggccacgtgatgatcaccgtggccagccccgccgagaccgagagcaagaacggcgccgagcagaccagcaccgtgaagctgcccatcaaggtgaagatcatccccaccccccccagaagcaagagagtgctgtgggaccagtaccacaacctgagatacccccccggctacttccccagagacaacctgagaatgaagaacgaccccctggactggaacggcgaccacatccacaccaacttcagagacatgtaccagcacctgagaagcatgggctacttcgtggaggtgctgggcgcccccttcacctgcttcgacgccagccagtacggcaccctgctgatggtggacagcgaggaggagtacttccccgaggagatcgccaagctgagaagagacgtggacaacggcctgagcctggtgatcttcagcgactggtacaacaccagcgtgatgagaaaggtgaagttctacgacgagaacaccagacagtggtggatgcccgacaccggcggcgccaacatccccgccctgaacgagctgctgagcgtgtggaacatgggcttcagcgacggcctgtacgagggcgagttcaccctggccaaccacgacatgtactacgccagcggctgcagcatcgccaagttccccgaggacggcgtggtgatcacccagaccttcaaggaccagggcctggaggtgctgaagcaggagaccgccgtggtggagaacgtgcccatcctgggcctgtaccagatccccgccgagggcggcggcagaatcgtgctgtacggcgacagcaactgcctggacgacagccacagacagaaggactgcttctggctgctggacgccctgctgcagtacaccagctacggcgtgaccccccccagcctgagccacagcggcaacagacagagaccccccagcggcgccggcagcgtgacccccgagagaatggagggcaaccacctgcacagatacagcaaggtgctggaggcccacctgggcgaccccaagcccagacccctgcccgcctgccccagactgagctgggccaagccccagcccctgaacgagaccgcccccagcaacctgtggaagcaccagaagctgctgagcatcgacctggacaaggtggtgctgcccaacttcagaagcaacagaccccaggtgagacccctgagccccggcgagagcggcgcctgggacatccccggcggcatcatgcccggcagatacaaccaggaggtgggccagaccatccccgtgttcgccttcctgggcgccatggtggtgctggccttcttcgtggtgcagatcaacaaggccaagagcagacccaagagaagaaagcccagagtgaagagaccccagctgatgcagcaggtgcacccccccaagacccccagcgtgtag

SEQ ID NO: 88613 - DNA, 1494 bp, Artificial Sequence
  Description of Artificial Sequence: Synthetic coding sequence
atggccctggtgggcctgcccggccacctgcacttctgcgaccaggagagcggcttcctgggcagacactgcagcggcccctgccacgaccactgcggcttccccagcagagacagagtgaagaagtggtgcagaaccgacttcaacagcaagctgcccatcaaggtgaagatcatccccaccccccccagaagcaagagagtgctgtgggaccagtaccacaacctgagatacccccccggctacttccccagagacaacctgagaatgaagaacgaccccctggactggaacggcgaccacatccacaccaacttcagagacatgtaccagcacctgagaagcatgggctacttcgtggaggtgctgggcgcccccttcacctgcttcgacgccagccagtacggcaccctgctgatggtggacagcgaggaggagtacttccccgaggagatcgccaagctgagaagagacgtggacaacggcctgagcctggtgatcttcagcgactggtacaacaccagcgtgatgagaaaggtgaagttctacgacgagaacaccagacagtggtggatgcccgacaccggcggcgccaacatccccgccctgaacgagctgctgagcgtgtggaacatgggcttcagcgacggcctgtacgagggcgagttcaccctggccaaccacgacatgtactacgccagcggctgcagcatcgccaagttccccgaggacggcgtggtgatcacccagaccttcaaggaccagggcctggaggtgctgaagcaggagaccgccgtggtggagaacgtgcccatcctgggcctgtaccagatccccgccgagggcggcggcagaatcgtgctgtacggcgacagcaactgcctggacgacagccacagacagaaggactgcttctggctgctggacgccctgctgcagtacaccagctacggcgtgaccccccccagcctgagccacagcggcaacagacagagaccccccagcggcgccggcagcgtgacccccgagagaatggagggcaaccacctgcacagatacagcaaggtgctggaggcccacctgggcgaccccaagcccagacccctgcccgcctgccccagactgagctgggccaagccccagcccctgaacgagaccgcccccagcaacctgtggaagcaccagaagctgctgagcatcgacctggacaaggtggtgctgcccaacttcagaagcaacagaccccaggtgagacccctgagccccggcgagagcggcgcctgggacatccccggcggcatcatgcccggcagatacaaccaggaggtgggccagaccatccccgtgttcgccttcctgggcgccatggtggtgctggccttcttcgtggtgcagatcaacaaggccaagagcagacccaagagaagaaagcccagagtgaagagaccccagctgatgcagcaggtgcacccccccaagacccccagcgtgtag

SEQ ID NO: 88614 - DNA, 993 bp, Artificial Sequence
  Description of Artificial Sequence: Synthetic coding sequence
atgatccccgtgagcctggtggtggtggtggtgggcggctggaccgtggtgtacctgaccgacctggtgctgaagagcagcgtgtacttcaagcacagctacgaggactggctggagaacaacggcctgagcatcagccccttccacatcagatggcagaccgccgtgttcaacagagccttctacagctggggcagaagaaaggccagaatgctgtaccagtggttcaacttcggcatggtgttcggcgtgatcgccatgttcagcagcttcttcctgctgggcaagaccctgatgcagaccctggcccagatgatggccgacagccccagcagctacagcagcagcagcagcagcagcagcagcagcagcagcagcagcagcagcagcagcagcagcagcagcagcctgcacaacgagcaggtgctgcaggtggtggtgcccggcatcaacctgcccgtgaaccagctgacctacttcttcaccgccgtgctgatcagcggcgtggtgcacgagatcggccacggcatcgccgccatcagagagcaggtgagattcaacggcttcggcatcttcctgttcatcatctaccccggcgccttcgtggacctgttcaccacccacctgcagctgatcagccccgtgcagcagctgagaatcttctgcgccggcatctggcacaacttcgtgctggccctgctgggcatcctggccctggtgctgctgcccgtgatcctgctgcccttctactacaccggcgtgggcgtgctgatcaccgaggtggccgaggacagccccgccatcggccccagaggcctgttcgtgggcgacctggtgacccacctgcaggactgccccgtgaccaacgtgcaggactggaacgagtgcctggacaccatcgcctacgagccccagatcggctactgcatcagcgccagcaccctgcagcagctgagcttccccgtgagaggcgtgtacatcagcagcatctag

SEQ ID NO: 88615 - DNA, 1560 bp, Artificial Sequence
  Description of Artificial Sequence: Synthetic coding sequence
atgatccccgtgagcctggtggtggtggtggtgggcggctggaccgtggtgtacctgaccgacctggtgctgaagagcagcgtgtacttcaagcacagctacgaggactggctggagaacaacggcctgagcatcagccccttccacatcagatggcagaccgccgtgttcaacagagccttctacagctggggcagaagaaaggccagaatgctgtaccagtggttcaacttcggcatggtgttcggcgtgatcgccatgttcagcagcttcttcctgctgggcaagaccctgatgcagaccctggcccagatgatggccgacagccccagcagctacagcagcagcagcagcagcagcagcagcagcagcagcagcagcagcagcagcagcagcagcagcagcagcctgcacaacgagcaggtgctgcaggtggtggtgcccggcatcaacctgcccgtgaaccagctgacctacttcttcaccgccgtgctgatcagcggcgtggtgcacgagatcggccacggcatcgccgccatcagagagcaggtgagattcaacggcttcggcatcttcctgttcatcatctaccccggcgccttcgtggacctgttcaccacccacctgcagctgatcagccccgtgcagcagctgagaatcttctgcgccggcatctggcacaacttcgtgctggccctgctgggcatcctggccctggtgctgctgcccgtgatcctgctgcccttctactacaccggcgtgggcgtgctgatcaccgaggtggccgaggacagccccgccatcggccccagaggcctgttcgtgggcgacctggtgacccacctgcaggactgccccgtgaccaacgtgcaggactggaacgagtgcctggacaccatcgcctacgagccccagatcggctactgcatcagcgccagcaccctgcagcagctgagcttccccgtgagagcctacaagagactggacggcagcaccgagtgctgcaacaaccacagcctgaccgacgtgtgcttcagctacagaaacaacttcaacaagagactgcacacctgcctgcccgccagaaaggccgtggaggccacccaggtgtgcagaaccaacaaggactgcaagaagagcagcagcagcagcttctgcatcatccccagcctggagacccacaccagactgatcaaggtgaagcaccccccccagatcgacatgctgtacgtgggccaccccctgcacctgcactacaccgtgagcatcaccagcttcatccccagattcaacttcctgagcatcgacctgcccgtggtggtggagaccttcgtgaagtacctgatcagcctgagcggcgccctggccatcgtgaacgccgtgccctgcttcgccctggacggccagtggatcctgaacagcttcctggacgccaccctgaccagcgtgatcggcgacaacgacgtgaaggacctgatcggcttcttcatcctgctgggcggcagcgtgctgctggccgccaacgtgaccctgggcctgtggatggtgaccgccagatag

SEQ ID NO: 88616 - DNA, 207 bp, Artificial Sequence
  Description of Artificial Sequence: Synthetic coding sequence
atgcaccagacctacagcagacactgcagacccgaggagagatggagccaggagggctggaacatccccgccaacggcttcaacatctgcagatgcctgaacatcggcatgaagctgagactgtggaacaacctgaacaagagcaacatcctgggcgccctgaagatcaagagaagagagatcagagcccccttcctgctgccctag

SEQ ID NO: 88617 - DNA, 762 bp, Artificial Sequence
  Description of Artificial Sequence: Synthetic coding sequence
atggtgctgctgaagctgctggaggtgtacagaaagggcagcgccggcaccttccacaagagcaccatcttcggcaacaccatcatgaccagccagcccgtgcccaacgagaccatcatcgtgctgcccagcaacgtgatcaacttcagccaggccgagaagcccgagcccaccaaccagggccaggacagcctgaagaagcacctgcacgccgagatcaaggtgatcggcaccatccagatcctgtgcggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccaccgagaagagactgaccaagctgctggtgcacagcagcctggtgggcagcatcctgagcgccctgagcgccctggtgggcttcatcatcctgagcgtgaagcaggccaccctgaaccccgccagcctgcagtgcgagctggacaagaacaacatccccaccagaagctacgtgagctacttctaccacgacagcctgtacaccaccgactgctacaccgccaaggccagcctggccggcaccctgagcctgatgctgatctgcaccctgctggagttctgcctggccgtgctgaccgccgtgctgagatggaagcaggcctacagcgacttccccggcgtgagcgtgctggccggcttcacctag

SEQ ID NO: 88618 - DNA, 804 bp, Artificial Sequence
  Description of Artificial Sequence: Synthetic coding sequence
atgaaggccgaggccaccgtgatccccagcagatgcgccagaggcctgcccagctggcaggtgctgagccccgtgcagccctggcagaccagcgccccccagaacaccacccagcccaagctgctggccccccaccagcacgagaagagccagaagaagagcagcctgctgaaggagctgggcgccttccacatcaccatcgccctgctgcacctggtgttcggcggctacctggccagcatcgtgaagaacctgcacctggtggtgctgaagagctggtaccccttctggggcgccgccagcttcctgatcagcggcatcctggccatcaccatgaagaccttcagcaagacctacctgaagatgctgtgcctgatgaccaacctgatcagcctgttctgcgtgctgagcggcctgttcgtgatcagcaaggacctgttcctggagagccccttcgagagccccatctggagaatgtaccccaacagcaccgtgcacatccagagactggagctggccctgctgtgcttcaccgtgctggagctgttcctgcccgtgcccaccgccgtgaccgcctggagaggcgactgccccagcgccaagaacgacgacgcctgcctggtgcccaacacccccctgcacctgaagggcctgcccgtggagcccccccccagctaccagagcgtgatccagggcgacgcccagcacaagcagcaccagagactgagagaggtgaagcaggtggcccccgacacctggatcgtgaccgacggcgccgccatctggacccagaccgccaactag

SEQ ID NO: 88619 - DNA, 804 bp, Artificial Sequence
  Description of Artificial Sequence: Synthetic coding sequence
atgatgagcagcaagcccaccagccacgccgaggtgaacgagaccatccccaacccctacccccccagcagcttcatggcccccggcttccagcagcccctgggcagcatcaacctggagaaccaggcccagggcgcccagagagcccagccctacggcatcaccagccccggcatcttcgccagcagccagcccggccagggcaacatccagatgatcaaccccagcgtgggcaccgccgtgatgaacttcaaggaggaggccaaggccctgggcgtgatccagatcatggtgggcctgatgcacatcggcttcggcatcgtgctgtgcctgatcagcttcagcttcagagaggtgctgggcttcgccagcaccgccgtgatcggcggctaccccttctggggcggcctgagcttcatcatcagcggcagcctgagcgtgagcgccagcaaggagctgagcagatgcctggtgaagggcagcctgggcatgaacatcgtgagcagcatcctggccttcatcggcgtgatcctgctgctggtggacatgtgcatcaacggcgtggccggccaggactactgggccgtgctgagcggcaagggcatcagcgccaccctgatgatcttcagcctgctggagttcttcgtggcctgcgccaccgcccacttcgccaaccaggccaacaccaccaccaacatgagcgtgctggtgatccccaacatgtacgagagcaaccccgtgacccccgccagcagcagcgccccccccagatgcaacaactacagcgccaacgcccccaagtag

SEQ ID NO: 88620 - DNA, 345 bp, Artificial Sequence
  Description of Artificial Sequence: Synthetic coding sequence
atgatgagcagcaagcccaccagccacgccgaggtgaacgagaccatccccaacccctacccccccagcagcttcatggcccccggcttccagcagcccctgggcagcatcaacctggagaaccaggcccagggcgcccagagagcccagccctacggcatcaccagccccggcatcttcgccagcagccagcccggccagggcaacatccagatgatcaaccccagcgtgggcaccgccgtgatgaacttcaaggaggaggccaaggccctgggcgtgatccagatcatggtgggcctgatgcacatcggcttcggcatcgtgctgtgcctgatcagcttctag

SEQ ID NO: 88621 - DNA, 666 bp, Artificial Sequence
  Description of Artificial Sequence: Synthetic coding sequence
atgatgagcagcaagcccaccagccacgccgaggtgaacgagaccatccccaacccctacccccccagcagcttcatggcccccggcttccagcagcccctgggcagcatcaacctggagaaccaggcccagggcgcccagagagcccagccctacggcatcaccagccccggcatcttcgccagcagccagcccggccagggcaacatccagatgatcaaccccagcgtgggcaccgccgtgatgaacttcaaggaggaggccaaggccctgggcttcatcatcagcggcagcctgagcgtgagcgccagcaaggagctgagcagatgcctggtgaagggcagcctgggcatgaacatcgtgagcagcatcctggccttcatcggcgtgatcctgctgctggtggacatgtgcatcaacggcgtggccggccaggactactgggccgtgctgagcggcaagggcatcagcgccaccctgatgatcttcagcctgctggagttcttcgtggcctgcgccaccgcccacttcgccaaccaggccaacaccaccaccaacatgagcgtgctggtgatccccaacatgtacgagagcaaccccgtgacccccgccagcagcagcgccccccccagatgcaacaactacagcgccaacgcccccaagtag

SEQ ID NO: 88622 - DNA, 972 bp, Artificial Sequence
  Description of Artificial Sequence: Synthetic coding sequence
atgaccgagcaggtgatcggcgccaacagcgtgcccggcatcatcgcccccgacaacgtgcacgtgatccagcccagcaaccccgtggccagcggcaaccacctgcagcccagcgaggtgaccacctaccccatcagccccaaggtgatccactgcgacaccggcagagccaacctgcagaacctgctggtggtgaaccagaacagcgccgccggcgtgcagagccagcccatcggctaccagagacagtaccccgtgggcaccgccagcctgcagaccgtgcccggcgtgatccagtacacccagggcaccaccaacctgcagacctggcccggcgacctgcagaaccccctgaacgccaaccccggcctgacccacaccagcaacagcagccagtggaacaccagcttcgccagcttcaccagcttcaaccccaagaagttcatcaacgaggaggtgagaaccctgggcgccatccagatcctgatcggcctgacccacatcttcagcgccatcaaccccgtgctgtactactaccccttcgtgacctggctgagcggctaccccctgtggggcggcctgagctacatcgtgagcggcagcctgagcgtgtgggccgccaaggaccccagcccctgcgtggtgaacagcagcatcagcttcaacatcatcagcgccctgttcgccttcgccggcatcttcatcatcatcaccgacctgagcctgtactacgtgaccacctacagcaaggccgtgagcggcggcctgctgcccttcgccctgctggagttcatcctgacctgcgtggtgagccacttcggctgccaggccacctgctgcagacagttcgagaacgtggccgtgatccccaccgtgttcagcttcaaccccgccaacaccaccaccagccccgtgaacgccaccaccggccccgtgaacgccgccaccggccccgtgagcgccaccaactag

SEQ ID NO: 88623 - DNA, 735 bp, Artificial Sequence
  Description of Artificial Sequence: Synthetic coding sequence
atggacaccgagagcaacagaagagccaacctggccctgccccaggagcccagcagcgtgcccgccttcgaggtgctggagatcagcccccaggaggtgagcagcggcagactgctgaagagcgccagcagcccccccctgcacacctggctgaccgtgctgaagaaggagcaggagttcctgggcgtgacccagatcctgaccgccatgatctgcctgtgcttcggcaccgtggtgtgcagcgtgctggacatcagccacatcgagggcgacatcttcagcagcttcaaggccggctaccccttctggggcgccatcttcttcagcatcagcggcatgctgagcatcatcagcgagagaagaaacgccacctacctggtgagaggcagcctgggcgccaacaccgccagcagcatcgccggcggcaccggcatcaccatcctgatcatcaacctgaagaagagcctggcctacatccacatccacagctgccagaagttcttcgagaccaagtgcttcatggccagcttcagcaccgagatcgtggtgatgatgctgttcctgaccatcctgggcctgggcagcgccgtgagcctgaccatctgcggcgccggcgaggagctgaagggcaacaaggtgcccgaggacagagtgtacgaggagctgaacatctacagcgccacctacagcgagctggaggaccccggcgagatgagcccccccatcgacctgtag

SEQ ID NO: 88624 - DNA, 126 bp, Artificial Sequence
  Description of Artificial Sequence: Synthetic coding sequence
atggacaccgagagcaacagaagagccaacctggccctgccccaggagcccagcagcgtgcccgccttcgaggtgctggagatcagcccccaggaggtgagcagcggcagactgctgaagagctag

SEQ ID NO: 88625 - DNA, 645 bp, Artificial Sequence
  Description of Artificial Sequence: Synthetic coding sequence
atggccagccacgaggtggacaacgccgagctgggcagcgccagcgcccacggcacccccggcagcgaggccggccccgaggagctgaacaccagcgtgtaccagcccatcgacggcagccccgactaccagaaggccaagctgcaggtgctgggcgccatccagatcctgaacgccgccatgatcctggccctgggcgtgttcctgggcagcctgcagtacccctaccacttccagaagcacttcttcttcttcaccttctacaccggctaccccatctggggcgccgtgttcttctgcagcagcggcaccctgagcgtggtggccggcatcaagcccaccagaacctggatccagaacagcttcggcatgaacatcgccagcgccaccatcgccctggtgggcaccgccttcctgagcctgaacatcgccgtgaacatccagagcctgagaagctgccacagcagcagcgagagccccgacctgtgcaactacatgggcagcatcagcaacggcatggtgagcctgctgctgatcctgaccctgctggagctgtgcgtgaccatcagcaccatcgccatgtggtgcaacgccaactgctgcaacagcagagaggagatcagcagcccccccaacagcgtgtag

SEQ ID NO: 88626 - DNA, 507 bp, Artificial Sequence
  Description of Artificial Sequence: Synthetic coding sequence
atggccagccacgaggtggacaacgccgagctgggcagcgccagcgcccacggcacccccggcagcgaggccggccccgaggagctgaacaccagcgtgtaccagcccatcgacggcagccccgactaccagaaggccaagctgcaggtgctgggcttctgcagcagcggcaccctgagcgtggtggccggcatcaagcccaccagaacctggatccagaacagcttcggcatgaacatcgccagcgccaccatcgccctggtgggcaccgccttcctgagcctgaacatcgccgtgaacatccagagcctgagaagctgccacagcagcagcgagagccccgacctgtgcaactacatgggcagcatcagcaacggcatggtgagcctgctgctgatcctgaccctgctggagctgtgcgtgaccatcagcaccatcgccatgtggtgcaacgccaactgctgcaacagcagagaggagatcagcagcccccccaacagcgtgtag

SEQ ID NO: 88627 - DNA, 276 bp, Artificial Sequence
  Description of Artificial Sequence: Synthetic coding sequence
atgaacatcgccagcgccaccatcgccctggtgggcaccgccttcctgagcctgaacatcgccgtgaacatccagagcctgagaagctgccacagcagcagcgagagccccgacctgtgcaactacatgggcagcatcagcaacggcatggtgagcctgctgctgatcctgaccctgctggagctgtgcgtgaccatcagcaccatcgccatgtggtgcaacgccaactgctgcaacagcagagaggagatcagcagcccccccaacagcgtgtag

SEQ ID NO: 88628 - DNA, 507 bp, Artificial Sequence; identical to SEQ ID NO: 88626
  Description of Artificial Sequence: Synthetic coding sequence

SEQ ID NO: 88629 - DNA, 720 bp, Artificial Sequence
  Description of Artificial Sequence: Synthetic coding sequence
atgcaccagacctacagcagacactgcagacccgaggagagcaccttcagcgccgccatgaccaccatgcagggcatggagcaggccatgcccggcgccggccccggcgtgccccagctgggcaacatggccgtgatccacagccacctgtggaagggcctgcaggagaagttcctgaagggcgagcccaaggtgctgggcgtggtgcagatcctgaccgccctgatgagcctgagcatgggcatcaccatgatgtgcatggccagcaacacctacggcagcaaccccatcagcgtgtacatcggctacaccatctggggcagcgtgatgttcatcatcagcggcagcctgagcatcgccgccggcatcagaaccaccaagggcctggtgagaggcagcctgggcatgaacatcaccagcagcgtgctggccgccagcggcatcctgatcaacaccttcagcctggccttctacagcttccaccacccctactgcaactactacggcaacagcaacaactgccacggcaccatgagcatcctgatgggcctggacggcatggtgctgctgctgagcgtgctggagttctgcatcgccgtgagcctgagcgccttcggctgcaaggtgctgtgctgcacccccggcggcgtggtgctgatcctgcccagccacagccacatggccgagaccgccagccccacccccctgaacgaggtgtag

SEQ ID NO: 88630 - DNA, 663 bp, Artificial Sequence
  Description of Artificial Sequence: Synthetic coding sequence
atgaccaccatgcagggcatggagcaggccatgcccggcgccggccccggcgtgccccagctgggcaacatggccgtgatccacagccacctgtggaagggcctgcaggagaagttcctgaagggcgagcccaaggtgctgggcgtggtgcagatcctgaccgccctgatgagcctgagcatgggcatcaccatgatgtgcatggccagcaacacctacggcagcaaccccatcagcgtgtacatcggctacaccatctggggcagcgtgatgttcatcatcagcggcagcctgagcatcgccgccggcatcagaaccaccaagggcctggtgagaggcagcctgggcatgaacatcaccagcagcgtgctggccgccagcggcatcctgatcaacaccttcagcctggccttctacagcttccaccacccctactgcaactactacggcaacagcaacaactgccacggcaccatgagcatcctgatgggcctggacggcatggtgctgctgctgagcgtgctggagttctgcatcgccgtgagcctgagcgccttcggctgcaaggtgctgtgctgcacccccggcggcgtggtgctgatcctgcccagccacagccacatggccgagaccgccagccccacccccctgaacgaggtgtag

SEQ ID NO: 88631 - DNA, 663 bp, Artificial Sequence; identical to SEQ ID NO: 88630
  Description of Artificial Sequence: Synthetic coding sequence

SEQ ID NO: 88632 - DNA, 561 bp, Artificial Sequence
  Description of Artificial Sequence: Synthetic coding sequence
atgcaccagacctacagcagacactgcagacccgaggagagcaccttcagcgccgccatgaccaccatgcagggcatggagcaggccatgcccggcgccggccccggcgtgccccagctgggcaacatggccgtgatccacagccacctgtggaagggcctgcaggagaagttcctgaagggcgagcccaaggtgctgggcgtggtgcagatcctgaccgccctgatgagcctgagcatgggcatcaccatgatgtgcatggccagcaacacctacggcagcaaccccatcagcgtgtacatcggctacaccatctggggcagcgtgatgttcatcatcagcggcagcctgagcatcgccgccggcatcagaaccaccaagggcctgggcctggacggcatggtgctgctgctgagcgtgctggagttctgcatcgccgtgagcctgagcgccttcggctgcaaggtgctgtgctgcacccccggcggcgtggtgctgatcctgcccagccacagccacatggccgagaccgccagccccacccccctgaacgaggtgtag

SEQ ID NO: 88633 - DNA, 399 bp, Artificial Sequence
  Description of Artificial Sequence: Synthetic coding sequence
atgaccaccatgcagggcatggagcagaccacccccggcgccggccccgacgtgccccagctgggcaacatcgacgtgatccacagctacctgtgcaagggcctgcaggagaagttcttcaagagaaagcccaaggtgctgggcgtggtgagaatcctgatcgccctgatgagcctgagcatgggcatcatcatgatgtgcgtggccttcagcagctacgaggagcaccccatcttcgtgtacgtggcctacaccatctggggcagcgtgatgtacccctaccagctgcagcaggagctggagcagcagaaggtgtggaactacctgaagaacctgagctggagaatcatgggcagctacctgtgcttcggcgagagaagcgagctgaagcccctgtag

SEQ ID NO: 88634 - DNA, 333 bp, Artificial Sequence
  Description of Artificial Sequence: Synthetic coding sequence
atgaccaccatgcagggcatggagcagaccacccccggcgccggccccgacgtgccccagctgggcaacatcgacgtgatccacagctacctgtgcaagggcctgcaggagaagttcttcaagagaaagcccaaggtgctgggcgtgctgtgcggccacaagttcagcacccacagcgtgagcctgagcgtggccgccggcatcagaaccaccaagggcctggagctgagcgaggagttcaagctggagaacaacggcatcatcttcgtgttctggagagagatcagagtggagaccaccatcagaagacaggtgagaagactgctgaagtag

SEQ ID NO: 88635 - DNA, 615 bp, Artificial Sequence
  Description of Artificial Sequence: Synthetic coding sequence
atgagctacatccacatctgcgtgaaggactgcaagagaagcagcagcagaggcaaccccaagagcctgggcttctgcgtggacatcagcttccagctgatcagagtggtgagaatcctgatcgccctgatgagcctgagcatgggcatcatcatgatgtgcgtggccttcagcagctacgaggagcaccccatcttcgtgtacgtggcctacaccatctggggcagcgtgatgtacccctaccagctgcagcaggagctggagcagcagaaggtgtgcatctacagagtgctgaacggcgcccaggccggcgtgcagtggagagacctgggcagcctgcagccccccccccccagcagactgccctggccccccaaggtgcccagagtgcagcccctgcccggcagacaccccgtgtgggaggtgagaagcgtgagcgcctggccccccatcgtgtgggacgtgagaagccccagcgcctggctgcccagcctggagagcgaggagagactgtgccccgccgccatccccagcagaaagtggggcgcccccctgcccggccaccaccccatctgggaggtgagaagcgtgagcgccagaccccccatcttctag

SEQ ID NO: 88636 - DNA, 399 bp, Artificial Sequence; identical to SEQ ID NO: 88633
  Description of Artificial Sequence: Synthetic coding sequence

SEQ ID NO: 88637 - DNA, 603 bp, Artificial Sequence
  Description of Artificial Sequence: Synthetic coding sequence
atggacagcagcaccgcccacagccccgtgttcctggtgttcccccccgagatcaccgccagcgagtacgagagcaccgagctgagcgccaccaccttcagcacccagagccccctgcagaagctgttcgccagaaagatgaagatcctgggcaccatccagatcctgttcggcatcatgaccttcagcttcggcgtgatcttcctgttcaccctgctgaagccctaccccagattccccttcatcttcctgagcggctaccccttctggggcagcgtgctgttcatcaacagcggcgccttcctgatcgccgtgaagagaaagaccaccgagaccctgatcatcctgagcagaatcatgaacttcctgagcgccctgggcgccatcgccggcatcatcctgctgaccttcggcttcatcctggaccagaactacatctgcggctacagccaccagaacagccagtgcaaggccgtgaccgtgctgttcctgggcatcctgatcaccctgatgaccttcagcatcatcgagctgttcatcagcctgcccttcagcatcctgggctgccacagcgaggactgcgactgcgagcagtgctgctag

SEQ ID NO: 88638 - DNA, 747 bp, Artificial Sequence
  Description of Artificial Sequence: Synthetic coding sequence
atgaccagccagcccgtgcccaacgagaccatcatcgtgctgcccagcaacgtgatcaacttcagccaggccgagaagcccgagcccaccaaccagggccaggacagcctgaagaagcacctgcacgccgagatcaaggtgatcggcaccatccagatcctgtgcggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccaccgagaagagactgaccaagctgctggtgcacagcagcctggtgggcagcatcctgagcgccctgagcgccctggtgggcttcatcatcctgagcgtgaagcaggccaccctgaaccccgccagcctgcagtgcgagctggacaagaacaacatccccaccagaagctacgtgagctacttctaccacgacagcctgtacaccaccgactgctacaccgccaaggccagcctggccggcaccctgagcctgatgctgatctgcaccctgctggagttctgcctggccgtgctgaccgccgtgctgagatggaagcaggcctacagcgacttccccggcagcgtgctgttcctgccccacagctacatcggcaacagcggcatgagcagcaagatgacccacgactgcggctacgaggagctgctgaccagctag

SEQ ID NO: 88639 - DNA, 537 bp, Artificial Sequence
  Description of Artificial Sequence: Synthetic coding sequence
atgaccagccagcccgtgcccaacgagaccatcatcgtgctgcccagcaacgtgatcaacttcagccaggccgagaagcccgagcccaccaaccagggccaggacagcctgaagaagcacctgcacgccgagatcaaggtgatcggcaccatccagatcctgtgcggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccaccgagaagagactgaccaagctgctggtgcacagcagcctggtgggcagcatcctgagcgccctgagcgccctggtgggcttcatcatcctgagcgtgaagcaggccaccctgaaccccgccagcctgcagtggaacagcctgagcgacgccgacctgcacagcgccggcatcctgcccagctgcgcccactgctgcgccgccgtggagaccggcctgctgtag

SEQ ID NO: 88640 - DNA, 543 bp, Artificial Sequence
  Description of Artificial Sequence: Synthetic coding sequence
atgaccagccagcccgtgcccaacgagaccatcatcgtgctgcccagcaacgtgatcaacttcagccaggccgagaagcccgagcccaccaaccagggccaggacagcctgaagaagcacctgcacgccgagatcaaggtgatcggcttcatcatcagcggcagcctgagcatcgccaccgagaagagactgaccaagctgctggtgcacagcagcctggtgggcagcatcctgagcgccctgagcgccctggtgggcttcatcatcctgagcgtgaagcaggccaccctgaaccccgccagcctgcagtgcgagctggacaagaacaacatccccaccagaagctacgtgagctacttctaccacgacagcctgtacaccaccgactgctacaccgccaaggccagcctggccggcaccctgagcctgatgctgatctgcaccctgctggagttctgcctggccgtgctgaccgccgtgctgagatggaagcaggcctacagcgacttccccggcgtgagcgtgctggccggcttcacctag

SEQ ID NO: 88641 - DNA, 678 bp, Artificial Sequence
  Description of Artificial Sequence: Synthetic coding sequence
atgaccagccagcccgtgcccaacgagaccatcatcgtgctgcccagcaacgtgatcaacttcagccaggccgagaagcccgagcccaccaaccagggccaggacagcctgaagaagcacctgcacgccgagatcaaggtgatcggcaccatccagatcctgtgcggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccaccgagaagagactgaccaagctgctggtgcacagcagcctggtgggcagcatcctgagcgccctgagcgccctggtgggcttcatcatcctgagcgtgaagcaggccaccctgaaccccgccagcctgcagtgcgagctggacaagaacaacatccccaccagaagctacgtgagctacttctaccacgacagcctgtacaccaccgactgctacaccgccaaggccagcctggccggcaccctgagcctgatgctgatctgcaccctgctggagttctgcctggccgtgctgaccgccgtgctgagatggaagcaggcctacagcgacttccccggcgtgagcgtgctggccggcttcacctag

SEQ ID NO: 88642 - DNA, 831 bp, Artificial Sequence
  Description of Artificial Sequence: Synthetic coding sequence
atggtgctgctgaagctgctggaggtgtacagaaagggcagcgccggcaccttccacaagagcaccatcttcggcaacaccatcatgaccagccagcccgtgcccaacgagaccatcatcgtgctgcccagcaacgtgatcaacttcagccaggccgagaagcccgagcccaccaaccagggccaggacagcctgaagaagcacctgcacgccgagatcaaggtgatcggcaccatccagatcctgtgcggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccaccgagaagagactgaccaagctgctggtgcacagcagcctggtgggcagcatcctgagcgccctgagcgccctggtgggcttcatcatcctgagcgtgaagcaggccaccctgaaccccgccagcctgcagtgcgagctggacaagaacaacatccccaccagaagctacgtgagctacttctaccacgacagcctgtacaccaccgactgctacaccgccaaggccagcctggccggcaccctgagcctgatgctgatctgcaccctgctggagttctgcctggccgtgctgaccgccgtgctgagatggaagcaggcctacagcgacttccccggcagcgtgctgttcctgccccacagctacatcggcaacagcggcatgagcagcaagatgacccacgactgcggctacgaggagctgctgaccagctag

SEQ ID NO: 88643 - DNA, 747 bp, Artificial Sequence; identical to SEQ ID NO: 88638
  Description of Artificial Sequence: Synthetic coding sequence

SEQ ID NO: 88644 - DNA, 72 bp, Artificial Sequence
  Description of Artificial Sequence: Synthetic coding sequence
atgaccagccagcccgtgcccaacgagaccatcatcgtgctgcccagcaacgtgatcaacttcagccagtag

SEQ ID NO: 88645 - DNA, 444 bp, Artificial Sequence
  Description of Artificial Sequence: Synthetic coding sequence
atgaccagccagcccatcagcaacgagaccatcatcatgctgcccagcaacgtgatcaacttcagccaggccgagaagcccgagcccaccaaccagggccaggacagcctgaagaagagactgcaggccaaggtgaaggtgatcggcgtgcacagcagcctggccggcagcatcctgagcgccctgagcgccctggtgggcttcatcctgctgagcgtgaaccccgccgccctgaaccccgccagcctgcagtgcaagctggacgagaaggacatccccaccagactgctgctgagctacgactaccacagcccctacaccatggactgccacagagccaaggccagcctggccggcaccctgagcctgatgctggtgagcaccgtgctggagttctgcctggccgtgctgaccgccgtgctgcagtggaagcagaccgtgtag

SEQ ID NO: 88646 - DNA, 723 bp, Artificial Sequence
  Description of Artificial Sequence: Synthetic coding sequence
atgctgctgcagagccagaccatgggcgtgagccacagcttcacccccaagggcatcaccatcccccagagagagaagcccggccacatgtaccagaacgaggactacctgcagaacggcctgcccaccgagaccaccgtgctgggcaccgtgcagatcctgtgctgcctgctgatcagcagcctgggcgccatcctggtgttcgccccctaccccagccacttcaaccccgccatcagcaccaccctgatgagcggctaccccttcctgggcgccctgtgcttcggcatcaccggcagcctgagcatcatcagcggcaagcagagcaccaagcccttcgacctgagcagcctgaccagcaacgccgtgagcagcgtgaccgccggcgccggcctgttcctgctggccgacagcatggtggccctgagaaccgccagccagcactgcggcagcgagatggactacctgagcagcctgccctacagcgagtactactaccccatctacgagatcaaggactgcctgctgaccagcgtgagcctgaccggcgtgctggtggtgatgctgatcttcaccgtgctggagctgctgctggccgcctacagcagcgtgttctggtggaagcagctgtacagcaacaaccccggcagcagcttcagcagcacccagagccaggaccacatccagcaggtgaagaagagcagcagcagaagctggatctag

SEQ ID NO: 88647 - DNA, 588 bp, Artificial Sequence
  Description of Artificial Sequence: Synthetic coding sequence
atgctgctgcagagccagaccatgggcgtgagccacagcttcacccccaagggcatcaccatcccccagagagagaagcccggccacatgtaccagaacgaggactacctgcagaacggcctgcccaccgagaccaccgtgctgggcttcggcatcaccggcagcctgagcatcatcagcggcaagcagagcaccaagcccttcgacctgagcagcctgaccagcaacgccgtgagcagcgtgaccgccggcgccggcctgttcctgctggccgacagcatggtggccctgagaaccgccagccagcactgcggcagcgagatggactacctgagcagcctgccctacagcgagtactactaccccatctacgagatcaaggactgcctgctgaccagcgtgagcctgaccggcgtgctggtggtgatgctgatcttcaccgtgctggagctgctgctggccgcctacagcagcgtgttctggtggaagcagctgtacagcaacaaccccggcagcagcttcagcagcacccagagccaggaccacatccagcaggtgaagaagagcagcagcagaagctggatctag

SEQ ID NO: 88648 - DNA, 510 bp, Artificial Sequence
  Description of Artificial Sequence: Synthetic coding sequence
atgctgctgcagagccagaccatgggcgtgagccacagcttcacccccaagggcatcaccatcccccagagagagaagcccggccacatgtaccagaacgaggactacctgcagaacggcctgcccaccgagaccaccgtgctgggcttcggcatcaccggcagcctgagcatcatcagcggcaagcagagcaccaagcccttcgacctgagcagcctgaccagcaacgccgtgagcagcgtgaccgccggcgccggcctgttcctgctggccgacagcatggtggccctgagaaccgccagccagcactgcggcagcgagatggactacctgagcagcctgccctacagcgagtactactaccccatctacgagatcaaggactgcctgctgaccagcgtgagcctgaccggcgtgctggtggtgatgctgatcttcaccgtgctggagctgctgctggccgcctacagcagcgtgttctggtggaagcagctgtacagcaacaactag

SEQ ID NO: 88649 - DNA, 588 bp, Artificial Sequence; identical to SEQ ID NO: 88647
  Description of Artificial Sequence: Synthetic coding sequence

SEQ ID NO: 88650 - DNA, 753 bp, Artificial Sequence
  Description of Artificial Sequence: Synthetic coding sequence
atgaacagcatgaccagcgccgtgcccgtggccaacagcgtgctggtggtggccccccacaacggctaccccgtgacccccggcatcatgagccacgtgcccctgtaccccaacagccagccccaggtgcacctggtgcccggcaacccccccagcctggtgagcaacgtgaacggccagcccgtgcagaaggccctgaaggagggcaagaccctgggcgccatccagatcatcatcggcctggcccacatcggcctgggcagcatcatggccaccgtgctggtgggcgagtacctgagcatcagcttctacggcggcttccccttctggggcggcctgtggttcatcatcagcggcagcctgagcgtggccgccgagaaccagccctacagctactgcctgctgagcggcagcctgggcctgaacatcgtgagcgccatctgcagcgccgtgggcgtgatcctgttcatcaccgacctgagcatcccccacccctacgcctaccccgactactacccctacgcctggggcgtgaaccccggcatggccatcagcggcgtgctgctggtgttctgcctgctggagttcggcatcgcctgcgccagcagccacttcggctgccagctggtgtgctgccagagcagcaacgtgagcgtgatctaccccaacatctacgccgccaaccccgtgatcacccccgagcccgtgaccagcccccccagctacagcagcgagatccaggccaacaagtag

SEQ ID NO: 88651 - DNA, 2550 bp, Artificial Sequence
  Description of Artificial Sequence: Synthetic coding sequence
atggtgcagaaggagagccaggccaccctggaggagagagagagcgagctgagcagcaaccccgccgccagcgccggcgccagcctggagccccccgccgcccccgcccccggcgaggacaaccccgccggcgccggcggcgccgccgtggccggcgccgccggcggcgccagaagattcctgtgcggcgtggtggagggcttctacggcagaccctgggtgatggagcagagaaaggagctgttcagaagactgcagaagtgggagctgaacacctacctgtacgcccccaaggacgactacaagcacagaatgttctggagagagatgtacagcgtggaggaggccgagcagctgatgaccctgatcagcgccgccagagagtacgagatcgagttcatctacgccatcagccccggcctggacatcaccttcagcaaccccaaggaggtgagcaccctgaagagaaagctggaccaggtgagccagttcggctgcagaagcttcgccctgctgttcgacgacatcgaccacaacatgtgcgccgccgacaaggaggtgttcagcagcttcgcccacgcccaggtgagcatcaccaacgagatctaccagtacctgggcgagcccgagaccttcctgttctgccccaccgagtactgcggcaccttctgctaccccaacgtgagccagagcccctacctgagaaccgtgggcgagaagctgctgcccggcatcgaggtgctgtggaccggccccaaggtggtgagcaaggagatccccgtggagagcatcgaggaggtgagcaagatcatcaagagagcccccgtgatctgggacaacatccacgccaacgactacgaccagaagagactgttcctgggcccctacaagggcagaagcaccgagctgatccccagactgaagggcgtgctgaccaaccccaactgcgagttcgaggccaactacgtggccatccacaccctggccacctggtacaagagcaacatgaacggcgtgagaaaggacgtggtgatgagcagacaggtggcccacagcggcgccaaggccagcgtggtggacggcacccccctggtggccgcccccagcctgaacgccaccaccgtggtgaccaccgtgtaccaggagcccatcatgagccagggcgccgccctgagcggcgagcccaccaccctgaccaaggaggaggagaagaagcagcccgacgaggagcccatggacatggtggtggagaagcaggaggagaccgaccacaagaacgacaaccagatcctgagcgagatcgtggaggccaagatggccgaggagctgaagcccatggacaccgacaaggagagcatcgccgagagcaagagccccgagatgagcatgcaggaggactgcatcagcgacatcgcccccatgcagaccgacgagcagaccaacaaggagcagttcgtgcccggccccaacgagaagcccctgtacaccgccgagcccgtgaccctggaggacctgcagctgctggccgacctgttctacctgccctacgagcacggccccaagggcgcccagatgctgagagagttccagtggctgagagccaacagcagcgtggtgagcgtgaactgcaagggcaaggacagcgagaagatcgaggagtggagaagcagagccgccaagttcgaggagatgtgcggcctggtgatgggcatgttcaccagactgagcaactgcgccaacagaaccatcctgtacgacatgtacagctacgtgtgggacatcaagagcatcatgagcatggtgaagagcttcgtgcagtggctgggctgcagaagccacagcagcgcccagttcctgatcggcgaccaggagccctgggccttcagaggcggcctggccggcgagttccagcccccccccctgacccccaccagcaaggtgtacaccatcagaccctacttccccaaggacgaggccagcgtgtacaagatctgcagagagatgtacgacgacggcgtgggcctgcccttccagagccagcccgacctgatcggcgacaagctggtgggcggcctgctgagcctgagcctggactactgcttcgtgctggaggacgaggacggcatctgcggctacgccctgggcaccgtggacgtgacccccttcatcaagaagtgcaagatcagctggatccccttcatgcaggagaagtacaccaagcccaacggcgacaaggagctgagcgaggccgagaagatcatgctgagcttccacgaggagcaggaggtgctgcccgagaccttcctggccaacttccccagcctgatcaagatggacatccacaagaaggtgaccgaccccagcgtggccaagagcatgatggcctgcctgctgagcagcctgaaggccaacggcagcagaggcgccttctgcgaggtgagacccgacgacaagagaatcctggagttctacagcaagctgggctgcttcgagatcgccaagatggagggcttccccaaggacgtggtgatcctgggcagaagcctgtag

SEQ ID NO: 88652 - DNA, 2751 bp, Artificial Sequence
  Description of Artificial Sequence: Synthetic coding sequence
atggtgcagaaggagagccaggccaccctggaggagagagagagcgagctgagcagcaaccccgccgccagcgccggcgccagcctggagccccccgccgcccccgcccccggcgaggacaaccccgccggcgccggcggcgccgccgtggccggcgccgccggcggcgccagaagattcctgtgcggcgtggtggagggcttctacggcagaccctgggtgatggagcagagaaaggagctgttcagaagactgcagaagtgggagctgaacacctacctgtacgcccccaaggacgactacaagcacagaatgttctggagagagatgtacagcgtggaggaggccgagcagctgatgaccctgatcagcgccgccagagagtacgagatcgagttcatctacgccatcagccccggcctggacatcaccttcagcaaccccaaggaggtgagcaccctgaagagaaagctggaccaggtgagccagttcggctgcagaagcttcgccctgctgttcgacgacatcgaccacaacatgtgcgccgccgacaaggaggtgttcagcagcttcgcccacgcccaggtgagcatcaccaacgagatctaccagtacctgggcgagcccgagaccttcctgttctgccccaccgagtactgcggcaccttctgctaccccaacgtgagccagagcccctacctgagaaccgtgggcgagaagctgctgcccggcatcgaggtgctgtggaccggccccaaggtggtgagcaaggagatccccgtggagagcatcgaggaggtgagcaagatcatcaagagagcccccgtgatctgggacaacatccacgccaacgactacgaccagaagagactgttcctgggcccctacaagggcagaagcaccgagctgatccccagactgaagggcgtgctgaccaaccccaactgcgagttcgaggccaactacgtggccatccacaccctggccacctggtacaagagcaacatgaacggcgtgagaaaggacgtggtgatgaccgacagcgaggacagcaccgtgagcatccagatcaagctggagaacgagggcagcgacgaggacatcgagaccgacgtgctgtacagcccccagatggccctgaagctggccctgaccgagtggctgcaggagttcggcgtgccccaccagtacagcagcagacaggtggcccacagcggcgccaaggccagcgtggtggacggcacccccctggtggccgcccccagcctgaacgccaccaccgtggtgaccaccgtgtaccaggagcccatcatgagccagggcgccgccctgagcggcgagcccaccaccctgaccaaggaggaggagaagaagcagcccgacgaggagcccatggacatggtggtggagaagcaggaggagaccgaccacaagaacgacaaccagatcctgagcgagatcgtggaggccaagatggccgaggagctgaagcccatggacaccgacaaggagagcatcgccgagagcaagagccccgagatgagcatgcaggaggactgcatcagcgacatcgcccccatgcagaccgacgagcagaccaacaaggagcagttcgtgcccggccccaacgagaagcccctgtacaccgccgagcccgtgaccctggaggacctgcagctgctggccgacctgttctacctgccctacgagcacggccccaagggcgcccagatgctgagagagttccagtggctgagagccaacagcagcgtggtgagcgtgaactgcaagggcaaggacagcgagaagatcgaggagtggagaagcagagccgccaagttcgaggagatgtgcggcctggtgatgggcatgttcaccagactgagcaactgcgccaacagaaccatcctgtacgacatgtacagctacgtgtgggacatcaagagcatcatgagcatggtgaagagcttcgtgcagtggctgggctgcagaagccacagcagcgcccagttcctgatcggcgaccaggagccctgggccttcagaggcggcctggccggcgagttccagagactgctgcccatcgacggcgccaacgacctgttcttccagcccccccccctgacccccaccagcaaggtgtacaccatcagaccctacttccccaaggacgaggccagcgtgtacaagatctgcagagagatgtacgacgacggcgtgggcctgcccttccagagccagcccgacctgatcggcgacaagctggtgggcggcctgctgagcctgagcctggactactgcttcgtgctggaggacgaggacggcatctgcggctacgccctgggcaccgtggacgtgacccccttcatcaagaagtgcaagatcagctggatccccttcatgcaggagaagtacaccaagcccaacggcgacaaggagctgagcgaggccgagaagatcatgctgagcttccacgaggagcaggaggtgctgcccgagaccttcctggccaacttccccagcctgatcaagatggacatccacaagaaggtgaccgaccccagcgtggccaagagcatgatggcctgcctgctgagcagcctgaaggccaacggcagcagaggcgccttctgcgaggtgagacccgacgacaagagaatcctggagttctacagcaagctgggctgcttcgagatcgccaagatggagggcttccccaaggacgtggtgatcctgggcagaagcctgtag

SEQ ID NO: 88653 - DNA, 2034 bp, Artificial Sequence
  Description of Artificial Sequence: Synthetic coding sequence
atggtgcagaaggagagccaggccaccctggaggagagagagagcgagctgagcagcaaccccgccgccagcgccggcgccagcctggagccccccgccgcccccgcccccggcgaggacaaccccgccggcgccggcggcgccgccgtggccggcgccgccggcggcgccagaagattcctgtgcggcgtggtggagggcttctacggcagaccctgggtgatggagcagagaaaggagctgttcagaagactgcagaagtgggagctgaacacctacctgtacgcccccaaggacgactacaagcacagaatgttctggagagagatgtacagcgtggaggaggccgagcagctgatgaccctgatcagcgccgccagagagtacgagatcgagttcatctacgccatcagccccggcctggacatcaccttcagcaaccccaaggaggtgagcaccctgaagagaaagctggaccaggtgagccagttcggctgcagaagcttcgccctgctgttcgacgacatcgaccacaacatgtgcgccgccgacaaggaggtgttcagcagcttcgcccacgcccaggtgagcatcaccaacgagatctaccagtacctgggcgagcccgagaccttcctgttctgccccaccgagtactgcggcaccttctgctaccccaacgtgagccagagcccctacctgagaaccgtgggcgagaagctgctgcccggcatcgaggtgctgtggaccggccccaaggtggtgagcaaggagatccccgtggagagcatcgaggaggtgagcaagatcatcaagagagcccccgtgatctgggacaacatccacgccaacgactacgaccagaagagactgttcctgggcccctacaagggcagaagcaccgagctgatccccagactgaagggcgtgctgaccaaccccaactgcgagttcgaggccaactacgtggccatccacaccctggccacctggtacaagagcaacatgaacggcgtgagaaaggacgtggtgatgaccgacagcgaggacagcaccgtgagcatccagatcaagctggagaacgagggcagcgacgaggacatcgagaccgacgtgctgtacagcccccagatggccctgaagctggccctgaccgagtggctgcaggagttcggcgtgccccaccagtacagcagcagacaggtggcccacagcggcgccaaggccagcgtggtggacggcacccccctggtggccgcccccagcctgaacgccaccaccgtggtgaccaccgtgtaccaggagcccatcatgagccagggcgccgccctgagcggcgagcccaccaccctgaccaaggaggaggagaagaagcagcccgacgaggagcccatggacatggtggtggagaagcaggaggagaccgaccacaagaacgacaaccagatcctgagcgagatcgtggaggccaagatggccgaggagctgaagcccatggacaccgacaaggagagcatcgccgagagcaagagccccgagatgagcatgcaggaggactgcatcagcgacatcgcccccatgcagaccgacgagcagaccaacaaggagcagttcgtgcccggccccaacgagaagcccctgtacaccgccgagcccgtgaccctggaggacctgcagctgctggccgacctgttctacctgccctacgagcacggccccaagggcgcccagatgctgagagagttccagtggctgagagccaacagcagcgtggtgagcgtgaactgcaagggcaaggacagcgagaagatcgaggagtggagaagcagagccgccaagttcgaggagatgtgcggcctggtgatgggcatgttcaccagactgagcaactgcgccaacagaaccatcctgtacgacatgtacagctacgtgtgggacatcaagagcatcatgagcatggtgaagagcttcgtgcagtggctgggcagatgcaccagaaacaacctgttcagcagcaacatcctgagcctgtag

SEQ ID NO: 88654 - DNA, 456 bp, Artificial Sequence
  Description of Artificial Sequence: Synthetic coding sequence
atggtgcagaaggagagccaggccaccctggaggagagagagagcgagctgagcagcaaccccgccgccagcgccggcgccagcctggagccccccgccgcccccgcccccggcgaggacaaccccgccggcgccggcggcgccgccgtggccggcgccgccggcggcgccagaagattcctgtgcggcgtggtggagggcttctacggcagaccctgggtgatggagcagagaaaggagctgttcagaagactgcagaagtgggagctgaacacctacctgtacgcccccaaggacgactacaagcacagaatgttctggagagagatgtacagcgtggaggaggccggcagcttcctgttcttctacctggtgaccatccagctggccgagatcgagagagtgctgtgcgccagcaaggtgatgaccatctgcgtgatcagctgggcctgctag

SEQ ID NO: 88655 - DNA, 771 bp, Artificial Sequence
  Description of Artificial Sequence: Synthetic coding sequence
gccgccggcggcgccagaagattcctgtgcggcgtggtggagggcttctacggcagaccctgggtgatggagcagagaaaggagctgttcagaagactgcagaagtgggagctgaacacctacctgtacgcccccaaggacgactacaagcacagaatgttctggagagagatgtacagcgtggaggaggccgagcagctgatgaccctgatcagcgccgccagagagtacgagatcgagttcatctacgccatcagccccggcctggacatcaccttcagcaaccccaaggaggtgagcaccctgaagagaaagctggaccaggtgagccagttcggctgcagaagcttcgccctgctgttcgacgacatcgaccacaacatgtgcgccgccgacaaggaggtgttcagcagcttcgcccacgcccaggtgagcatcaccaacgagatctaccagtacctgggcgagcccgagaccttcctgttctgccccaccggccccaaggtggtgagcaaggagatccccgtggagagcatcgaggaggtgagcaagatcatcaagagagcccccgtgatctgggacaacatccacgccaacgactacgaccagaagagactgttcctgggcccctacaagggcagaagcaccgagctgatccccagactgaagggcgtgctgaccaaccccaactgcgagttcgaggccaactacgtggccatccacaccctggccacctggtacaagagcaacatgaacggcgtgagaaagtag

SEQ ID NO: 88656 - DNA, 2592 bp, Artificial Sequence
  Description of Artificial Sequence: Synthetic coding sequence
atggtgcagaaggagagccaggccaccctggaggagagagagagcgagctgagcagcaaccccgccgccagcgccggcgccagcctggagccccccgccgcccccgcccccggcgaggacaaccccgccggcgccggcggcgccgccgtggccggcgccgccggcggcgccagaagattcctgtgcggcgtggtggagggcttctacggcagaccctgggtgatggagcagagaaaggagctgttcagaagactgcagaagtgggagctgaacacctacctgtacgcccccaaggacgactacaagcacagaatgttctggagagagatgtacagcgtggaggaggccgagcagctgatgaccctgatcagcgccgccagagagtacgagatcgagttcatctacgccatcagccccggcctggacatcaccttcagcaaccccaaggaggtgagcaccctgaagagaaagctggaccaggtgagccagttcggctgcagaagcttcgccctgctgttcgacgacatcgaccacaacatgtgcgccgccgacaaggaggtgttcagcagcttcgcccacgcccaggtgagcatcaccaacgagatctaccagtacctgggcgagcccgagaccttcctgttctgccccaccgagtactgcggcaccttctgctaccccaacgtgagccagagcccctacctgagaaccgtgggcgagaagctgctgcccggcatcgaggtgctgtggaccggccccaaggtggtgagcaaggagatccccgtggagagcatcgaggaggtgagcaagatcatcaagagagcccccgtgatctgggacaacatccacgccaacgactacgaccagaagagactgttcctgggcccctacaagggcagaagcaccgagctgatccccagactgaagggcgtgctgaccaaccccaactgcgagttcgaggccaactacgtggccatccacaccctggccacctggtacaagagcaacatgaacggcgtgagaaaggacgtggtgatgagcagacaggtggcccacagcggcgccaaggccagcgtggtggacggcacccccctggtggccgcccccagcctgaacgccaccaccgtggtgaccaccgtgtaccaggagcccatcatgagccagggcgccgccctgagcggcgagcccaccaccctgaccaaggaggaggagaagaagcagcccgacgaggagcccatggacatggtggtggagaagcaggaggagaccgaccacaagaacgacaaccagatcctgagcgagatcgtggaggccaagatggccgaggagctgaagcccatggacaccgacaaggagagcatcgccgagagcaagagccccgagatgagcatgcaggaggactgcatcagcgacatcgcccccatgcagaccgacgagcagaccaacaaggagcagttcgtgcccggccccaacgagaagcccctgtacaccgccgagcccgtgaccctggaggacctgcagctgctggccgacctgttctacctgccctacgagcacggccccaagggcgcccagatgctgagagagttccagtggctgagagccaacagcagcgtggtgagcgtgaactgcaagggcaaggacagcgagaagatcgaggagtggagaagcagagccgccaagttcgaggagatgtgcggcctggtgatgggcatgttcaccagactgagcaactgcgccaacagaaccatcctgtacgacatgtacagctacgtgtgggacatcaagagcatcatgagcatggtgaagagcttcgtgcagtggctgggctgcagaagccacagcagcgcccagttcctgatcggcgaccaggagccctgggccttcagaggcggcctggccggcgagttccagagactgctgcccatcgacggcgccaacgacctgttcttccagcccccccccctgacccccaccagcaaggtgtacaccatcagaccctacttccccaaggacgaggccagcgtgtacaagatctgcagagagatgtacgacgacggcgtgggcctgcccttccagagccagcccgacctgatcggcgacaagctggtgggcggcctgctgagcctgagcctggactactgcttcgtgctggaggacgaggacggcatctgcggctacgccctgggcaccgtggacgtgacccccttcatcaagaagtgcaagatcagctggatccccttcatgcaggagaagtacaccaagcccaacggcgacaaggagctgagcgaggccgagaagatcatgctgagcttccacgaggagcaggaggtgctgcccgagaccttcctggccaacttccccagcctgatcaagatggacatccacaagaaggtgaccgaccccagcgtggccaagagcatgatggcctgcctgctgagcagcctgaaggccaacggcagcagaggcgccttctgcgaggtgagacccgacgacaagagaatcctggagttctacagcaagctgggctgcttcgagatcgccaagatggagggcttccccaaggacgtggtgatcctgggcagaagcctgtag

SEQ ID NO: 88657 - DNA, 1545 bp, Artificial Sequence
  Description of Artificial Sequence: Synthetic coding sequence
atggccgtgtggctggcccagtggctgggccccctgctgctggtgagcctgtggggcctgctggcccccgccagcctgctgagaagactgggcgagcacatccagcagttccaggagagcagcgcccagggcctgggcctgagcctgggccccggcgccgccgccctgcccaaggtgggctggctggagcagctgctggaccccttcaacgtgagcgacagaagaagcttcctgcagagatactgggtgaacgaccagcactgggtgggccaggacggccccatcttcctgcacctgggcggcgagggcagcctgggccccggcagcgtgatgagaggccaccccgccgccctggcccccgcctggggcgccctggtgatcagcctggagcacagattctacggcctgagcatccccgccggcggcctggagatggcccagctgagattcctgagcagcagactggccctggccgacgtggtgagcgccagactggccctgagcagactgttcaacatcagcagcagcagcccctggatctgcttcggcggcagctacgccggcagcctggccgcctgggccagactgaagttcccccacctgatcttcgccagcgtggccagcagcgcccccgtgagagccgtgctggacttcagcgagtacaacgacgtggtgagcagaagcctgatgagcaccgccatcggcggcagcctggagtgcagagccgccgtgagcgtggccttcgccgaggtggagagaagactgagaagcggcggcgccgcccaggccgccctgagaaccgagctgagcgcctgcggccccctgggcagagccgagaaccaggccgagctgctgggcgccctgcaggccctggtgggcggcgtggtgcagtacgacggccagaccggcgcccccctgagcgtgagacagctgtgcggcctgctgctgggcggcggcggcaacagaagccacagcaccccctactgcggcctgagaagagccgtgcagatcgtgctgcacagcctgggccagaagtgcctgagcttcagcagagccgagaccgtggcccagctgagaagcaccgagccccagctgagcggcgtgggcgacagacagtggctgtaccagacctgcaccgagttcggcttctacgtgacctgcgagaaccccagatgccccttcagccagctgcccgccctgcccagccagctggacctgtgcgagcaggtgttcggcctgagcgccctgagcgtggcccaggccgtggcccagaccaacagctactacggcggccagacccccggcgccaacaaggtgctgttcgtgaacggcgacaccgacccctggcacgtgctgagcgtgacccaggccctgggcagcagcgagagcaccctgctgatcagaaccggcagccactgcctggacatggcccccgagagacccagcgacagccccagcctgagactgggcagacagaacatcttccagcagctgcagacctggctgaagctggccaaggagagccagatcaagggcgaggtgtag

SEQ ID NO: 88658 - DNA, 2106 bp, Artificial Sequence
  Description of Artificial Sequence: Synthetic coding sequence
atggacctgtggaacctgagctggttcctgttcctggacgccctgctggtgatcagcggcctggccacccccgagaacttcgacgtggacggcggcatggaccaggacatcttcgacatcaacgagggcctgggcctggacctgttcgagggcgacatcagactggacagagcccagatcagaaacagcatcatcggcgagaagtacagatggccccacaccatcccctacgtgctggaggacagcctggagatgaacgccaagggcgtgatcctgaacgccttcgagagatacagactgaagacctgcatcgacttcaagccctgggccggcgagaccaactacatcagcgtgttcaagggcagcggctgctggagcagcgtgggcaacagaagagtgggcaagcaggagctgagcatcggcgccaactgcgacagaatcgccaccgtgcagcacgagttcctgcacgccctgggcttctggcacgagcagagcagaagcgacagagacgactacgtgagaatcatgtgggacagaatcctgagcggcagagagcacaacttcaacacctacagcgacgacatcagcgacagcctgaacgtgccctacgactacaccagcgtgatgcactacagcaagaccgccttccagaacggcaccgagcccaccatcgtgaccagaatcagcgacttcgaggacgtgatcggccagagaatggacttcagcgacagcgacctgctgaagctgaaccagctgtacaactgcagcagcagcctgagcttcatggacagctgcagcttcgagctggagaacgtgtgcggcatgatccagagcagcggcgacaacgccgactggcagagagtgagccaggtgcccagaggccccgagagcgaccacagcaacatgggccagtgccagggcagcggcttcttcatgcacttcgacagcagcagcgtgaacgtgggcgccaccgccgtgctggagagcagaaccctgtaccccaagagaggcttccagtgcctgcagttctacctgtacaacagcggcagcgagagcgaccagctgaacatctacatcagagagtacagcgccgacaacgtggacggcaacctgaccctggtggaggagatcaaggagatccccaccggcagctggcagctgtaccacgtgaccctgaaggtgaccaagaagttcagagtggtgttcgagggcagaaagggcagcggcgccagcctgggcggcctgagcatcgacgacatcaacctgagcgagaccagatgcccccaccacatctggcacatcagaaacttcacccagttcatcggcagccccaacggcaccctgtacagcccccccttctacagcagcaagggctacgccttccagatctacctgaacctggcccacgtgaccaacgccggcatctacttccacctgatcagcggcgccaacgacgaccagctgcagtggccctgcccctggcagcaggccaccatgaccctgctggaccagaaccccgacatcagacagagaatgagcaaccagagaagcatcaccaccgaccccttcatgaccaccgacaacggcaactacttctgggacagacccagcaaggtgggcaccgtggccctgttcagcaacggcacccagttcagaagaggcggcggctacggcaccagcgccttcatcacccacgagagactgaagagcagagacttcatcaagggcgacgacgtgtacatcctgctgaccgtggaggacatcagccacctgaacagcacccagatccagctgacccccgcccccagcgtgcaggacctgtgcagcaagaccacctgcaagaacgacggcgtgtgcaccgtgagagacggcaaggccgagtgcagatgccagagcggcgaggactggtggtacatgggcgagagatgcgagaagagaggcagcaccagagacaccatcgtgatcgccgtgagcagcaccgtggccgtgttcgccctgatgctgatcatcaccctggtgagcgtgtactgcaccagaaagaagtacagagagagaatgagcagcaacagacccaacctgaccccccagaaccagcacgccttctag

SEQ ID NO: 88659 - DNA, 894 bp, Artificial Sequence
  Description of Artificial Sequence: Synthetic coding sequence
atggccagcccccagctgtgcagagccctggtgagcgcccagtgggtggccgaggccctgagagcccccagagccggccagcccctgcagctgctggacgccagctggtacctgcccaagctgggcagagacgccagaagagagttcgaggagagacacatccccggcgccgccttcttcgacatcgaccagtgcagcgacagaaccagcccctacgaccacatgctgcccggcgccgagcacttcgccgagtacgccggcagactgggcgtgggcgccgccacccacgtggtgatctacgacgccagcgaccagggcctgtacagcgcccccagagtgtggtggatgttcagagccttcggccaccacgccgtgagcctgctggacggcggcctgagacactggctgagacagaacctgcccctgagcagcggcaagagccagcccgcccccgccgagttcagagcccagctggaccccgccttcatcaagacctacgaggacatcaaggagaacctggagagcagaagattccaggtggtggacagcagagccaccggcagattcagaggcaccgagcccgagcccagagacggcatcgagcccggccacatccccggcaccgtgaacatccccttcaccgacttcctgagccaggagggcctggagaagagccccgaggagatcagacacctgttccaggagaagaaggtggacctgagcaagcccctggtggccacctgcggcagcggcgtgaccgcctgccacgtggccctgggcgcctacctgtgcggcaagcccgacgtgcccatctacgacggcagctgggtggagtggtacatgagagccagacccgaggacgtgatcagcgagggcagaggcaagacccactag

SEQ ID NO: 88660 - DNA, 954 bp, Artificial Sequence
  Description of Artificial Sequence: Synthetic coding sequence
atggccgagcccggcagcagagagagcgagaccagagccagaagccccagcgtggccgccatggccagcccccagctgtgcagagccctggtgagcgcccagtgggtggccgaggccctgagagcccccagagccggccagcccctgcagctgctggacgccagctggtacctgcccaagctgggcagagacgccagaagagagttcgaggagagacacatccccggcgccgccttcttcgacatcgaccagtgcagcgacagaaccagcccctacgaccacatgctgcccggcgccgagcacttcgccgagtacgccggcagactgggcgtgggcgccgccacccacgtggtgatctacgacgccagcgaccagggcctgtacagcgcccccagagtgtggtggatgttcagagccttcggccaccacgccgtgagcctgctggacggcggcctgagacactggctgagacagaacctgcccctgagcagcggcaagagccagcccgcccccgccgagttcagagcccagctggaccccgccttcatcaagacctacgaggacatcaaggagaacctggagagcagaagattccaggtggtggacagcagagccaccggcagattcagaggcaccgagcccgagcccagagacggcatcgagcccggccacatccccggcaccgtgaacatccccttcaccgacttcctgagccaggagggcctggagaagagccccgaggagatcagacacctgttccaggagaagaaggtggacctgagcaagcccctggtggccacctgcggcagcggcgtgaccgcctgccacgtggccctgggcgcctacctgtgcggcaagcccgacgtgcccatctacgacggcagctgggtggagtggtacatgagagccagacccgaggacgtgatcagcgagggcagaggcaagacccactag

SEQ ID NO: 88661 - DNA, 894 bp, Artificial Sequence; identical to SEQ ID NO: 88659
  Description of Artificial Sequence: Synthetic coding sequence

SEQ ID NO: 88662 - DNA, 894 bp, Artificial Sequence; identical to SEQ ID NO: 88659
  Description of Artificial Sequence: Synthetic coding sequence

SEQ ID NO: 88663 - DNA, 894 bp, Artificial Sequence; identical to SEQ ID NO: 88659
  Description of Artificial Sequence: Synthetic coding sequence

SEQ ID NO: 88664 - DNA, 894 bp, Artificial Sequence; identical to SEQ ID NO: 88659
  Description of Artificial Sequence: Synthetic coding sequence

SEQ ID NO: 88665 - DNA, 738 bp, Artificial Sequence
  Description of Artificial Sequence: Synthetic coding sequence
atggccagcccccagctgtgcagagccctggtgagcgcccagtgggtggccgaggccctgagagcccccagagccggccagcccctgcagctgctggacgccagctggtacctgcccaagctgggcagagacgccagaagagagttcgaggagagacacatccccggcgccgccttcttcgacatcgaccagtgcagcgacagaaccagcccctacgaccacatgctgcccggcgccgagcacttcgccgagtacgccggcagactgggcgtgggcgccgccacccacgtggtgatctacgacgccagcgaccagggcctgtacagcgcccccagagtgtggtggatgttcagagccttcggccaccacgccgtgagcctgctggacggcggcctgagacactggctgagacagaacctgcccctgagcagcggcaagagccagcccgcccccgccgagttcagagcccagctggaccccgccttcatcaagacctacgaggacatcaaggagaacctggagagcagaagattccaggtggtggacagcagagccaccggcagattcagaggcaccgagcccgagccccccgccgtgggcatcgagcccggccacatccccggcaccgtgaacatccccttcaccgacttcctgagccaggacggcagctgggtggagtggtacatgagagccagacccgaggacgtgatcagcgagggcagaggcaagacccactag

SEQ ID NO: 88666 - DNA, 765 bp, Artificial Sequence
  Description of Artificial Sequence: Synthetic coding sequence
atggaccccgccgccagcagctgcatgagaagcctgcagccccccgcccccgtgtggggctgcctgagaaacccccacagcgagggcaacggcgccagcggcctgccccactacccccccacccccttcagcttccaccagaagcccgacttcctggccaccgccaccgccgcctaccccgacttcagcgccagctgcctggccgccaccccccacagcctgccccaggaggagcacatcttcaccgagcagcaccccgccttcccccagagccccaactggcacttccccgtgagcgacgccagaagaagacccaacagcggccccgccggcggcagcaaggagatgggcaccagcagcctgggcctggtggacaccaccggcggccccggcgacgactacggcgtgctgggcagcaccgccaacgagaccgagaagaagagcagcagaagaagaaaggagagcagcgacaaccaggagaacagaggcaagcccgagggcagcagcaaggccagaaaggagagaaccgccttcaccaaggagcagctgagagagctggaggccgagttcgcccaccacaactacctgaccagactgagaagatacgagatcgccgtgaacctggacctgagcgagagacaggtgaaggtgtggttccagaacagaagaatgaagtggaagagagtgaagggcggccagcccatcagccccaacggccaggaccccgaggacggcgacagcaccgccagccccagcagcgagtag

SEQ ID NO: 88667 - DNA, 555 bp, Artificial Sequence
  Description of Artificial Sequence: Synthetic coding sequence
atggaccccgccgccagcagctgcatgagaagcctgcagccccccgcccccgtgtggggctgcctgagaaacccccacagcgagggcaacggcgccagcggcctgccccactacccccccacccccttcagcttccaccagaagcccgacttcctggccaccgccaccgccgcctaccccgacttcagcgccagctgcctggccgccaccccccacagcctgccccaggaggagcacatcttcaccgagcagcaccccgccttcccccagagccccaactggcacttccccgtgagcgacgccagaagaagacccaacagcggccccgccggcggcagcaaggagatgggcaccagcagcctgggcctggtggacaccaccggcggccccggcgacgactacggcgtgctgggcagcaccgccaacgagaccgagaagaagagcagcagaagaagaaaggagagcagcggccagagcgtggtgcccgagcccaaggacgaggtggaggcctgcgagggcagaagcgcccacctgccccagtgggccggcccctag

SEQ ID NO: 88668 - DNA, 420 bp, Artificial Sequence
  Description of Artificial Sequence: Synthetic coding sequence
atgggcaccagcagcctgggcctggtggacaccaccggcggccccggcgacgactacggcgtgctgggcagcaccgccaacgagaccgagaagaagagcagcagaagaagaaaggagagcagcgacaaccaggagaacagaggcaagcccgagggcagcagcaaggccagaaaggagagaaccgccttcaccaaggagcagctgagagagctggaggccgagttcgcccaccacaactacctgaccagactgagaagatacgagatcgccgtgaacctggacctgagcgagagacaggtgaaggtgtggttccagaacagaagaatgaagtggaagagagtgaagggcggccagcccatcagccccaacggccaggaccccgaggacggcgacagcaccgccagccccagcagcgagtag

SEQ ID NO: 88669 - DNA, 915 bp, Artificial Sequence
  Description of Artificial Sequence: Synthetic coding sequence
atggagcaccccctgttcggctgcctgagaagcccccacgccaccgcccagggcctgcaccccttcagccagagcagcctggccctgcacggcagaagcgaccacatgagctaccccgagctgagcaccagcagcagcagctgcatcatcgccggctaccccaacgaggagggcatgttcgccagccagcaccacagaggccaccaccaccaccaccaccaccaccaccaccaccaccaccagcagcagcagcaccaggccctgcagaccaactggcacctgccccagatgagcagcccccccagcgccgccagacacagcctgtgcctgcagcccgacagcggcggcccccccgagctgggcagcagcccccccgtgctgtgcagcaacagcagcagcctgggcagcagcacccccaccggcgccgcctgcgcccccggcgactacggcagacaggccctgagccccgccgaggccgagaagagaagcggcggcaagagaaagagcgacagcagcgacagccaggagggcaactacaagagcgaggtgaacagcaagcccagaaaggagagaaccgccttcaccaaggagcagatcagagagctggaggccgagttcgcccaccacaactacctgaccagactgagaagatacgagatcgccgtgaacctggacctgaccgagagacaggtgaaggtgtggttccagaacagaagaatgaagtggaagagagtgaagggcggccagcagggcgccgccgccagagagaaggagctggtgaacgtgaagaagggcaccctgctgcccagcgagctgagcggcatcggcgccgccaccctgcagcagaccggcgacagcatcgccaacgaggacagccacgacagcgaccacagcagcgagcacgcccacctgtag

SEQ ID NO: 88670 - DNA, 705 bp, Artificial Sequence
  Description of Artificial Sequence: Synthetic coding sequence
atggccgccagcagatgggccagaaaggccgtggtgctgctgtgcgccagcgacctgctgctgctgctgctgctgctgcccccccccggcagctgcgccgccgagggcagccccggcacccccgacgagagcacccccccccccagaaagaagaagaaggacatcagagactacaacgacgccgacatggccagactgctggagcagtgggagaaggacgacgacatcgaggagggcgacctgcccgagcacaagagacccagcgcccccgtggacttcagcaagatcgaccccagcaagcccgagagcatcctgaagatgaccaagaagggcaagaccctgatgatgttcgtgaccgtgagcggcagccccaccgagaaggagaccgaggagatcaccagcctgtggcagggcagcctgttcaacgccaactacgacgtgcagagattcatcgtgggcagcgacagagccatcttcatgctgagagacggcagctacgcctgggagatcaaggacttcctggtgggccaggacagatgcgccgacgtgaccctggagggccaggtgtaccccggcaagggcggcggcagcaaggagaagaacaagaccaagcaggacaagggcaagaagaagaaggagggcgacctgaagagcagaagcagcaaggaggagaacagagccggcaacaagagagaggacctgtag

SEQ ID NO: 88671 - DNA, 705 bp, Artificial Sequence; identical to SEQ ID NO: 88670
  Description of Artificial Sequence: Synthetic coding sequence

SEQ ID NO: 88672 - DNA, 1194 bp, Artificial Sequence
  Description of Artificial Sequence: Synthetic coding sequence
atggcccagagcccccccccccagagcctgctgggccacgaccactggatcttcgcccagggctggggctgggccggccactgggacagcaccagccccgccagcagcagcgacagcagcggcagctgcccctgcgacggcgccagaggcctgccccagccccagccccccagctgcagcagcagagccgccgaggccgccgccaccacccccagaagagccagaaccggccccgccggcggccagagacagagcgccagcgagagagagaagctgagaatgagaaccctggccagagccctgcacgagctgagaagattcctgccccccagcctggcccccgccggccagagcctgaccaagatcgagaccctgagactggccatcagatacatcggccacctgagcgccgtgctgggcctgagcgaggagagcctgcagtgcagaagaagacagagaggcgacgccggcagcccctggggctgccccctgtgccccgacagaggccccgccgaggcccagacccaggccgagggccagggccagggccagggccagggccagggccagggccagggccagggccagggccagggccagggccagggccagggcagaagacccggcctggtgagcgccgtgctggccgaggccagctggggcagccccagcgcctgccccggcgcccaggccgcccccgagagactgggcagaggcgtgcacgacaccgacccctgggccacccccccctactgccccaagatccagagccccccctacagcagccagggcaccaccagcgacgccagcctgtggacccccccccagggctgcccctggacccagagcagccccgagcccagaaacccccccgtgccctggaccgccgcccccgccaccctggagctggccgccgtgtaccagggcctgagcgtgagccccgagccctgcctgagcctgggcgcccccagcctgctgccccaccccagctgccagagactgcagccccagacccccggcagatgctggagccacagcgccgaggtggtgcccaacagcgaggaccagggccccggcgccgccttccagctgagcgaggccagccccccccagagcagcggcctgagattcagcggctgccccgagctgtggcaggaggacctggagggcgccagactgggcatcttctactag

SEQ ID NO: 88673 - DNA, 3510 bp, Artificial Sequence
  Description of Artificial Sequence: Synthetic coding sequence
atggagcccagagagagcggcaaggcccccgtgaccttcgacgacatcaccgtgtacctgctgcaggaggagtgggtgctgctgagccagcagcagaaggagctgtgcggcagcaacaagctggtggcccccctgggccccaccgtggccaaccccgagctgttcagaaagttcggcagaggccccgagccctggctgggcagcgtgcagggccagagaagcctgctggagcaccaccccggcaagaagcagatgggctacatgggcgagatggaggtgcagggccccaccagagagagcggccagagcctgcccccccagaagaaggcctacctgagccacctgagcaccggcagcggccacatcgagggcgactgggccggcagaaacagaaagctgctgaagcccagaagcatccagaagagctggttcgtgcagttcccctggctgatcatgaacgaggagcagaccgccctgttctgcagcgcctgcagagagtaccccagcatcagagacaagagaagcagactgatcgagggctacaccggccccttcaaggtggagaccctgaagtaccacgccaagagcaaggcccacatgttctgcgtgaacgccctggccgccagagaccccatctgggccgccagattcagaagcatcagagacccccccggcgacgtgctggccagccccgagcccctgttcaccgccgactgccccatcttctacccccccggccccctgggcggcttcgacagcatggccgagctgctgcccagcagcagagccgagctggaggaccccggcggcgacggcgccatccccgccatgtacctggactgcatcagcgacctgagacagaaggagatcaccgacggcatccacagcagcagcgacatcaacatcctgtacaacgacgccgtggagagctgcatccaggaccccagcgccgagggcctgagcgaggaggtgcccgtggtgttcgaggagctgcccgtggtgttcgaggacgtggccgtgtacttcaccagagaggagtggggcatgctggacaagagacagaaggagctgtacagagacgtgatgagaatgaactacgagctgctggccagcctgggccccgccgccgccaagcccgacctgatcagcaagctggagagaagagccgccccctggatcaaggaccccaacggccccaagtggggcaagggcagaccccccggcaacaagaagatggtggccgtgagagaggccgacacccaggccagcgccgccgacagcgccctgctgcccggcagccccgtggaggccagagccagctgctgcagcagcagcatctgcgaggagggcgacggccccagaagaatcaagagaacctacagacccagaagcatccagagaagctggttcggccagttcccctggctggtgatcgaccccaaggagaccaagctgttctgcagcgcctgcatcgagagacccaacctgcacgacaagagcagcagactggtgagaggctacaccggccccttcaaggtggagaccctgaagtaccacgaggtgagcaaggcccacagactgtgcgtgaacaccgtggagatcaaggaggacaccccccacaccgccctggtgcccgagatcagcagcgacctgatggccaacatggagcacttcttcaacgccgcctacagcatcgcctaccacagcagacccctgaacgacttcgagaagatcctgcagctgctgcagagcaccggcaccgtgatcctgggcaagtacagaaacagaaccgcctgcacccagttcatcaagtacatcagcgagaccctgaagagagagatcctggaggacgtgagaaacagcccctgcgtgagcgtgctgctggacagcagcaccgacgccagcgagcaggcctgcgtgggcatctacatcagatacttcaagcagatggaggtgaaggagagctacatcaccctggcccccctgtacagcgagaccgccgacggctacttcgagaccatcgtgagcgccctggacgagctggacatccccttcagaaagcccggctgggtggtgggcctgggcaccgacggcagcgccatgctgagctgcagaggcggcctggtggagaagttccaggaggtgatcccccagctgctgcccgtgcactgcgtggcccacagactgcacctggccgtggtggacgcctgcggcagcatcgacctggtgaagaagtgcgacagacacatcagaaccgtgttcaagttctaccagagcagcaacaagagactgaacgagctgcaggagggcgccgcccccctggagcaggagatcatcagactgaaggacctgaacgccgtgagatgggtggccagcagaagaagaaccctgcacgccctgctggtgagctggcccgccctggccagacacctgcagagagtggccgaggccggcggccagatcggccacagagccaagggcatgctgaagctgatgagaggcttccacttcgtgaagttctgccacttcctgctggacttcctgagcatctacagacccctgagcgaggtgtgccagaaggagatcgtgctgatcaccgaggtgaacgccaccctgggcagagcctacgtggccctggagagcctgagacaccaggccggccccaaggaggaggagttcaacgccagcttcaaggacggcagactgcacggcatctgcctggacaagctggaggtggccgagcagagattccaggccgacagagagagaaccgtgctgaccggcatcgagtacctgcagcagagattcgacgccgacagacccccccagctgaagaacatggaggtgttcgacaccatggcctggcccagcggcatcgagctggccagcttcggcaacgacgacatcctgaacctggccagatacttcgagtgcagcctgcccaccggctacagcgaggaggccctgctggaggagtggctgggcctgaagaccatcgcccagcacctgcccttcagcatgctgtgcaagaacgccctggcccagcactgcagattccccctgctgagcaagctgatggccgtggtggtgtgcgtgcccatcagcaccagctgctgcgagagaggcttcaaggccatgaacagaatcagaaccgacgagagaaccaagctgagcaacgaggtgctgaacatgctgatgatgaccgccgtgaacggcgtggccgtgaccgagtacgacccccagcccgccatccagcactggtacctgaccagcagcggcagaagattcagccacgtgtacacctgcgcccaggtgcccgccagaagccccgccagcgccagactgagaaaggaggagatgggcgccctgtacgtggaggagcccagaacccagaagccccccatcctgcccagcagagaggccgccgaggtgctgaaggactgcatcatggagccccccgagagactgctgtacccccacaccagccaggaggcccccggcatgagctag

SEQ ID NO: 88674 - DNA, 981 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcatcttccccgagacccacagacccctgctgctgcagaagctgctgaaggacggcggcgtgctgagccccatcctgaccagactgatgaacttcttcgtgttcagcagaggcctgacccccgtgttcggcccctacaccagacccagcgagagcgagctgtgggacatgtgggccggcatcagaaacaacgacggcaacctggtgatcgacagcctgctgcagtacatcaaccagagaaagaagttcagaagaagatgggtgggcgccctggccagcgtgaccatccccatccacttcatctacggccccctggaccccgtgaacccctaccccgagttcctggagctgtacagaaagaccctgcccagaagcaccgtgagcatcctggacgaccacatcagccactacccccagctggaggaccccatgggcttcctgaacgcctacatgggcttcatcaacagcttctag

SEQ ID NO: 88675 - DNA, 981 bp, Artificial Sequence; identical to SEQ ID NO: 88674
  Description of Artificial Sequence: Synthetic coding sequence

SEQ ID NO: 88676 - DNA, 357 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtgtag

SEQ ID NO: 88677 - DNA, 624 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcatcttccccgagacccacagacccctgctgctgcagaagctgctgaaggacggcggcgtgctgagccccatcctgaccagactgatgaacttcttcgtgttcagcagaggctag

SEQ ID NO: 88678 - DNA, 483 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgacctag

SEQ ID NO: 88679 - DNA, 384 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgtag

SEQ ID NO: 88680 - DNA, 522 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcaactgcctgtag

SEQ ID NO: 88681 - DNA, 879 bp, Artificial Sequence
  Description of Artificial Sequence: Synthetic coding sequence
atgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcatcttccccgagacccacagacccctgctgctgcagaagctgctgaaggacggcggcgtgctgagccccatcctgaccagactgatgaacttcttcgtgttcagcagaggcctgctgcagtacatcaaccagagaaagaagttcagaagaagatgggtgggcgccctggccagcgtgaccatccccatccacttcatctacggccccctggaccccgtgaacccctaccccgagttcctggagctgtacagaaagaccctgcccagaagcaccgtgagcatcctggacgaccacatcagccactacccccagctggaggaccccatgggcttcctgaacgcctacatgggcttcatcaacagcttctag

SEQ ID NO: 88682 - DNA, 879 bp, Artificial Sequence; identical to SEQ ID NO: 88681
  Description of Artificial Sequence: Synthetic coding sequence

SEQ ID NO: 88683 - DNA, 582 bp, Artificial Sequence
  Description of Artificial Sequence: Synthetic coding sequence
atggacaacctgagagagaccttcctgagcctggaggacggcctgggcagcagcgacagccccggcctgctgagcagctgggactggaaggacagagccggccccttcgagctgaaccaggccagccccagccagagcctgagccccgcccccagcctggagagctacagcagcagcccctgccccgccgtggccggcctgccctgcgagcacggcggcgccagcagcggcggcagcgagggctgcagcgtgggcggcgccagcggcctggtggaggtggactacaacatgctggccttccagcccacccacctgcagggcggcggcggccccaaggcccagaagggcaccaaggtgagaatgagcgtgcagagaagaagaaaggccagcgagagagagaagctgagaatgagaaccctggccgacgccctgcacaccctgagaaactacctgccccccgtgtacagccagagaggccagcccctgaccaagatccagaccctgaagtacaccatcaagtacatcggcgagctgaccgacctgctgaacagaggcagagagcccagagcccagagcgcctag

SEQ ID NO: 88684 - DNA, 1893 bp, Artificial Sequence
  Description of Artificial Sequence: Synthetic coding sequence
atggccctgcccaccgccagacccctgctgggcagctgcggcacccccgccctgggcagcctgctgttcctgctgttcagcctgggctgggtgcagcccagcagaaccctggccggcgagaccggccaggaggccgcccccctggacggcgtgctggccaacccccccaacatcagcagcctgagccccagacagctgctgggcttcccctgcgccgaggtgagcggcctgagcaccgagagagtgagagagctggccgtggccctggcccagaagaacgtgaagctgagcaccgagcagctgagatgcctggcccacagactgagcgagccccccgaggacctggacgccctgcccctggacctgctgctgttcctgaaccccgacgccttcagcggcccccaggcctgcaccagattcttcagcagaatcaccaaggccaacgtggacctgctgcccagaggcgcccccgagagacagagactgctgcccgccgccctggcctgctggggcgtgagaggcagcctgctgagcgaggccgacgtgagagccctgggcggcctggcctgcgacctgcccggcagattcgtggccgagagcgccgaggtgctgctgcccagactggtgagctgccccggccccctggaccaggaccagcaggaggccgccagagccgccctgcagggcggcggccccccctacggcccccccagcacctggagcgtgagcaccatggacgccctgagaggcctgctgcccgtgctgggccagcccatcatcagaagcatcccccagggcatcgtggccgcctggagacagagaagcagcagagaccccagctggagacagcccgagagaaccatcctgagacccagattcagaagagaggtggagaagaccgcctgccccagcggcaagaaggccagagagatcgacgagagcctgatcttctacaagaagtgggagctggaggcctgcgtggacgccgccctgctggccacccagatggacagagtgaacgccatccccttcacctacgagcagctggacgtgctgaagcacaagctggacgagctgtacccccagggctaccccgagagcgtgatccagcacctgggctacctgttcctgaagatgagccccgaggacatcagaaagtggaacgtgaccagcctggagaccctgaaggccctgctggaggtgaacaagggccacgagatgagcccccaggcccccagaagacccctgccccaggtggccaccctgatcgacagattcgtgaagggcagaggccagctggacaaggacaccctggacaccctgaccgccttctaccccggctacctgtgcagcctgagccccgaggagctgagcagcgtgccccccagcagcatctgggccgtgagaccccaggacctggacacctgcgaccccagacagctggacgtgctgtaccccaaggccagactggccttccagaacatgaacggcagcgagtacttcgtgaagatccagagcttcctgggcggcgcccccaccgaggacctgaaggccctgagccagcagaacgtgagcatggacctggccaccttcatgaagctgagaaccgacgccgtgctgcccctgaccgtggccgaggtgcagaagctgctgggcccccacgtggagggcctgaaggccgaggagagacacagacccgtgagagactggatcctgagacagagacaggacgacctggacaccctgggcctgggcctgcagggcggcatccccaacggctacctggtgctggacctgagcatgcaggaggccctgagcggcaccccctgcctgctgggccccggccccgtgctgaccgtgctggccctgctgctggccagcaccctggcctag

SEQ ID NO: 88685 - DNA, 1869 bp, Artificial Sequence
  Description of Artificial Sequence: Synthetic coding sequence
atggccctgcccaccgccagacccctgctgggcagctgcggcacccccgccctgggcagcctgctgttcctgctgttcagcctgggctgggtgcagcccagcagaaccctggccggcgagaccggccaggaggccgcccccctggacggcgtgctggccaacccccccaacatcagcagcctgagccccagacagctgctgggcttcccctgcgccgaggtgagcggcctgagcaccgagagagtgagagagctggccgtggccctggcccagaagaacgtgaagctgagcaccgagcagctgagatgcctggcccacagactgagcgagccccccgaggacctggacgccctgcccctggacctgctgctgttcctgaaccccgacgccttcagcggcccccaggcctgcaccagattcttcagcagaatcaccaaggccaacgtggacctgctgcccagaggcgcccccgagagacagagactgctgcccgccgccctggcctgctggggcgtgagaggcagcctgctgagcgaggccgacgtgagagccctgggcggcctggcctgcgacctgcccggcagattcgtggccgagagcgccgaggtgctgctgcccagactggtgagctgccccggccccctggaccaggaccagcaggaggccgccagagccgccctgcagggcggcggccccccctacggcccccccagcacctggagcgtgagcaccatggacgccctgagaggcctgctgcccgtgctgggccagcccatcatcagaagcatcccccagggcatcgtggccgcctggagacagagaagcagcagagaccccagctggagacagcccgagagaaccatcctgagacccagattcagaagagaggtggagaagaccgcctgccccagcggcaagaaggccagagagatcgacgagagcctgatcttctacaagaagtgggagctggaggcctgcgtggacgccgccctgctggccacccagatggacagagtgaacgccatccccttcacctacgagcagctggacgtgctgaagcacaagctggacgagctgtacccccagggctaccccgagagcgtgatccagcacctgggctacctgttcctgaagatgagccccgaggacatcagaaagtggaacgtgaccagcctggagaccctgaaggccctgctggaggtgaacaagggccacgagatgagcccccaggtggccaccctgatcgacagattcgtgaagggcagaggccagctggacaaggacaccctggacaccctgaccgccttctaccccggctacctgtgcagcctgagccccgaggagctgagcagcgtgccccccagcagcatctgggccgtgagaccccaggacctggacacctgcgaccccagacagctggacgtgctgtaccccaaggccagactggccttccagaacatgaacggcagcgagtacttcgtgaagatccagagcttcctgggcggcgcccccaccgaggacctgaaggccctgagccagcagaacgtgagcatggacctggccaccttcatgaagctgagaaccgacgccgtgctgcccctgaccgtggccgaggtgcagaagctgctgggcccccacgtggagggcctgaaggccgaggagagacacagacccgtgagagactggatcctgagacagagacaggacgacctggacaccctgggcctgggcctgcagggcggcatccccaacggctacctggtgctggacctgagcatgcaggaggccctgagcggcaccccctgcctgctgggccccggccccgtgctgaccgtgctggccctgctgctggccagcaccctggcctag

SEQ ID NO: 88686 - DNA, 1893 bp, Artificial Sequence; identical to SEQ ID NO: 88684
  Description of Artificial Sequence: Synthetic coding sequence

SEQ ID NO: 88687 - DNA, 1869 bp, Artificial Sequence; identical to SEQ ID NO: 88685
  Description of Artificial Sequence: Synthetic coding sequence

SEQ ID NO: 88688 - DNA, 1869 bp, Artificial Sequence; identical to SEQ ID NO: 88685
  Description of Artificial Sequence: Synthetic coding sequence

SEQ ID NO: 88689 - DNA, 1782 bp, Artificial Sequence
  Description of Artificial Sequence: Synthetic coding sequence
atgagagacagcaccggcgccggcaacagcctggtgcacaagagaagccccctgagaagaaaccagaagacccccaccagcctgaccaagctgagcctgcaggacggccacaaggccaagaagcccgcctgcaagttcgaggagggccaggacgtgctggccagatggagcgacggcctgttctacctgggcaccatcaagaagatcaacatcctgaagcagagctgcttcatcatcttcgaggacagcagcaagagctgggtgctgtggaaggacatccagaccggcgccaccggcagcggcgagatggtgtgcaccatctgccaggaggagtacagcgaggcccccaacgagatggtgatctgcgacaagtgcggccagggctaccaccagctgtgccacaccccccacatcgactgcagcgtgatcgacagcgacgagaagtggctgtgcagacagtgcgtgttcgccaccaccaccaagagaggcggcgccctgaagaagggccccaacgccaaggccctgcaggtgatgaagcagaccctgccctacagcgtggccgacctggagtgggacgccggccacaagaccaacgtgcagcagtgctactgctactgcggcggccccggcgactggtacctgaagatgctgcagtgctgcaagtgcaagcagtggttccacgaggcctgcgtgcagtgcctgcagaagcccatgctgttcggcgacagattctacaccttcatctgcagcgtgtgcagcagcggccccgagtacctgaagagactgcccctgcagtgggtggacatcgcccacctgtgcctgtacaacctgagcgtgatccacaagaagaagtacttcgacagcgagctggagctgatgacctacatcaacgagaactgggacagactgcaccccggcgagctggccgacacccccaagagcgagagatacgagcacgtgctggaggccctgaacgactacaagaccatgttcatgagcggcaaggagatcaagaagaagaagcacctgttcggcctgagaatcagagtgccccccgtgccccccaacgtggccttcaaggccgagaaggagcccgagggcaccagccacgagttcaagatcaagggcagaaaggccagcaagcccatcagcgacagcagagaggtgagcaacggcatcgagaagaagggcaagaagaagagcgtgggcagaccccccggcccctacaccagaaagatgatccagaagaccgccgagcccctgctggacaaggagagcatcagcgagaaccccaccctggacctgccctgcagcatcggcagaaccgagggcaccgcccacagcagcaacaccagcgacgtggacttcaccggcgccagcagcgccaaggagaccaccagcagcagcatcagcagacactacggcctgagcgacagcagaaagagaaccagaaccggcagaagctggcccgccgccatcccccacctgagaagaagaagaggcagactgcccagaagagccctgcagacccagaacagcgagatcgtgaaggacgacgagggcaaggaggactaccagttcgacgagctgaacaccgagatcctgaacaacctggccgaccaggagctgcagctgaaccacctgaagaacagcatcaccagctacttcggcgccgccggcagaatcgcctgcggcgagaagtacagagtgctggccagaagagtgaccctggacggcaaggtgcagtacctggtggagtgggagggcgccaccgccagctag

SEQ ID NO: 88690 - DNA, 1611 bp, Artificial Sequence
  Description of Artificial Sequence: Synthetic coding sequence
atgagagacagcaccggcgccggcaacagcctggtgcacaagagaagccccctgagaagaaaccagaagacccccaccagcctgaccaagctgagcctgcaggacggccacaaggccaagaagcccgcctgcaagttcgaggagggccaggacgtgctggccagatggagcgacggcctgttctacctgggcaccatcaagaagatcaacatcctgaagcagagctgcttcatcatcttcgaggacagcagcaagagctgggtgctgtggaaggacatccagaccggcgccaccggcagcggcgagatggtgtgcaccatctgccaggaggagtacagcgaggcccccaacgagatggtgatctgcgacaagtgcggccagggctaccaccagctgtgccacaccccccacatcgactgcagcgtgatcgacagcgacgagaagtggctgtgcagacagtgcgtgttcgccaccaccaccaagagaggcggcgccctgaagaagggccccaacgccaaggccctgcaggtgatgaagcagaccctgccctacagcgtggccgacctggagtgggacgccggccacaagaccaacgtgcagcagtgctactgctactgcggcggccccggcgactggtacctgaagatgctgcagtgctgcaagtgcaagcagtggttccacgaggcctgcgtgcagtgcctgcagaagcccatgctgttcggcgacagattctacaccttcatctgcagcgtgtgcagcagcggccccgagtacctgaagagactgcccctgcagtgggtggacatcgcccacctgtgcctgtacaacctgagcgtgatccacaagaagaagtacttcgacagcgagctggagctgatgacctacatcaacgagaactgggacagactgcaccccggcgagctggccgacacccccaagagcgagagatacgagcacgtgctggaggccctgaacgactacaagaccatggaggtgagcaacggcatcgagaagaagggcaagaagaagagcgtgggcagaccccccggcccctacaccagaaagatgatccagaagaccgccgagcccctgctggacaaggagagcatcagcgagaaccccaccctggacctgccctgcagcatcggcagaaccgagggcaccgcccacagcagcaacaccagcgacgtggacttcaccggcgccagcagcgccaaggagaccaccagcagcagcatcagcagacactacggcctgagcgacagcagaaagagaaccagaaccggcagaagctggcccgccgccatcccccacctgagaagaagaagaggcagactgcccagaagagccctgcagacccagaacagcgagatcgtgaaggacgacgagggcaaggaggactaccagttcgacgagctgaacaccgagatcctgaacaacctggccgaccaggagctgcagctgaaccacctgaagaacagcatcaccagctacttcggcgccgccggcagaatcgcctgcggcgagaagtacagagtgctggccagaagagtgaccctggacggcaaggtgcagtacctggtggagtgggagggcgccaccgccagctag

SEQ ID NO: 88691 - DNA, 861 bp, Artificial Sequence
  Description of Artificial Sequence: Synthetic coding sequence
atggtgtgcaccatctgccaggaggagtacagcgaggcccccaacgagatggtgatctgcgacaagtgcggccagggctaccaccagctgtgccacaccccccacatcgactgcagcgtgatcgacagcgacgagaagtggctgtgcagacagtgcgtgttcgccaccaccaccaagagaggcggcgccctgaagaagggccccaacgccaaggccctgcaggtgatgaagcagaccctgccctacagcgtggccgacctggagtgggacgccggccacaagaccaacgtgcagcagtgctactgctactgcggcggccccggcgactggtacctgaagatgctgcagtgctgcaagtgcaagcagtggttccacgaggcctgcgtgcagtgcctgcagaagcccatgctgttcggcgacagattctacaccttcatctgcagcgtgtgcagcagcggccccgagtacctgaagagactgcccctgcagtgggtggacatcgcccacctgtgcctgtacaacctgagcgtgatccacaagaagaagtacttcgacagcgagctggagctgatgacctacatcaacgagaactgggacagactgcaccccggcgagctggccgacacccccaagagcgagagatacgagcacgtgctggaggccctgaacgactacaagaccatgttcatgagcggcaaggagatcaagaagaagaagcacctgttcggcctgagaatcagagtgccccccgtgccccccaacgtggccttcaaggccgagaaggagcccgagggcaccagccacgagttcaagctgaaggccgagagacaccccaacctgtacctgatccagggcaagtag

SEQ ID NO: 88692 - DNA, 1476 bp, Artificial Sequence
  Description of Artificial Sequence: Synthetic coding sequence
atggtgtgcaccatctgccaggaggagtacagcgaggcccccaacgagatggtgatctgcgacaagtgcggccagggctaccaccagctgtgccacaccccccacatcgactgcagcgtgatcgacagcgacgagaagtggctgtgcagacagtgcgtgttcgccaccaccaccaagagaggcggcgccctgaagaagggccccaacgccaaggccctgcaggtgatgaagcagaccctgccctacagcgtggccgacctggagtgggacgccggccacaagaccaacgtgcagcagtgctactgctactgcggcggccccggcgactggtacctgaagatgctgcagtgctgcaagtgcaagcagtggttccacgaggcctgcgtgcagtgcctgcagaagcccatgctgttcggcgacagattctacaccttcatctgcagcgtgtgcagcagcggccccgagtacctgaagagactgcccctgcagtgggtggacatcgcccacctgtgcctgtacaacctgagcgtgatccacaagaagaagtacttcgacagcgagctggagctgatgacctacatcaacgagaactgggacagactgcaccccggcgagctggccgacacccccaagagcgagagatacgagcacgtgctggaggccctgaacgactacaagaccatgttcatgagcggcaaggagatcaagaagaagaagcacctgttcggcctgagaatcagagtgccccccgtgccccccaacgtggccttcaaggccgagaaggagcccgagggcaccagccacgagttcaagatcaagggcagaaaggccagcaagcccatcagcgacagcagagaggtgagcaacggcatcgagaagaagggcaagaagaagagcgtgggcagaccccccggcccctacaccagaaagatgatccagaagaccgccgagcccctgctggacaaggagagcatcagcgagaaccccaccctggacctgccctgcagcatcggcagaaccgagggcaccgcccacagcagcaacaccagcgacgtggacttcaccggcgccagcagcgccaaggagaccaccagcagcagcatcagcagacactacggcctgagcgacagcagaaagagaaccagaaccggcagaagctggcccgccgccatcccccacctgagaagaagaagaggcagactgcccagaagagccctgcagacccagaacagcgagatcgtgaaggacgacgagggcaaggaggactaccagttcgacgagctgaacaccgagatcctgaacaacctggccgaccaggagctgcagctgaaccacctgaagaacagcatcaccagctacttcggcgccgccggcagaatcgcctgcggcgagaagtacagagtgctggccagaagagtgaccctggacggcaaggtgcagtacctggtggagtgggagggcgccaccgccagctag

SEQ ID NO: 88693 - DNA, 1476 bp, Artificial Sequence; identical to SEQ ID NO: 88692
  Description of Artificial Sequence: Synthetic coding sequence

SEQ ID NO: 88694 - DNA, 1191 bp, Artificial Sequence
  Description of Artificial Sequence: Synthetic coding sequence
atggccatgatcgagctgggcttcggcagacagaacttccaccccctgaagagaaagagcagcctgctgctgaagctgatcgccgtggtgttcgccgtgctgctgttctgcgagttcctgatctactacctggccatcttccagtgcaactggcccgaggtgaagaccaccgccagcgacggcgagcagaccaccagagagcccgtgctgaaggccatgttcctggccgacacccacctgctgggcgagttcctgggccactggctggacaagctgagaagagagtggcagatggagagagccttccagaccgccctgtggctgctgcagcccgaggtggtgttcatcctgggcgacatcttcgacgagggcaagtggagcacccccgaggcctgggccgacgacgtggagagattccagaagatgttcagacaccccagccacgtgcagctgaaggtggtggccggcaaccacgacatcggcttccactacgagatgaacacctacaaggtggagagattcgagaaggtgttcagcagcgagagactgttcagctggaagggcatcaacttcgtgatggtgaacagcgtggccctgaacggcgacggctgcggcatctgcagcgagaccgaggccgagctgatcgaggtgagccacagactgaactgcagcagagaggccagaggcagcagcagatgcggccccggccccctgctgcccaccagcgcccccgtgctgctgcagcactaccccctgtacagaagaagcgacgccaactgcagcggcgaggacgccgcccccgccgaggagagagacatccccttcaaggagaactacgacgtgctgagcagagaggccagccagaagctgctgtggtggctgcagcccagactggtgctgagcggccacacccacagcgcctgcgaggtgcaccacggcggcagagtgcccgagctgagcgtgcccagcttcagctggagaaacagaaacaaccccagcttcatcatgggcagcatcacccccaccgactacaccctgagcaagtgctacctgcccagagaggacgtggtgctgatcatctactgcggcgtggtgggcttcctggtggtgctgaccctgacccacttcggcctgctggccagccccttcctgagcggcctgaacctgctgggcaagagaaagaccagatag

SEQ ID NO: 88695 - DNA, 1002 bp, Artificial Sequence
  Description of Artificial Sequence: Synthetic coding sequence
atggccatgatcgagctgggcttcggcagacagaacttccaccccctgaagagaaagagcagcctgctgctgaagctgatcgccgtggtgttcgccgtgctgctgttctgcgagttcctgatctactacctggccatcttccagtgcaactggcccgaggtgaagaccaccgccagcgacggcgagcagaccaccagagagcccgtgctgaaggccatgttcctggccgacacccacctgctgggcgagttcctgggccactggctggacaagctgagaagagagtggcagatggagagagccttccagaccgccctgtggctgctgcagcccgaggtggtgttcatcctgggcgacatcttcgacgagggcaagtggagcacccccgaggcctgggccgacgacgtggagagattccagaagatgttcagacaccccagccacgtgcagctgaaggtggtggccggcaaccacgacatcggcttccactacgagatgaacacctacaaggtggagagattcgagaaggtgttcagcagcgagagactgttcagctggaagggcatcaacttcgtgatggtgaacagcgtggccctgaacggcgacggctgcggcatctgcagcgagaccgaggccgagctgatcgaggtgagccacagactgaactgcagcagagagctgctgtggtggctgcagcccagactggtgctgagcggccacacccacagcgcctgcgaggtgcaccacggcggcagagtgcccgagctgagcgtgcccagcttcagctggagaaacagaaacaaccccagcttcatcatgggcagcatcacccccaccgactacaccctgagcaagtgctacctgcccagagaggacgtggtgctgatcatctactgcggcgtggtgggcttcctggtggtgctgaccctgacccacttcggcctgctggccagccccttcctgagcggcctgaacctgctgggcaagagaaagaccagatag

SEQ ID NO: 88696 - DNA, 732 bp, Artificial Sequence
  Description of Artificial Sequence: Synthetic coding sequence
atggagagagccttccagaccgccctgtggctgctgcagcccgaggtggtgttcatcctgggcgacatcttcgacgagggcaagtggagcacccccgaggcctgggccgacgacgtggagagattccagaagatgttcagacaccccagccacgtgcagctgaaggtggtggccggcaaccacgacatcggcttccactacgagatgaacacctacaaggtggagagattcgagaaggtgttcagcagcgagagactgttcagctggaagggcatcaacttcgtgatggtgaacagcgtggccctgaacggcgacggctgcggcatctgcagcgagaccgaggccgagctgatcgaggtgagccacagactgaactgcagcagagaggccagaggcagcagcagatgcggccccggccccctgctgcccaccagcgcccccgtgctgctgcagcactaccccctgtacagaagaagcgacgccaactgcagcggcgaggacgccgcccccgccgaggagagagacatccccttcaaggagaactacgacgtgctgagcagagaggccagccagaagctgctgtggtggctgcagcccagactggtgctgagcggccacacccacagcgcctgcgaggtgcaccacggcggcagagtgcccgagctgagcgtgcccagcttcagctggagaaacagaaacaaccccagcttcatcatgggcaccgacgcctag

SEQ ID NO: 88697 - DNA, 1194 bp, Artificial Sequence
  Description of Artificial Sequence: Synthetic coding sequence
atggccatgatcgagctgggcttcggcagacagaacttccaccccctgaagagaaagagcagcctgctgctgaagctgatcgccgtggtgttcgccgtgctgctgttctgcgagttcctgatctactacctggccatcttccagtgcaactggcccgaggtgaagaccaccgccagcgacggcgagcagaccaccagagagcccgtgctgaaggccatgttcctggccgacacccacctgctgggcgagttcctgggccactggctggacaagctgagaagagagtggcagatggagagagccttccagaccgccctgtggctgctgcagcccgaggtggtgttcatcctgggcgacatcttcgacgagggcaagtggagcacccccgaggcctgggccgacgacgtggagagattccagaagatgttcagacaccccagccacgtgcagctgaaggtggtggccggcaaccacgacatcggcttccactacgagatgaacacctacaaggtggagagattcgagaaggtgttcagcagcgagagactgttcagctggaagggcatcaacttcgtgatggtgaacagcgtggccctgaacggcgacggctgcggcatctgcagcgagaccgaggccgagctgatcgaggtgagccacagactgaactgcagcagagagcaggccagaggcagcagcagatgcggccccggccccctgctgcccaccagcgcccccgtgctgctgcagcactaccccctgtacagaagaagcgacgccaactgcagcggcgaggacgccgcccccgccgaggagagagacatccccttcaaggagaactacgacgtgctgagcagagaggccagccagaagctgctgtggtggctgcagcccagactggtgctgagcggccacacccacagcgcctgcgaggtgcaccacggcggcagagtgcccgagctgagcgtgcccagcttcagctggagaaacagaaacaaccccagcttcatcatgggcagcatcacccccaccgactacaccctgagcaagtgctacctgcccagagaggacgtggtgctgatcatctactgcggcgtggtgggcttcctggtggtgctgaccctgacccacttcggcctgctggccagccccttcctgagcggcctgaacctgctgggcaagagaaagaccagatag

SEQ ID NO: 88698 - DNA, 1026 bp, Artificial Sequence
  Description of Artificial Sequence: Synthetic coding sequence
atggccatgatcgagctgggcttcggcagacagaacttccaccccctgaagagaaagagcagcctgctgctgaagctgatcgccgtggtgttcgccgtgctgctgttctgcgagttcctgatctactacctggccatcttccagtgcaactggcccgaggtgaagaccaccgccagcgacggcgagcagaccaccagagagcccgtgctgaaggccatgttcctggccgacacccacctgctgggcgagttcctgggccactggctggacaagctgagaagagagtggcagatggagagagccttccagaccgccctgtggctgctgcagcccgaggtggtgttcatcctgggcgacatcttcgacgagggcaagtggagcacccccgaggcctgggccgacgacgtggagagattccagaagatgttcagacaccccagccacgtgcagctgaaggtggtggccggcaaccacgacatcggcttccactacgagatgaacacctacaaggtggagagattcgagaaggtgttcagcagcgagagactgttcagctggaagggcatcaacttcgtgatggtgaacagcgtggccctgaacggcgacggctgcggcatctgcagcgagaccgaggccgagctgatcgaggtgagccacagactgaactgcagcagagagcaggccagaggcagcagcagatgcggccccggccccctgctgcccaccagcgcccccgtgctgctgcagcactaccccctgtacagaagaagcgacgccaactgcagcggcgaggacgccgcccccgccgaggagagagacatccccttcaaggagaactacgacgtgctgagcagagaggccagccagaagctgctgtggtggctgcagcccagactggtgctgagcggccacacccacagcgcctgcgaggtgcaccacggcggcagagtgcccgagctgagcgtgcccagcttcagctggagaaacagaaacaaccccagcttcatcatgggcaccgacgcctag

SEQ ID NO: 88699 - DNA, 1191 bp, Artificial Sequence; identical to SEQ ID NO: 88694
  Description of Artificial Sequence: Synthetic coding sequence

SEQ ID NO: 88700 - DNA, 360 bp, Artificial Sequence
  Description of Artificial Sequence: Synthetic coding sequence
atgtggagaagcagatgggacgccagcgtgctgaaggccgaggccctggccctgctgccctgcggcctgggcatggccttcagccagagccacgtgatggccgccagaagacaccagcacagcagactgatcatcgaggtggacgagtacagcagcaaccccacccaggccttcaccttctacaacatcaaccagggcagattccagcccccccacgtgcagatggtggaccccgtgccccacgacgcccccaagccccccggctacaccagattcgtgtgcgtgagcgacacccacagcagaaccgaccccatccagatgccctacggcgacgtgctgatccacgccggcgacttctag

SEQ ID NO: 88701 - DNA, 663 bp, Artificial Sequence
  Description of Artificial Sequence: Synthetic coding sequence
atgccctacggcgacgtgctgatccacgccggcgacttcaccgagctgggcctgcccagcgaggtgaagaagttcaacgagtggctgggcagcctgccctacgagtacaagatcgtgatcgccggcaaccacgagctgaccttcgaccaggagttcatggccgacctgatcaagcaggacttctactacttccccagcgtgagcaagctgaagcccgagaactacgagaacgtgcagagcctgctgaccaactgcatctacctgcaggacagcgaggtgaccgtgagaggcttcagaatctacggcagcccctggcagccctggttctacggctggggcttcaacctgcccagaggccaggccctgctggagaagtggaacctgatccccgagggcgtggacatcctgatcacccacggcccccccctgggcttcctggactgggtgcccaagaagatgcagagagtgggctgcgtggagctgctgaacaccgtgcagagaagagtgcagcccagactgcacgtgttcggccacatccacgagggctacggcgtgatggccgacggcaccaccacctacgtgaacgccagcgtgtgcaccgtgaactaccagcccgtgaacccccccatcgtgatcgacctgcccacccccagaaacagctag

SEQ ID NO: 88702 - DNA, 981 bp, Artificial Sequence
  Description of Artificial Sequence: Synthetic coding sequence
atgtggagaagcagatgggacgccagcgtgctgaaggccgaggccctggccctgctgccctgcggcctgggcatggccttcagccagagccacgtgatggccgccagaagacaccagcacagcagactgatcatcgaggtggacgagtacagcagcaaccccacccaggccttcaccttctacaacatcaaccagggcagattccagcccccccacgtgcagatggtggaccccgtgccccacgacgcccccaagccccccggctacaccagattcgtgtgcgtgagcgacacccacagcagaaccgaccccatccagatgccctacggcgacgtgctgatccacgccggcgacttcaccgagctgggcctgcccagcgaggtgaagaagttcaacgagtggctgggcagcctgccctacgagtacaagatcgtgatcgccggcaaccacgagctgaccttcgaccaggagttcatggccgacctgatcaagcaggacttctactacttccccagcgtgagcaagctgaagcccgagaactacgagaacgtgcagagcctgctgaccaactgcatctacctgcaggacagcgaggtgaccgtgagaggcttcagaatctacggcagcccctggcagccctggttctacggctggggcttcaacctgcccagaggccaggccctgctggagaagtggaacctgatccccgagggcgtggacatcctgatcacccacggcccccccctgggcttcctggactgggtgcccaagaagatgcagagagtgggctgcgtggagctgctgaacaccgtgcagagaagagtgcagcccagactgcacgtgttcggccacatccacgagggctacggcgtgatggccgacggcaccaccacctacgtgaacgccagcgtgtgcaccgtgaactaccagcccgtgaacccccccatcgtgatcgacctgcccacccccagaaacagctag

SEQ ID NO: 88703 - DNA, 507 bp, Artificial Sequence
  Description of Artificial Sequence: Synthetic coding sequence
atggccgacctgatcaagcaggacttctactacttccccagcgtgagcaagctgaagcccgagaactacgagaacgtgcagagcctgctgaccaactgcatctacctgcaggacagcgaggtgaccgtgagaggcttcagaatctacggcagcccctggcagccctggttctacggctggggcttcaacctgcccagaggccaggccctgctggagaagtggaacctgatccccgagggcgtggacatcctgatcacccacggcccccccctgggcttcctggactgggtgcccaagaagatgcagagagtgggctgcgtggagctgctgaacaccgtgcagagaagagtgcagcccagactgcacgtgttcggccacatccacgagggctacggcgtgatggccgacggcaccaccacctacgtgaacgccagcgtgtgcaccgtgaactaccagcccgtgaacccccccatcgtgatcgacctgcccacccccagaaacagctag

SEQ ID NO: 88704 - DNA, 981 bp, Artificial Sequence; identical to SEQ ID NO: 88702
  Description of Artificial Sequence: Synthetic coding sequence

SEQ ID NO: 88705 - DNA, 225 bp, Artificial Sequence
  Description of Artificial Sequence: Synthetic coding sequence
atgtggagaagcagatgggacgccagcgtgctgaaggccgaggccctggccctgctgccctgcggcctgggcatggccttcagccagagccacgtgatggccgccagaagacaccagcacagcagactgatcatcgaggtggacgagtacagcagcaaccccacccaggccttcaccttctacaacatcaaccagggcagattccagcccccccacgtgcagtag

SEQ ID NO: 88706 - DNA, 1080 bp, Artificial Sequence
  Description of Artificial Sequence: Synthetic coding sequence
atgaacggcagagagacccagagcgtgagcagaagcggcggcggccccggctgcggcggcggcagcggcggcagatgcagaggcggcagaagaagaagcatgtggagaagcagatgggacgccagcgtgctgaaggccgaggccctggccctgctgccctgcggcctgggcatggccttcagccagagccacgtgatggccgccagaagacaccagcacagcagactgatcatcgaggtggacgagtacagcagcaaccccacccaggccttcaccttctacaacatcaaccagggcagattccagcccccccacgtgcagatggtggaccccgtgccccacgacgcccccaagccccccggctacaccagattcgtgtgcgtgagcgacacccacagcagaaccgaccccatccagatgccctacggcgacgtgctgatccacgccggcgacttcaccgagctgggcctgcccagcgaggtgaagaagttcaacgagtggctgggcagcctgccctacgagtacaagatcgtgatcgccggcaaccacgagctgaccttcgaccaggagttcatggccgacctgatcaagcaggacttctactacttccccagcgtgagcaagctgaagcccgagaactacgagaacgtgcagagcctgctgaccaactgcatctacctgcaggacagcgaggtgaccgtgagaggcttcagaatctacggcagcccctggcagccctggttctacggctggggcttcaacctgcccagaggccaggccctgctggagaagtggaacctgatccccgagggcgtggacatcctgatcacccacggcccccccctgggcttcctggactgggtgcccaagaagatgcagagagtgggctgcgtggagctgctgaacaccgtgcagagaagagtgcagcccagactgcacgtgttcggccacatccacgagggctacggcgtgatggccgacggcaccaccacctacgtgaacgccagcgtgtgcaccgtgaactaccagcccgtgaacccccccatcgtgatcgacctgcccacccccagaaacagctag

SEQ ID NO: 88707 - DNA, 981 bp, Artificial Sequence; identical to SEQ ID NO: 88702
  Description of Artificial Sequence: Synthetic coding sequence

SEQ ID NO: 88708 - DNA, 915 bp, Artificial Sequence
  Description of Artificial Sequence: Synthetic coding sequence
atgtggagaagcttcagccagagccacgtgatggccgccagaagacaccagcacagcagactgatcatcgaggtggacgagtacagcagcaaccccacccaggccttcaccttctacaacatcaaccagggcagattccagcccccccacgtgcagatggtggaccccgtgccccacgacgcccccaagccccccggctacaccagattcgtgtgcgtgagcgacacccacagcagaaccgaccccatccagatgccctacggcgacgtgctgatccacgccggcgacttcaccgagctgggcctgcccagcgaggtgaagaagttcaacgagtggctgggcagcctgccctacgagtacaagatcgtgatcgccggcaaccacgagctgaccttcgaccaggagttcatggccgacctgatcaagcaggacttctactacttccccagcgtgagcaagctgaagcccgagaactacgagaacgtgcagagcctgctgaccaactgcatctacctgcaggacagcgaggtgaccgtgagaggcttcagaatctacggcagcccctggcagccctggttctacggctggggcttcaacctgcccagaggccaggccctgctggagaagtggaacctgatccccgagggcgtggacatcctgatcacccacggcccccccctgggcttcctggactgggtgcccaagaagatgcagagagtgggctgcgtggagctgctgaacaccgtgcagagaagagtgcagcccagactgcacgtgttcggccacatccacgagggctacggcgtgatggccgacggcaccaccacctacgtgaacgccagcgtgtgcaccgtgaactaccagcccgtgaacccccccatcgtgatcgacctgcccacccccagaaacagctag

SEQ ID NO: 88709 - DNA, 885 bp, Artificial Sequence
  Description of Artificial Sequence: Synthetic coding sequence
atggcccacggcatccccagccagggcaaggtgaccatcaccgtggacgagtacagcagcaaccccacccaggccttcacccactacaacatcaaccagagcagattccagcccccccacgtgcacatggtggaccccatcccctacgacacccccaagcccgccggccacaccagattcgtgtgcatcagcgacacccacagcagaaccgacggcatccagatgccctacggcgacatcctgctgcacaccggcgacttcaccgagctgggcctgcccagcgaggtgaagaagttcaacgactggctgggcaacctgccctacgagtacaagatcgtgatcgccggcaaccacgagctgaccttcgacaaggagttcatggccgacctggtgaagcaggactactacagattccccagcgtgagcaagctgaagcccgaggacttcgacaacgtgcagagcctgctgaccaacagcatctacctgcaggacagcgaggtgaccgtgaagggcttcagaatctacggcgccccctggaccccctggttcaacggctggggcttcaacctgcccagaggccagagcctgctggacaagtggaacctgatccccgagggcatcgacatcctgatgacccacggcccccccctgggcttcagagactgggtgcccaaggagctgcagagagtgggctgcgtggagctgctgaacaccgtgcagagaagagtgagacccaagctgcacgtgttcggcggcatccacgagggctacggcatcatgaccgacggctacaccacctacatcaacgccagcacctgcaccgtgagcttccagcccaccaacccccccatcatcttcgacctgcccaacccccagggcagctag

SEQ ID NO: 88710 - DNA, 834 bp, Artificial Sequence
  Description of Artificial Sequence: Synthetic coding sequence
atggcccacggcatccccagccagggcaaggtgaccatcaccgtggacgagtacagcagcaaccccacccaggccttcacccactacaacatcaaccagagcagattccagcccccccacgtgcacatggtggaccccatcccctacgacacccccaagcccgccggccacaccagattcgtgtgcatcagcgacacccacagcagaaccgacggcatccagatgccctacggcgacatcctgctgcacaccggcgacttcaccgagctgggcctgcccagcgaggtgaagaagttcaacgactggctgggcaacctgccctacgagtacaagatcgtgatcgccggcaaccacgagctgaccttcgacaaggagttcatggccgacctggtgaagcaggactactacagattccccagcgtgagcaagctgaagcccgaggacttcgacaacgtgcagagcctgctgaccaacagcatctacctgcaggacagcgaggtgaccgtgaagggcttcagaatctacggcgccccctggaccccctggttcaacggctggggcttcaacctgcccagaggccagagcctgctggacaagtggaacctgatccccgagggcatcgacatcctgatgacccacggcccccccctgggcttcagagactgggtgcccaaggagctgcagagagtgggctgcgtggagctgctgaacaccgtgcagagaagagtgagacccaagctgcacgtgttcggcggcatccacgaggtgaaccccgtgagcatcagcaaggccctgagaaccaagatctgcagcctgcccagcaagaccagctag

SEQ ID NO: 88711 - DNA, 132 bp, Artificial Sequence
  Description of Artificial Sequence: Synthetic coding sequence
atggcccacggcatccccagccagggcaaggtgaccatcaccgtggacgagtacagcagcaaccccacccaggccttcacccactacaacatcaaccagagcagattccagcccccccacgtgcacatgtag

SEQ ID NO: 88712 - DNA, 186 bp, Artificial Sequence
  Description of Artificial Sequence: Synthetic coding sequence
atggaccccaactgcagctgcgccaccggcggcagctgcacctgcaccggcagctgcaagtgcaaggagtgcaagtgcaccagctgcaagaagagctgctgcagctgctgccccatgagctgcgccaagtgcgcccagggctgcatctgcaagggcgccagcgagaagtgcagctgctgcgcctag

SEQ ID NO: 88713 - DNA, 186 bp, Artificial Sequence
  Description of Artificial Sequence: Synthetic coding sequence
atggaccccaactgcagctgcaccaccggcggcagctgcgcctgcgccggcagctgcaagtgcaaggagtgcaagtgcaccagctgcaagaagtgctgctgcagctgctgccccgtgggctgcgccaagtgcgcccagggctgcgtgtgcaagggcagcagcgagaagtgcagatgctgcgcctag

SEQ ID NO: 88714 - DNA, 186 bp, Artificial Sequence
  Description of Artificial Sequence: Synthetic coding sequence
atggaccccaactgcagctgcgccaccggcggcagctgcacctgcgccggcagctgcaagtgcaaggagtgcaagtgcaccagctgcaagaagagctgctgcagctgctgccccgtgggctgcgccaagtgcgcccagggctgcgtgtgcaagggcgccagcgagaagtgcagctgctgcgcctag

SEQ ID NO: 88715 - DNA, 384 bp, Artificial Sequence
  Description of Artificial Sequence: Synthetic coding sequence
atggaccccaactgcagctgcgccaccggcggcagctgcacctgcgccggcagctgcaagtgcaaggagtgcaagtgcaccagctgcaagaagagcgagtgcggcgccatcagcagaaacctgggcctgtggctgagactgggcggcaacagcagactggccctgagcgccagcttctggggcaccggcctgagcctgcccagcctgcccgtgagcttccccctgcaggccttctgccccaagttcagatggggcagaaccgccttcttcagctgggacaccaaccccaactgcaccccctacggcttcagaaccgagctgtgccagaccaagaagagcatcctgtgggtgtgggtgctgagcagcagccaggcctgctactag

SEQ ID NO: 88716 - DNA, 186 bp, Artificial Sequence
  Description of Artificial Sequence: Synthetic coding sequence
atggaccccaactgcagctgcgccgccggcgtgagctgcacctgcgccggcagctgcaagtgcaaggagtgcaagtgcaccagctgcaagaagagctgctgcagctgctgccccgtgggctgcagcaagtgcgcccagggctgcgtgtgcaagggcgccagcgagaagtgcagctgctgcgactag

SEQ ID NO: 88717 - DNA, 189 bp, Artificial Sequence
  Description of Artificial Sequence: Synthetic coding sequence
atggaccccaactgcagctgcgccgccgccggcgtgagctgcacctgcgccggcagctgcaagtgcaaggagtgcaagtgcaccagctgcaagaagagctgctgcagctgctgccccgtgggctgcagcaagtgcgcccagggctgcgtgtgcaagggcgccagcgagaagtgcagctgctgcgactag

SEQ ID NO: 88718 - DNA, 189 bp, Artificial Sequence
  Description of Artificial Sequence: Synthetic coding sequence
atggaccccaactgcagctgcgccgccgccggcgtgagctgcacctgcgccagcagctgcaagtgcaaggagtgcaagtgcaccagctgcaagaagagctgctgcagctgctgccccgtgggctgcgccaagtgcgcccagggctgcatctgcaagggcgccagcgagaagtgcagctgctgcgcctag

SEQ ID NO: 88719 - DNA, 186 bp, Artificial Sequence
  Description of Artificial Sequence: Synthetic coding sequence
atggaccccaactgcagctgcgccgccggcgtgagctgcacctgcgccagcagctgcaagtgcaaggagtgcaagtgcaccagctgcaagaagagctgctgcagctgctgccccgtgggctgcgccaagtgcgcccagggctgcatctgcaagggcgccagcgagaagtgcagctgctgcgcctag

SEQ ID NO: 88720 - DNA, 186 bp, Artificial Sequence
  Description of Artificial Sequence: Synthetic coding sequence
atggaccccaactgcagctgcgaggccggcggcagctgcgcctgcgccggcagctgcaagtgcaagaagtgcaagtgcaccagctgcaagaagagctgctgcagctgctgccccctgggctgcgccaagtgcgcccagggctgcatctgcaagggcgccagcgagaagtgcagctgctgcgcctag

SEQ ID NO: 88721 - DNA, 186 bp, Artificial Sequence
  Description of Artificial Sequence: Synthetic coding sequence
atggaccccaactgcagctgcagccccgtgggcagctgcgcctgcgccggcagctgcaagtgcaaggagtgcaagtgcaccagctgcaagaagagctgctgcagctgctgccccgtgggctgcgccaagtgcgcccagggctgcatctgcaagggcaccagcgacaagtgcagctgctgcgcctag

SEQ ID NO: 88722 - DNA, 186 bp, Artificial Sequence
  Description of Artificial Sequence: Synthetic coding sequence
atggaccccaactgcagctgcgccgccggcgacagctgcacctgcgccggcagctgcaagtgcaaggagtgcaagtgcaccagctgcaagaagagctgctgcagctgctgccccgtgggctgcgccaagtgcgcccagggctgcatctgcaagggcgccagcgacaagtgcagctgctgcgcctag

SEQ ID NO: 88723 - DNA, 207 bp, Artificial Sequence
  Description of Artificial Sequence: Synthetic coding sequence
atggaccccgagacctgcccctgccccagcggcggcagctgcacctgcgccgacagctgcaagtgcgagggctgcaagtgcaccagctgcaagaagagctgctgcagctgctgccccgccgagtgcgagaagtgcgccaaggactgcgtgtgcaagggcggcgaggccgccgaggccgaggccgagaagtgcagctgctgccagtag

SEQ ID NO: 88724 - DNA, 687 bp, Artificial Sequence
  Description of Artificial Sequence: Synthetic coding sequence
atgaagatcaagcccggcttcatgggcaaggccacccccccctacgacgtgcagttccacatggaggccagcgtggagaactgcatcatcgtgagcatgaacaccgccgaccccggcagccagggcatcacccacagcctgctgctgcaggtgatcgacgacaagggcagcatcctgccccccaacaccgagggcaacatcggcatcagaatcaagcccgtgagacccgtgagcctgttcatgtgctacgagggcgaccccgagaagaccgccaaggtggagtgcggcgacttctacaacaccggcgacagaggcaagatggacgaggagggctacatctgcttcctgggcagaagcgacgacatcatcaacgccagcggctacagaatcggccccgccgaggtggagagcgccctggtggagcaccccgccgtggccgagagcgccgtggtgggcagccccgaccccatcagaggcgaggtggtgaaggccttcatcgtgctgaccccccagttcctgagccacgacaaggaccagctgaccaaggagctgcagcagcacgtgaagagcgtgaccgccccctacaagtaccccagaaaggtggagttcgtgagcgagctgcccaagaccatcaccggcaagatcgagagaaaggagctgagaaagaaggagaccggccagatgtag

SEQ ID NO: 88725 - DNA, 1527 bp, Artificial Sequence
  Description of Artificial Sequence: Synthetic coding sequence
atggaggagggccccctgcccggcggcctgcccagccccgaggacgccatggtgaccgagctgctgagccccgagggccccttcgccagcgagaacatcggcctgaaggcccccgtgaagtacgaggaggacgagttccacgtgttcaaggaggcctacctgggccccgccgaccccaaggagcccgtgctgcacgccttcaaccccgccctgggcgccgactgcaagggccaggtgaaggccaagctggccggcggcgacagcgacggcggcgagctgctgggcgagtaccccggcatccccgagctgagcgccctggaggacgtggccctgctgcaggccccccagccccccgcctgcaacgtgcacttcctgagcagcctgctgcccgcccacagaagccccgccgtgctgcccctgggcgcctgggtgctggagggcgccagccaccccggcgtgagaatgatccccgtggagatcaaggaggccggcggcaccaccaccagcaacaaccccgaggaggccaccctgcagaacctgctggcccaggagagctgctgcaagttccccagcagccaggagctggaggacgccagctgctgcagcctgaagaaggacagcaaccccatggtgatctgccagctgaagggcggcacccagatgctgtgcatcgacaacagcagaaccagagagctgaaggccctgcacctggtgccccagtaccaggaccagaacaactacctgcagagcgacgtgcccaagcccatgaccgccctggtgggcagattcctgcccgccagcaccaagctgaacctgatcacccagcagctggagggcgccctgcccagcgtggtgaacggcagcgccttccccagcggcagcaccctgcccggcccccccaagatcaccctggccggctactgcgactgcttcgccagcggcgacttctgcaacaactgcaactgcaacaactgctgcaacaacctgcaccacgacatcgagagattcaaggccatcaaggcctgcctgggcagaaaccccgaggccttccagcccaagatcggcaagggccagctgggcaacgtgaagccccagcacaacaagggctgcaactgcagaagaagcggctgcctgaagaactactgcgagtgctacgaggcccagatcatgtgcagcagcatctgcaagtgcatcggctgcaagaactacgaggagagccccgagagaaagaccctgatgagcatgcccaactacatgcagaccggcggcctggagggcagccactacctgccccccaccaagttcagcggcctgcccagattcagccacgacagaagacccagcagctgcatcagctgggaggtggtggaggccacctgcgcctgcctgctggcccagggcgaggaggccgagaaggagcactgcagcaagtgcctggccgagcagatgatcctggaggagttcggcagatgcctgagccagatcctgcacaccgagttcaagagcaagggcctgaagatggagtag

SEQ ID NO: 88726 - DNA, 756 bp, Artificial Sequence
  Description of Artificial Sequence: Synthetic coding sequence
atggaggagggccccctgcccggcggcctgcccagccccgaggacgccatggtgaccgagctgctgagccccgagggccccttcgccagcgagaacatcggcctgaaggcccccgtgaagtacgaggaggacgagttccacgtgttcaaggaggcctacctgggccccgccgaccccaaggagcccgtgctgcacgccttcaaccccgccctgggcgccgactgcaagggccaggtgaaggccaagctggccggcggcgacagcgacggcggcgagctgctgggcgagtaccccggcatccccgagctgagcgccctggaggacgtggccctgctgcaggccccccagccccccgcctgcaacgtgcacttcctgagcagcctgctgcccgcccacagaagccccgccgtgctgcccctgggcgcctgggtgctggagggcgccagccaccccggcgtgagaatgatccccgtggagatcaaggaggccggcggcaccaccaccagcaacaaccccgaggaggccaccctgcagaacctgctggcccaggagagctgctgcaagttccccagcagccaggagctggaggacgccagctgctgcagcctgaagaaggacagcaaccccatggtgatctgccagctgaagggcggcacccagatgctgtgcatcgacaacagcagaaccagagagctgaaggccctgcacctggtgccccagtaccaggaccagaacaactacctgcagagcgcctag

SEQ ID NO: 88727 - DNA, 921 bp, Artificial Sequence
  Description of Artificial Sequence: Synthetic coding sequence
atggaggagggccccctgcccggcggcctgcccagccccgaggacgccatggtgaccgagctgctgagccccgagggccccttcgccagcgagaacatcggcctgaaggcccccgtgaagtacgaggaggacgagttccacgtgttcaaggaggcctacctgggccccgccgaccccaaggagcccgtgctgcacgccttcaaccccgccctgggcgccgactgcaagggccaggtgaaggccaagctggccggcggcgacagcgacggcggcgagctgctgggcgagtaccccggcatccccgagctgagcgccctggaggacgtggccctgctgcaggccccccagccccccgcctgcaacgtgcacttcctgagcagcctgctgcccgcccacagaagccccgccgtgctgcccctgggcgcctgggtgctggagggcgccagccaccccggcgtgagaatgatccccgtggagatcaaggaggccggcggcaccaccaccagcaacaaccccgaggaggccaccctgcagaacctgctggcccaggagagctgctgcaagttccccagcagccaggagctggaggacgccagctgctgcagcctgaagaaggacagcaaccccatggtgatctgccagctgaagggcggcacccagatgctgtgcatcgacaacagcagaaccagagagctgaaggccctgcacctggtgccccagtaccaggaccagaacaactacctgcagagcgacgtgcccaagcccatgaccgccctggtgggcagattcctgcccgccagcaccaagctgaacctgatcacccagcagctggagggcgccctgcccagcgtggtgaacggcagcgccttccccagcggcagcaccctgcccggcccccccaagatcaccctggccggctag

SEQ ID NO: 88728 - DNA, 2262 bp, Artificial Sequence
  Description of Artificial Sequence: Synthetic coding sequence
atgggcgagcacagccccgacaacaacatcatctacttcgaggccgaggaggacgagctgacccccgacgacaagatgctgagattcgtggacaagaacggcctggtgcccagcagcagcggcaccgtgtacgacagaaccaccgtgctgatcgagcaggaccccggcaccctggaggacgaggacgacgacggccagtgcggcgagcacctgcccttcctggtgggcggcgaggagggcttccacctgatcgaccacgaggccatgagccagggctacgtgcagcacatcatcagccccgaccagatccacctgaccatcaaccccggcagcacccccatgcccagaaacatcgagggcgccaccctgaccctgcagagcgagtgccccgagaccaagagaaaggaggtgaagagataccagtgcaccttcgagggctgccccagaacctacagcaccgccggcaacctgagaacccaccagaagacccacagaggcgagtacaccttcgtgtgcaaccaggagggctgcggcaaggccttcctgaccagctacagcctgagaatccacgtgagagtgcacaccaaggagaagcccttcgagtgcgacgtgcagggctgcgagaaggccttcaacaccctgtacagactgaaggcccaccagagactgcacaccggcaagaccttcaactgcgagagcgagggctgcagcaagtacttcaccaccctgagcgacctgagaaagcacatcagaacccacaccggcgagaagcccttcagatgcgaccacgacggctgcggcaaggccttcgccgccagccaccacctgaagacccacgtgagaacccacaccggcgagagacccttcttctgccccagcaacggctgcgagaagaccttcagcacccagtacagcctgaagagccacatgaagggccacgacaacaagggccacagctacaacgccctgccccagcacaacggcagcgaggacaccaaccacagcctgtgcctgagcgacctgagcctgctgagcaccgacagcgagctgagagagaacagcagcaccacccagggccaggacctgagcaccatcagccccgccatcatcttcgagagcatgttccagaacagcgacgacaccgccatccaggaggacccccagcagaccgccagcctgaccgagagcttcaacggcgacgccgagagcgtgagcgacgtgccccccagcaccggcaacagcgccagcctgagcctgcccctggtgctgcagcccggcctgagcgagcccccccagcccctgctgcccgccagcgcccccagcgcccccccccccgcccccagcctgggccccggcagccagcaggccgccttcggcaacccccccgccctgctgcagccccccgaggtgcccgtgccccacagcacccagttcgccgccaaccaccaggagttcctgccccacccccaggccccccagcccatcgtgcccggcctgagcgtggtggccggcgccagcgccagcgccgccgccgtggccagcgccgtggccgcccccgcccccccccagagcaccaccgagcccctgcccgccatggtgcagaccctgcccctgggcgccaacagcgtgctgaccaacaaccccaccatcaccatcacccccacccccaacaccgccatcctgcagagcagcctggtgatgggcgagcagaacctgcagtggatcctgaacggcgccaccagcagcccccagaaccaggagcagatccagcaggccagcaaggtggagaaggtgttcttcaccaccgccgtgcccgtggccagcagccccggcagcagcgtgcagcagatcggcctgagcgtgcccgtgatcatcatcaagcaggaggaggcctgccagtgccagtgcgcctgcagagacagcgccaaggagagagccagcagcagaagaaagggctgcagcagcccccccccccccgagcccagcccccaggcccccgacggccccagcctgcagctgcccgcccagaccttcagcagcgcccccgtgcccggcagcagcagcagcaccctgcccagcagctgcgagcagagcagacaggccgagacccccagcgacccccagaccgagaccctgagcgccatggacgtgagcgagttcctgagcctgcagagcctggacacccccagcaacctgatccccatcgaggccctgctgcagggcgaggaggagatgggcctgaccagcagcttcagcaagtag

SEQ ID NO: 88729 - DNA, 603 bp, Artificial Sequence
  Description of Artificial Sequence: Synthetic coding sequence
aagcagagccaggtgaagagataccagtgcaccttcgagggctgccccagaacctacagcaccgccggcaacctgagaacccaccagaagacccacagaggcgagtacaccttcgtgtgcaaccaggagggctgcggcaaggccttcctgaccagctacagcctgagaatccacgtgagagtgcacaccaaggagaagcccttcgagtgcgacgtgcagggctgcgagaaggccttcaacaccctgtacagactgaaggcccaccagagactgcacaccggcaagaccttcaactgcgagagcgagggctgcagcaagtacttcaccaccctgagcgacctgagaaagcacatcagaacccacaccggcgagaagcccttcagatgcgaccacgacggctgcggcaaggccttcgccgccagccaccacctgaagacccacgtgagaacccacaccggcgagagacccttcttctgccccagcaacggctgcgagaagaccttcagcacccagtacagcctgaagagccacatgaagggccacgacaacaagggccacagctacaacgccctgccccagcacaacggcagcgagagcacctag

SEQ ID NO: 88730 - DNA, 2559 bp, Artificial Sequence
  Description of Artificial Sequence: Synthetic coding sequence
atgctgatcaccgagagaaagcacttcagaagcggcagaatcgcccagagcatgagcgaggccaacctgatcgacatggaggccggcaagctgagcaagagctgcaacatcaccgagtgccaggaccccgacctgctgcacaactggcccgacgccttcaccctgagaggcaacaacgccagcaaggtggccaaccccttctggaaccagctgagcgccagcaaccccttcctggacgacatcacccagctgagaaacaacagaaagagaaacaacatcagcatcctgaaggaggaccccttcctgttctgcagagagatcgagaacggcaacagcttcgacagcagcggcgacgagctggacgtgcaccagctgctgagacagaccagcagcagaaacagcggcagaagcaagagcgtgagcgagctgctggacatcctggacgacaccgcccacgcccaccagagcatccacaacagcgaccagatcctgctgcacgacctggagtggctgaagaacgacagagaggcctacaagatggcctggctgagccagagacagctggccagaagctgcctggacctgaacaccatcagccagagccccggctgggcccagacccagctggccgaggtgaccatcgcctgcaaggtgaaccaccagggcggcagcgtgcagctgcccgagagcgacatcaccgtgcacgtgccccagggccacgtggccgtgggcgagttccaggaggtgagcctgagagccttcctggaccccccccacatgctgaaccacgacctgagctgcaccgtgagccccctgctggagatcatgctgggcaacctgaacaccatggaggccctgctgctggagatgaagatcggcgccgaggtgagaaaggaccccttcagccaggtgatgaccgagatggtgtgcctgcacagcctgggcaaggagggccccttcaaggtgctgagcaactgctacatctacaaggacaccatccaggtgaagctgatcgacctgagccaggtgatgtacctggtggtggccgcccaggccaaggccctgcccagccccgccgccaccatctgggactacatccacaagaccaccagcatcggcatctacggccccaagtacatccaccccagcttcaccgtggtgctgaccgtgtgcggccacaactacatgcccggccagctgaccatcagcgacatcaagaagggcggcaagaacatcagccccgtggtgttccagctgtggggcaagcagagcttcctgctggacaagccccaggacctgagcatcagcatcttcagctgcgaccccgacttcgaggtgaagaccgagggcgagagaaaggagatcaagcagaagcagctggaggccggcgaggtggtgcaccagcagttcctgttcagcctggtggagcacagagagatgcacctgttcgacttctgcgtgcaggtggagccccccaacggcgagcccgtggcccagttcagcatcaccacccccgaccccacccccaacctgaagagactgagcaacctgcccggctacctgcagaagaaggaggagatcaagagcgcccccctgagccccaagatcctggtgaagtaccccaccttccaggacaagaccctgaacttcagcaactacggcgtgaccctgaaggccgtgctgagacagagcaagatcgactacttcctggagtacttcaagggcgacaccatcgccctgctgggcgagggcaaggtgaaggccatcggccagagcaaggtgaaggagtggtacgtgggcgtgctgagaggcaagatcggcctggtgcactgcaagaacgtgaaggtgatcagcaaggagcaggtgatgttcatgagcgacagcgtgttcaccaccagaaacctgctggagcagatcgtgctgcccctgaagaagctgacctacatctacagcgtggtgctgaccctggtgagcgagaaggtgtacgactggaaggtgctggccgacgtgctgggctacagccacctgagcctggaggacttcgaccagatccaggccgacaaggagagcgagaaggtgagctacgtgatcaagaagctgaaggaggactgccacaccgagagaaacaccagaaagttcctgtacgagctgatcgtggccctgctgaagatggactgccaggagctggtggccagactgatccaggaggccgccgtgctgaccagcgccgtgaagctgggcaagggctggagagagctggccgagaagctggtgagactgaccaagcagcagatggaggcctacgagatcccccacagaggcaacaccggcgacgtggccgtggagatgatgtggaagcccgcctacgacttcctgtacacctggagcgcccactacggcaacaactacagagacgtgctgcaggacctgcagagcgccctggacagaatgaagaaccccgtgaccaagcactggagagagctgaccggcgtgctgatcctggtgaacagcctggaggtgctgagagtgaccgccttcagcaccagcgaggaggtgtag

SEQ ID NO: 88731 - DNA, 2559 bp, Artificial Sequence; identical to SEQ ID NO: 88730
  Description of Artificial Sequence: Synthetic coding sequence

SEQ ID NO: 88732 - DNA, 1308 bp, Artificial Sequence
  Description of Artificial Sequence: Synthetic coding sequence
atgctgctgggcggcccccccagaagccccagaagcggcaccagccccaagggcccctggagcagcaccggccacgtgcagttcggcaagagcccccagacctggcccagaagaaccagacccagaagccccgagcccgccgcccccagcggcgtgagaggcagcacctggaccagaagaagagacacccccagaagagccggccccaccgccctgagcagatacgtgggccacctgtggatgggcagaagaccccccagccccgaggccagaggccccgtgcccagaagcagcgccgccagcagagccagaagaagcctggccagccccggcatcagccccggccccctgaccgccaccatcggcggcgccgtggccggcggcggccccagacagggcagagccgaggcccacaaggaggtgttccccggccagagagtgggcaagatggccgcccccatggagctgttctgctggagcggcggctggggcctgcccagcgtggacctggacagcctggccgtgctgacctacgccagattcaccggcgcccccctgaaggtgcacaagatcagcaacccctggcagagccccagcggcaccctgcccgccctgagaaccagccacggcgaggtgatcagcgtgccccacaagatcatcacccacctgagaaaggaggtgcacaccttctggatcgacaccaagaactacgtggaggtgaccagaaagtggtacgccgaggccatgcccttccccctgaacttcttcctgcccggcagaatgcagagacagtacatggagagactgcagctgctgaccggcgagcacagacccgaggacgaggaggagctggagaaggagctgtacagagaggccagagagtgcctgaccctgctgagccagagactgggcagccagaagttcttcttcggcgacgcccccgccagcctggacgccttcgtgttcagctacctggccctgctgctgcaggccaagctgcccagcggcaagctgcaggtgcacctgagaggcctgcacaacctgtgcgcctactgcacccacatcctgagcctgtacttcccctgggacggcgccgaggtgcccccccagagacagacccccgccggccccgagaccgaggaggagccctacagaagaagaaaccagatcctgagcgtgctggccggcctggccgccatggtgggctacgccctgctgagcggcatcgtgagcatccagagagccacccccgccagagcccccggcaccagaaccctgggcatggccgaggaggacgaggaggagtag

SEQ ID NO: 88733 - DNA, 1401 bp, Artificial Sequence
  Description of Artificial Sequence: Synthetic coding sequence
atgctgctgggcggcccccccagaagccccagaagcggcaccagccccaagggcccctggagcagcaccggccacgtgcagttcggcaagagcccccagacctggcccagaagaaccagacccagaagccccgagcccgccgcccccagcggcgtgagaggcagcacctggaccagaagaagagacacccccagaagagccggccccaccgccctgagcagatacgtgggccacctgtggatgggcagaagaccccccagccccgaggccagaggccccgtgcccagaagcagcgccgccagcagagccagaagaagcctggccagccccggcatcagccccggccccctgaccgccaccatcggcggcgccgtggccggcggcggccccagacagggcagagccgaggcccacaaggaggtgttccccggccagagagtgggcaagatggccgcccccatggagctgttctgctggagcggcggctggggcctgcccagcgtggacctggacagcctggccgtgctgacctacgccagattcaccggcgcccccctgaaggtgcacaagatcagcaacccctggcagagccccagcggcaccctgcccgccctgagaaccagccacggcgaggtgatcagcgtgccccacaagatcatcacccacctgagaaaggagaagtacaacgccgactacgacctgagcgccagacagggcgccgacaccctggccttcatgagcctgctggaggagaagctgctgcccgtgctggtgcacaccttctggatcgacaccaagaactacgtggaggtgaccagaaagtggtacgccgaggccatgcccttccccctgaacttcttcctgcccggcagaatgcagagacagtacatggagagactgcagctgctgaccggcgagcacagacccgaggacgaggaggagctggagaaggagctgtacagagaggccagagagtgcctgaccctgctgagccagagactgggcagccagaagttcttcttcggcgacgcccccgccagcctggacgccttcgtgttcagctacctggccctgctgctgcaggccaagctgcccagcggcaagctgcaggtgcacctgagaggcctgcacaacctgtgcgcctactgcacccacatcctgagcctgtacttcccctgggacggcgccgaggtgcccccccagagacagacccccgccggccccgagaccgaggaggagccctacagaagaagaaaccagatcctgagcgtgctggccggcctggccgccatggtgggctacgccctgctgagcggcatcgtgagcatccagagagccacccccgccagagcccccggcaccagaaccctgggcatggccgaggaggacgaggaggagtag

SEQ ID NO: 88734 - DNA, 951 bp, Artificial Sequence
  Description of Artificial Sequence: Synthetic coding sequence
tgagagggcggccaggacggcggcgcccacggcgccgtgctgctggtgagaggcctgggcgccgccgtgagcggccccggccagcccggcagagccgacctgtgccagatctactggtgcagcaccgagggcacccaggaccagcagcccctggccgagcccttcagataccccgtgagcctgggcggcaccctgcccgccctgagaaccagccacggcgaggtgatcagcgtgccccacaagatcatcacccacctgagaaaggagaagtacaacgccgactacgacctgagcgccagacagggcgccgacaccctggccttcatgagcctgctggaggagaagctgctgcccgtgctggtgcacaccttctggatcgacaccaagaactacgtggaggtgaccagaaagtggtacgccgaggccatgcccttccccctgaacttcttcctgcccggcagaatgcagagacagtacatggagagactgcagctgctgaccggcgagcacagacccgaggacgaggaggagctggagaaggagctgtacagagaggccagagagtgcctgaccctgctgagccagagactgggcagccagaagttcttcttcggcgacgcccccgccagcctggacgccttcgtgttcagctacctggccctgctgctgcaggccaagctgcccagcggcaagctgcaggtgcacctgagaggcctgcacaacctgtgcgcctactgcacccacatcctgagcctgtacttcccctgggacggcgccgaggtgcccccccagagacagacccccgccggccccgagaccgaggaggagccctacagaagaagaaaccagatcctgagcgtgctggccggcctggccgccatggtgggctacgccctgctgagcggcatcgtgagcatccagagagccacccccgccagagcccccggctag

SEQ ID NO: 88735 - DNA, 1188 bp, Artificial Sequence
  Description of Artificial Sequence: Synthetic coding sequence
atgaacggccccgtggacggcctgtgcgaccacagcctgagcgagggcgtgttcatgttcaccagcgagagcgtgggcgagggccaccccgacaagatctgcgaccagatcagcgacgccgtgctggacgcccacctgaagcaggaccccaacgccaaggtggcctgcgagaccgtgtgcaagaccggcatggtgctgctgtgcggcgagatcaccagcatggccatggtggactaccagagagtggtgagagacaccatcaagcacatcggctacgacgacagcgccaagggcttcgacttcaagacctgcaacgtgctggtggccctggagcagcagagccccgacatcgcccagtgcgtgcacctggacagaaacgaggaggacgtgggcgccggcgaccagggcctgatgttcggctacgccaccgacgagaccgaggagtgcatgcccctgaccatcatcctggcccacaagctgaacgccagaatggccgacctgagaagaagcggcctgctgccctggctgagacccgacagcaagacccaggtgaccgtgcagtacatgcaggacaacggcgccgtgatccccgtgagaatccacaccatcgtgatcagcgtgcagcacaacgaggacatcaccctggaggagatgagaagagccctgaaggagcaggtgatcagagccgtggtgcccgccaagtacctggacgaggacaccgtgtaccacctgcagcccagcggcagattcgtgatcggcggcccccagggcgacgccggcgtgaccggcagaaagatcatcgtggacacctacggcggctggggcgcccacggcggcggcgccttcagcggcaaggactacaccaaggtggacagaagcgccgcctacgccgccagatgggtggccaagagcctggtgaaggccggcctgtgcagaagagtgctggtgcaggtgagctacgccatcggcgtggccgagcccctgagcatcagcatcttcacctacggcaccagccagaagaccgagagagagctgctggacgtggtgcacaagaacttcgacctgagacccggcgtgatcgtgagagacctggacctgaagaagcccatctaccagaagaccgcctgctacggccacttcggcagaagcgagttcccctgggaggtgcccagaaagctggtgttctag

SEQ ID NO: 88736 - DNA, 1188 bp, Artificial Sequence; identical to SEQ ID NO: 88735
  Description of Artificial Sequence: Synthetic coding sequence

SEQ ID NO: 88737 - DNA, 438 bp, Artificial Sequence
  Description of Artificial Sequence: Synthetic coding sequence
gagagcgtgggcgagggccaccccgacaagatctgcgaccagatcagcgacgccgtgctggacgcccacctgaagcaggaccccaacgccaaggtggcctgcggcttcgacttcaagacctgcaacgtgctggtggccctggagcagcagagccccgacatcgcccagtgcgtgcacctggacagaaacgaggaggacgtgggcgccggcgaccagggcctgatgttcggctacgccaccgacgagaccgaggagtgcatgcccctgaccatcatcctggcccacaagctgaacgccagaatggccgacctgagaagaagcggcctgctgccctggctgagacccgacagcaagacccaggtgaccgtgcagtacatgcaggacaacggcgccgtgatccccgtgagaatccacaccatcgtgatcagcgtgcagtag

SEQ ID NO: 88738 - DNA, 1188 bp, Artificial Sequence
  Description of Artificial Sequence: Synthetic coding sequence
atgaacggccagctgaacggcttccacgaggccttcatcgaggagggcaccttcctgttcaccagcgagagcgtgggcgagggccaccccgacaagatctgcgaccagatcagcgacgccgtgctggacgcccacctgcagcaggaccccgacgccaaggtggcctgcgagaccgtggccaagaccggcatgatcctgctggccggcgagatcaccagcagagccgccgtggactaccagaaggtggtgagagaggccgtgaagcacatcggctacgacgacagcagcaagggcttcgactacaagacctgcaacgtgctggtggccctggagcagcagagccccgacatcgcccagggcgtgcacctggacagaaacgaggaggacatcggcgccggcgaccagggcctgatgttcggctacgccaccgacgagaccgaggagtgcatgcccctgaccatcgtgctggcccacaagctgaacgccaagctggccgagctgagaagaaacggcaccctgccctggctgagacccgacagcaagacccaggtgaccgtgcagtacatgcaggacagaggcgccgtgctgcccatcagagtgcacaccatcgtgatcagcgtgcagcacgacgaggaggtgtgcctggacgagatgagagacgccctgaaggagaaggtgatcaaggccgtggtgcccgccaagtacctggacgaggacaccatctaccacctgcagcccagcggcagattcgtgatcggcggcccccagggcgacgccggcctgaccggcagaaagatcatcgtggacacctacggcggctggggcgcccacggcggcggcgccttcagcggcaaggactacaccaaggtggacagaagcgccgcctacgccgccagatgggtggccaagagcctggtgaagggcggcctgtgcagaagagtgctggtgcaggtgagctacgccatcggcgtgagccaccccctgagcatcagcatcttccactacggcaccagccagaagagcgagagagagctgctggagatcgtgaagaagaacttcgacctgagacccggcgtgatcgtgagagacctggacctgaagaagcccatctaccagagaaccgccgcctacggccacttcggcagagacagcttcccctgggaggtgcccaagaagctgaagtactag

SEQ ID NO: 88739 - DNA, 531 bp, Artificial Sequence
  Description of Artificial Sequence: Synthetic coding sequence
atgaacggccagctgaacggcttccacgaggccttcatcgaggagggcaccttcctgttcaccagcgagagcgtgggcgagggccaccccgacaagatctgcgaccagatcggcgacgccggcctgaccggcagaaagatcatcgtggacacctacggcggctggggcgcccacggcggcggcgccttcagcggcaaggactacaccaaggtggacagaagcgccgcctacgccgccagatgggtggccaagagcctggtgaagggcggcctgtgcagaagagtgctggtgcaggtgagctacgccatcggcgtgagccaccccctgagcatcagcatcttccactacggcaccagccagaagagcgagagagagctgctggagatcgtgaagaagaacttcgacctgagacccggcgtgatcgtgagagacctggacctgaagaagcccatctaccagagaaccgccgcctacggccacttcggcagagacagcttcccctgggaggtgcccaagaagctgaagtactag

SEQ ID NO: 88740 - DNA, 549 bp, Artificial Sequence
  Description of Artificial Sequence: Synthetic coding sequence
atggccagactgctgtggctgctgagaggcctgaccctgggcaccgcccccagaagagccgtgagaggccaggccggcggcggcggccccggcaccggccccggcctgggcgaggccggcagcctggccacctgcgagctgcccctggccaagagcgagtggcagaagaagctgacccccgagcagttctacgtgaccagagagaagggcaccgagccccccttcagcggcatctacctgaacaacaaggaggccggcatgtaccactgcgtgtgctgcgacagccccctgttcagcagcgagaagaagtactgcagcggcaccggctggcccagcttcagcgaggcccacggcaccagcggcagcgacgagagccacaccggcatcctgagaagactggacaccagcctgggcagcgccagaaccgaggtggtgtgcaagcagtgcgaggcccacctgggccacgtgttccccgacggccccggccccaacggccagagattctgcatcaacagcgtggccctgaagttcaagcccagaaagcactag

SEQ ID NO: 88741 - DNA, 558 bp, Artificial Sequence
  Description of Artificial Sequence: Synthetic coding sequence
atgagcgccttcaacctgctgcacctggtgaccaagagccagcccgtggccctgagagcctgcggcctgcccagcggcagctgcagagacaagaagaactgcaaggtggtgttcagccagcaggagctgagaaagagactgacccccctgcagtaccacgtgacccaggagaagggcaccgagagcgccttcgagggcgagtacacccaccacaaggaccccggcatctacaagtgcgtggtgtgcggcacccccctgttcaagagcgagaccaagttcgacagcggcagcggctggcccagcttccacgacgtgatcaacagcgaggccatcaccttcaccgacgacttcagctacggcatgcacagagtggagaccagctgcagccagtgcggcgcccacctgggccacatcttcgacgacggccccagacccaccggcaagagatactgcatcaacagcgccgccctgagcttcacccccgccgacagcagcggcaccgccgagggcggcagcggcgtggccagccccgcccaggccgacaaggccgagctgtag

SEQ ID NO: 88742 - DNA, 579 bp, Artificial Sequence
  Description of Artificial Sequence: Synthetic coding sequence
atgagccccagaagaaccctgcccagacccctgagcctgtgcctgagcctgtgcctgtgcctgtgcctggccgccgccctgggcagcgcccagagcggcagctgcagagacaagaagaactgcaaggtggtgttcagccagcaggagctgagaaagagactgacccccctgcagtaccacgtgacccaggagaagggcaccgagagcgccttcgagggcgagtacacccaccacaaggaccccggcatctacaagtgcgtggtgtgcggcacccccctgttcaagagcgagaccaagttcgacagcggcagcggctggcccagcttccacgacgtgatcaacagcgaggccatcaccttcaccgacgacttcagctacggcatgcacagagtggagaccagctgcagccagtgcggcgcccacctgggccacatcttcgacgacggccccagacccaccggcaagagatactgcatcaacagcgccgccctgagcttcacccccgccgacagcagcggcaccgccgagggcggcagcggcgtggccagccccgcccaggccgacaaggccgagctgtag

SEQ ID NO: 88743 - DNA, 495 bp, Artificial Sequence
  Description of Artificial Sequence: Synthetic coding sequence
atgagcgccttcaacctgctgcacctggtgaccaagagccagcccgtggccctgagagcctgcggcctgcccagcggcagctgcagagacaagaagaactgcaaggtggtgttcagccagcaggagctgagaaagagactgacccccctgcagtaccacgtgacccaggagaagggcaccgagagcgccttcgagggcgagtacacccaccacaaggaccccggcatctacaagtgcgtggtgtgcggcacccccctgttcaagagcgagaccaagttcgacagcggcagcggctggcccagcttccacgacgtgatcaacagcgaggccatcaccttcaccgacgacttcagctacggcatgcacagagtggagaccagctgcagccagtgcggcgcccacctgggccacatcttcgacgacggccccagacccaccggcaagagatactgcatcaacagcgccgccctgagcttcacccccgccgacagctag

SEQ ID NO: 88744 - DNA, 558 bp, Artificial Sequence; identical to SEQ ID NO: 88741
  Description of Artificial Sequence: Synthetic coding sequence

SEQ ID NO: 88745 - DNA, 354 bp, Artificial Sequence
  Description of Artificial Sequence: Synthetic coding sequence
atgagcgccttcaacctgctgcacctggtgaccaagagccagcccgtggccctgagagcctgcggcctgcccagcggcagctgcagagacaagaagaactgcaaggtggtgttcagccagcaggagctgagaaagagactgacccccctgcagtaccacgtgacccaggagaagggcaccgagagcgccttcgagggcgagtacacccaccacaaggaccccggcatctacaagtgcgtggtgtgcggcacccccctgttcaagagcgagaccaagttcgacagcggcagcggctggcccagcttccacgacgtgatcaacagcgaggccatcaccttcaccgacgacttctag

SEQ ID NO: 88746 - DNA, 2703 bp, Artificial Sequence
  Description of Artificial Sequence: Synthetic coding sequence
atgagactgttcgtgagcgacggcgtgcccggctgcctgcccgtgctggccgccgccggcagagccagaggcagagccgaggtgctgatcagcaccgtgggccccgaggactgcgtggtgcccttcctgaccagacccaaggtgcccgtgctgcagctggacagcggcaactacctgttcagcaccagcgccatctgcagatacttcttcctgctgagcggctgggagcaggacgacctgaccaaccagtggctggagtgggaggccaccgagctgcagcccgccctgagcgccgccctgtactacctggtggtgcagggcaagaagggcgaggacgtgctgggcagcgtgagaagagccctgacccacatcgaccacagcctgagcagacagaactgccccttcctggccggcgagaccgagagcctggccgacatcgtgctgtggggcgccctgtaccccctgctgcaggaccccgcctacctgcccgaggagctgagcgccctgcacagctggttccagaccctgagcacccaggagccctgccagagagccgccgagaccgtgctgaagcagcagggcgtgctggccctgagaccctacctgcagaagcagccccagcccagccccgccgagggcagagccgtgaccaacgagcccgaggaggaggagctggccaccctgagcgaggaggagatcgccatggccgtgaccgcctgggagaagggcctggagagcctgccccccctgagaccccagcagaaccccgtgctgcccgtggccggcgagagaaacgtgctgatcaccagcgccctgccctacgtgaacaacgtgccccacctgggcaacatcatcggctgcgtgctgagcgccgacgtgttcgccagatacagcagactgagacagtggaacaccctgtacctgtgcggcaccgacgagtacggcaccgccaccgagaccaaggccctggaggagggcctgaccccccaggagatctgcgacaagtaccacatcatccacgccgacatctacagatggttcaacatcagcttcgacatcttcggcagaaccaccaccccccagcagaccaagatcacccaggacatcttccagcagctgctgaagagaggcttcgtgctgcaggacaccgtggagcagctgagatgcgagcactgcgccagattcctggccgacagattcgtggagggcgtgtgccccttctgcggctacgaggaggccagaggcgaccagtgcgacaagtgcggcaagctgatcaacgccgtggagctgaagaagccccagtgcaaggtgtgcagaagctgccccgtggtgcagagcagccagcacctgttcctggacctgcccaagctggagaagagactggaggagtggctgggcagaaccctgcccggcagcgactggacccccaacgcccagttcatcaccagaagctggctgagagacggcctgaagcccagatgcatcaccagagacctgaagtggggcacccccgtgcccctggagggcttcgaggacaaggtgttctacgtgtggttcgacgccaccatcggctacctgagcatcaccgccaactacaccgaccagtgggagagatggtggaagaaccccgagcaggtggacctgtaccagttcatggccaaggacaacgtgcccttccacagcctggtgttcccctgcagcgccctgggcgccgaggacaactacaccctggtgagccacctgatcgccaccgagtacctgaactacgaggacggcaagttcagcaagagcagaggcgtgggcgtgttcggcgacatggcccaggacaccggcatccccgccgacatctggagattctacctgctgtacatcagacccgagggccaggacagcgccttcagctggaccgacctgctgctgaagaacaacagcgagctgctgaacaacctgggcaacttcatcaacagagccggcatgttcgtgagcaagttcttcggcggctacgtgcccgagatggtgctgacccccgacgaccagagactgctggcccacgtgaccctggagctgcagcactaccaccagctgctggagaaggtgagaatcagagacgccctgagaagcatcctgaccatcagcagacacggcaaccagtacatccaggtgaacgagccctggaagagaatcaagggcagcgaggccgacagacagagagccggcaccgtgaccggcctggccgtgaacatcgccgccctgctgagcgtgatgctgcagccctacatgcccaccgtgagcgccaccatccaggcccagctgcagctgcccccccccgcctgcagcatcctgctgaccaacttcctgtgcaccctgcccgccggccaccagatcggcaccgtgagccccctgttccagaagctggagaacgaccagatcgagagcctgagacagagattcggcggcggccaggccaagaccagccccaagcccgccgtggtggagaccgtgaccaccgccaagccccagcagatccaggccctgatggacgaggtgaccaagcagggcaacatcgtgagagagctgaaggcccagaaggccgacaagaacgaggtggccgccgaggtggccaagctgctggacctgaagaagcagctggccgtggccgagggcaagccccccgaggcccccaagggcaagaagaagaagtag

SEQ ID NO: 88747 - DNA, 1908 bp, Artificial Sequence
  Description of Artificial Sequence: Synthetic coding sequence
atggccgtgaccgcctgggagaagggcctggagagcctgccccccctgagaccccagcagaaccccgtgctgcccgtggccggcgagagaaacgtgctgatcaccagcgccctgccctacgtgaacaacgtgccccacctgggcaacatcatcggctgcgtgctgagcgccgacgtgttcgccagatacagcagactgagacagtggaacaccctgtacctgtgcggcaccgacgagtacggcaccgccaccgagaccaaggccctggaggagggcctgaccccccaggagatctgcgacaagtaccacatcatccacgccgacatctacagatggttcaacatcagcttcgacatcttcggcagaaccaccaccccccagcagaccaagatcacccaggacatcttccagcagctgctgaagagaggcttcgtgctgcaggacaccgtggagcagctgagatgcgagcactgcgccagattcctggccgacagattcgtggagggcgtgtgccccttctgcggctacgaggaggccagaggcgaccagtgcgacaagtgcggcaagctgatcaacgccgtggagctgaagaagccccagtgcaaggtgtgcagaagctgccccgtggtgcagagcagccagcacctgttcctggacctgcccaagctggagaagagactggaggagtggctgggcagaaccctgcccggcagcgactggacccccaacgcccagttcatcaccagaagctggctgagagacggcctgaagcccagatgcatcaccagagacctgaagtggggcacccccgtgcccctggagggcttcgaggacaaggtgttctacgtgtggttcgacgccaccatcggctacctgagcatcaccgccaactacaccgaccagtgggagagatggtggaagaaccccgagcaggtggacctgtaccagttcatggccaaggacaacgtgcccttccacagcctggtgttcccctgcagcgccctgggcgccgaggacaactacaccctggtgagccacctgatcgccaccgagtacctgaactacgaggacggcaagttcagcaagagcagaggcgtgggcgtgttcggcgacatggcccaggacaccggcatccccgccgacatctggagattctacctgctgtacatcagacccgagggccaggacagcgccttcagctggaccgacctgctgctgaagaacaacagcgagctgctgaacaacctgggcaacttcatcaacagagccggcatgttcgtgagcaagttcttcggcggctacgtgcccgagatggtgctgacccccgacgaccagagactgctggcccacgtgaccctggagctgcagcactaccaccagctgctggagaaggtgagaatcagagacgccctgagaagcatcctgaccatcagcagacacggcaaccagtacatccaggtgaacgagccctggaagagaatcaagggcagcgaggccgacagacagagagccggcaccgtgaccggcctggccgtgaacatcgccgccctgctgagcgtgatgctgcagccctacatgcccaccgtgagcgccaccatccaggcccagctgcagctgcccccccccgcctgcagcatcctgctgaccaacttcctgtgcaccctgcccgccggccaccagatcggcaccgtgagccccctgttccagaagctggagaacgaccagatcgagagcctgagacagagattcggcggcggccaggtgagaaagctgaaggccgtgcccagcctgcacaacagccacagcatcaccagcctgatcagcctgagcagcccccaccccagcctgttccccagcttcggccccgccgccagcagcctgaccgtgttcctgagctgcctgaactag

SEQ ID NO: 88748 - DNA, 1641 bp, Artificial Sequence
  Description of Artificial Sequence: Synthetic coding sequence
atgagactgttcgtgagcgacggcgtgcccggctgcctgcccgtgctggccgccgccggcagagccagaggcagagccgaggtgctgatcagcaccgtgggccccgaggactgcgtggtgcccttcctgaccagacccaaggtgcccgtgctgcagctggacagcggcaactacctgttcagcaccagcgccatctgcagatacttcttcctgctgagcggctgggagcaggacgacctgaccaaccagtggctggagtgggaggccaccgagctgcagcccgccctgagcgccgccctgtactacctggtggtgcagggcaagaagggcgaggacgtgctgggcagcgtgagaagagccctgacccacatcgaccacagcctgagcagacagaactgccccttcctggccggcgagaccgagagcctggccgacatcgtgctgtggggcgccctgtaccccctgctgcaggaccccgcctacctgcccgaggagctgagcgccctgcacagctggttccagaccctgagcacccaggagccctgccagagagccgccgagaccgtgctgaagcagcagggcgtgctggccctgagaccctacctgcagaagcagccccagcccagccccgccgagggcagagccgtgaccaacgagcccgaggaggaggagctggccaccctgagcgaggaggagatcgccatggccgtgaccgcctgggagaagggcctggagagcctgccccccctgagaccccagcagaaccccgtgctgcccgtggccggcgagagaaacgtgctgatcaccagcgccctgccctacgtgaacaacgtgccccacctgggcaacatcatcggctgcgtgctgagcgccgacgtgttcgccagatacagcagactgagacagtggaacaccctgtacctgtgcggcaccgacgagtacggcaccgccaccgagaccaaggccctggaggagggcctgaccccccaggagatctgcgacaagtaccacatcatccacgccgacatctacagatggttcaacatcagcttcgacatcttcggcagaaccaccaccccccagcagaccaagatcacccaggacatcttccagcagctgctgaagagaggcttcgtgctgcaggacaccgtggagcagctgagatgcgagcactgcgccagattcctggccgacagattcgtggagggcgtgtgccccttctgcggctacgaggaggccagaggcgaccagtgcgacaagtgcggcaagctgatcaacgccgtggagctgaagaagccccagtgcaaggtgtgcagaagctgccccgtggtgcagagcagccagcacctgttcctggacctgcccaagctggagaagagactggaggagtggctgggcagaaccctgcccggcagcgactggacccccaacgcccagttcatcaccagaagctggctgagagacggcctgaagcccagatgcatcaccagagacctgaagtggggcacccccgtgcccctggagggcttcgaggacaaggtgttctacgtgtggttcgacgccaccatcggctacctgagcatcaccgccaactacaccgaccagtgggagagatggtggaagaaccccgagcagccctag

SEQ ID NO: 88749 - DNA, 1782 bp, Artificial Sequence
  Description of Artificial Sequence: Synthetic coding sequence
atgctgagaaccagcgtgctgagactgctgggcagaaccggcgccagcagactgagcctgctggaggacttcggccccagatactacagcagcggcagcctgagcgccggcgacgacgcctgcgacgtgagagcctacttcaccacccccatcttctacgtgaacgccgccccccacatcggccacctgtacagcgccctgctggccgacgccctgtgcagacacagaagactgagaggccccagcaccgccgccaccagattcagcaccggcaccgacgagcacggcctgaagatccagcaggccgccgccaccgccggcctggcccccaccgagctgtgcgacagagtgagcgagcagttccagcagctgttccaggaggccggcatcagctgcaccgacttcatcagaaccaccgaggccagacacagagtggccgtgcagcacttctggggcgtgctgaagagcagaggcctgctgtacaagggcgtgtacgagggctggtactgcgccagcgacgagtgcttcctgcccgaggccaaggtgacccagcagcccggccccagcggcgacagcttccccgtgagcctggagagcggccaccccgtgagctggaccaaggaggagaactacatcttcagactgagccagttcagaaagcccctgcagagatggctgagaggcaacccccaggccatcacccccgagcccttccaccacgtggtgctgcagtggctggacgaggagctgcccgacctgagcgtgagcagaagaagcagccacctgcactggggcatccccgtgcccggcgacgacagccagaccatctacgtgtggctggacgccctggtgaactacctgaccgtgatcggctaccccaacgccgagttcaagagctggtggcccgccaccagccacatcatcggcaaggacatcctgaagttccacgccatctactggcccgccttcctgctgggcgccggcatgagccccccccagagaatctgcgtgcacagccactggaccgtgtgcggccagaagatgagcaagagcctgggcaacgtggtggaccccagaacctgcctgaacagatacaccgtggacggcttcagatacttcctgctgagacagggcgtgcccaactgggactgcgactactacgacgagaaggtggtgaagctgctgaacagcgagctggccgacgccctgggcggcctgctgaacagatgcaccgccaagagaatcaaccccagcgagacctaccccgccttctgcaccacctgcttccccagcgagcccggcctggtgggccccagcgtgagagcccaggccgaggactacgccctggtgagcgccgtggccaccctgcccaagcaggtggccgaccactacgacaacttcagaatctacaaggccctggaggccgtgagcagctgcgtgagacagaccaacggcttcgtgcagagacacgccccctggaagctgaactgggagagccccgtggacgccccctggctgggcaccgtgctgcacgtggccctggagtgcctgagagtgttcggcaccctgctgcagcccgtgacccccagcctggccgacaagctgctgagcagactgggcgtgagcgccagcgagagaagcctgggcgagctgtacttcctgcccagattctacggccacccctgccccttcgagggcagaagactgggccccgagaccggcctgctgttccccagactggaccagagcagaacctggctggtgaaggcccacagaacctag

SEQ ID NO: 88750 - DNA, 1563 bp, Artificial Sequence
  Description of Artificial Sequence: Synthetic coding sequence
atgctgagaaccagcgtgctgagactgctgggcagaaccggcgccagcagactgagcctgctggaggacttcggccccagatactacagcagcggcagcctgagcgccggcgacgacgcctgcgacgtgagagcctacttcaccacccccatcttctacgtgaacgccgccccccacatcggccacctgtacagcgccctgctggccgacgccctgtgcagacacagaagactgagaggccccagcaccgccgccaccagattcagcaccggcaccgacgagcacggcctgaagatccagcaggccgccgccaccgccggcctggcccccaccgagctgtgcgacagagtgagcgagcagttccagcagctgttccaggaggccggcatcagctggaccaaggaggagaactacatcttcagactgagccagttcagaaagcccctgcagagatggctgagaggcaacccccaggccatcacccccgagcccttccaccacgtggtgctgcagtggctggacgaggagctgcccgacctgagcgtgagcagaagaagcagccacctgcactggggcatccccgtgcccggcgacgacagccagaccatctacgtgtggctggacgccctggtgaactacctgaccgtgatcggctaccccaacgccgagttcaagagctggtggcccgccaccagccacatcatcggcaaggacatcctgaagttccacgccatctactggcccgccttcctgctgggcgccggcatgagccccccccagagaatctgcgtgcacagccactggaccgtgtgcggccagaagatgagcaagagcctgggcaacgtggtggaccccagaacctgcctgaacagatacaccgtggacggcttcagatacttcctgctgagacagggcgtgcccaactgggactgcgactactacgacgagaaggtggtgaagctgctgaacagcgagctggccgacgccctgggcggcctgctgaacagatgcaccgccaagagaatcaaccccagcgagacctaccccgccttctgcaccacctgcttccccagcgagcccggcctggtgggccccagcgtgagagcccaggccgaggactacgccctggtgagcgccgtggccaccctgcccaagcaggtggccgaccactacgacaacttcagaatctacaaggccctggaggccgtgagcagctgcgtgagacagaccaacggcttcgtgcagagacacgccccctggaagctgaactgggagagccccgtggacgccccctggctgggcaccgtgctgcacgtggccctggagtgcctgagagtgttcggcaccctgctgcagcccgtgacccccagcctggccgacaagctgctgagcagactgggcgtgagcgccagcgagagaagcctgggcgagctgtacttcctgcccagattctacggccacccctgccccttcgagggcagaagactgggccccgagaccggcctgctgttccccagactggaccagagcagaacctggctggtgaaggcccacagaacctag

SEQ ID NO: 88751 - DNA, 1461 bp, Artificial Sequence
  Description of Artificial Sequence: Synthetic coding sequence
atggtggccggcatgctgggcctgagagaggagaagagcgaggaccaggacctgcagggcctgaaggacaagcccctgaagttcaagaaggtgaagaaggacaagaaggaggagaaggagggcaagcacgagcccgtgcagcccagcgcccaccacagcgccgagcccgccgaggccggcaaggccgagaccagcgagggcagcggcagcgcccccgccgtgcccgaggccagcgccagccccaagcagagaagaagcatcatcagagacagaggccccatgtacgacgaccccaccctgcccgagggctggaccagaaagctgaagcagagaaagagcggcagaagcgccggcaagtacgacgtgtacctgatcaacccccagggcaaggccttcagaagcaaggtggagctgatcgcctacttcgagaaggtgggcgacaccagcctggaccccaacgacttcgacttcaccgtgaccggcagaggcagccccagcagaagagagcagaagccccccaagaagcccaagagccccaaggcccccggcaccggcagaggcagaggcagacccaagggcagcggcaccaccagacccaaggccgccaccagcgagggcgtgcaggtgaagagagtgctggagaagagccccggcaagctgctggtgaagatgcccttccagaccagccccggcggcaaggccgagggcggcggcgccaccaccagcacccaggtgatggtgatcaagagacccggcagaaagagaaaggccgaggccgacccccaggccatccccaagaagagaggcagaaagcccggcagcgtggtggccgccgccgccgccgaggccaagaagaaggccgtgaaggagagcagcatcagaagcgtgcaggagaccgtgctgcccatcaagaagagaaagaccagagagaccgtgagcatcgaggtgaaggaggtggtgaagcccctgctggtgagcaccctgggcgagaagagcggcaagggcctgaagacctgcaagagccccggcagaaagagcaaggagagcagccccaagggcagaagcagcagcgccagcagcccccccaagaaggagcaccaccaccaccaccaccacagcgagagccccaaggcccccgtgcccctgctgccccccctgcccccccccccccccgagcccgagagcagcgaggaccccaccagcccccccgagccccaggacctgagcagcagcgtgtgcaaggaggagaagatgcccagaggcggcagcctggagagcgacggctgccccaaggagcccgccaagacccagcccgccgtggccaccgccgccaccgccgccgagaagtacaagcacagaggcgagggcgagagaaaggacatcgtgagcagcagcatgcccagacccaacagagaggagcccgtggacagcagaacccccgtgaccgagagagtgagctag

SEQ ID NO: 88752 - DNA, 816 bp, Artificial Sequence
  Description of Artificial Sequence: Synthetic coding sequence
atggtggccggcatgctgggcctgagagaggagaagagcgaggaccaggacctgcagggcctgaaggacaagcccctgaagttcaagaaggtgaagaaggacaagaaggaggagaaggagggcaagcacgagcccgtgcagcccagcgcccaccacagcgccgagcccgccgaggccggcaaggccgagaccagcgagggcagcggcagcgcccccgccgtgcccgaggccagcgccagccccaagcagagaagaagcatcatcagagacagaggccccatgtacgacgaccccaccctgcccgagggctggaccagaaagctgaagcagagaaagagcggcagaagcgccggcaagtacgacgtgtacctgatcaacccccagggcaaggccttcagaagcaaggtggagctgatcgcctacttcgagaaggtgggcgacaccagcctggaccccaacgacttcgacttcaccgtgaccggcagaggcagccccagcagaagagagcagaagccccccaagaagcccaagagccccaaggcccccggcaccggcagaggcagaggcagacccaagggcagcggcaccaccagacccaaggccgccaccagcgagggcgtgcaggtgaagagagtgctggagaagagccccggcaagctgctggtgaagatgcccttccagaccagccccggcggcaaggccgagggcggcggcgccaccaccagcacccaggtgatggtgatcaagagacccggcagaaagagaagccccagagcccccagaaccccccccgcccccctgagccccagaacctag

SEQ ID NO: 88753 - DNA, 153 bp, Artificial Sequence
  Description of Artificial Sequence: Synthetic coding sequence
atggtggccggcatgctgggcctgagagaggagaagagcgaggaccaggacctgcagggcctgaaggacaagcccctgaagttcaagaaggtgaagaaggacaagaaggaggagaaggagggcaagcacgagcccgtgcagcccagcgcctag

SEQ ID NO: 88754 - DNA, 1497 bp, Artificial Sequence
  Description of Artificial Sequence: Synthetic coding sequence
atggccgccgccgccgccgccgcccccagcggcggcggcggcggcggcgaggaggagagactggaggagaagagcgaggaccaggacctgcagggcctgaaggacaagcccctgaagttcaagaaggtgaagaaggacaagaaggaggagaaggagggcaagcacgagcccgtgcagcccagcgcccaccacagcgccgagcccgccgaggccggcaaggccgagaccagcgagggcagcggcagcgcccccgccgtgcccgaggccagcgccagccccaagcagagaagaagcatcatcagagacagaggccccatgtacgacgaccccaccctgcccgagggctggaccagaaagctgaagcagagaaagagcggcagaagcgccggcaagtacgacgtgtacctgatcaacccccagggcaaggccttcagaagcaaggtggagctgatcgcctacttcgagaaggtgggcgacaccagcctggaccccaacgacttcgacttcaccgtgaccggcagaggcagccccagcagaagagagcagaagccccccaagaagcccaagagccccaaggcccccggcaccggcagaggcagaggcagacccaagggcagcggcaccaccagacccaaggccgccaccagcgagggcgtgcaggtgaagagagtgctggagaagagccccggcaagctgctggtgaagatgcccttccagaccagccccggcggcaaggccgagggcggcggcgccaccaccagcacccaggtgatggtgatcaagagacccggcagaaagagaaaggccgaggccgacccccaggccatccccaagaagagaggcagaaagcccggcagcgtggtggccgccgccgccgccgaggccaagaagaaggccgtgaaggagagcagcatcagaagcgtgcaggagaccgtgctgcccatcaagaagagaaagaccagagagaccgtgagcatcgaggtgaaggaggtggtgaagcccctgctggtgagcaccctgggcgagaagagcggcaagggcctgaagacctgcaagagccccggcagaaagagcaaggagagcagccccaagggcagaagcagcagcgccagcagcccccccaagaaggagcaccaccaccaccaccaccacagcgagagccccaaggcccccgtgcccctgctgccccccctgcccccccccccccccgagcccgagagcagcgaggaccccaccagcccccccgagccccaggacctgagcagcagcgtgtgcaaggaggagaagatgcccagaggcggcagcctggagagcgacggctgccccaaggagcccgccaagacccagcccgccgtggccaccgccgccaccgccgccgagaagtacaagcacagaggcgagggcgagagaaaggacatcgtgagcagcagcatgcccagacccaacagagaggagcccgtggacagcagaacccccgtgaccgagagagtgagctag

SEQ ID NO: 88755 - DNA, 1185 bp, Artificial Sequence
  Description of Artificial Sequence: Synthetic coding sequence
atggtggccggcatgctgggcctgagagaggagaagagcgaggaccaggacctgcagggcctgaaggacaagcccctgaagttcaagaaggtgaagaaggacaagaaggaggagaaggagggcaagcacgagcccgtgcagcccagcgcccaccacagcgccgagcccgccgaggccggcaaggccgagaccagcgagggcagcggcagcgcccccgccgtgcccgaggccagcgccagccccaagcagagaagaagcatcatcagagacagaggccccatgtacgacgaccccaccctgcccgagggctggaccagaaagctgaagcagagaaagagcggcagaagcgccggcaagtacgacgtgtacctgatcaacccccagggcaaggccttcagaagcaaggtggagctgatcgcctacttcgagaaggtgggcgacaccagcctggaccccaacgacttcgacttcaccgtgaccggcagaggcagccccagcagaagagagcagaagccccccaagaagcccaagagccccaaggcccccggcaccggcagaggcagaggcagacccaagggcagcggcaccaccagacccaaggccgccaccagcgagggcgtgcaggtgaagagagtgctggagaagagccccggcaagctgctggtgaagatgcccttccagaccagccccggcggcaaggccgagggcggcggcgccaccaccagcacccaggtgatggtgatcaagagacccggcagaaagagaaaggccgaggccgacccccaggccatccccaagaagagaggcagaaagcccggcagcgtggtggccgccgccgccgccgaggccaagaagaaggccgtgaaggagagcagcatcagaagcgtgcaggagaccgtgctgcccatcaagaagagaaagaccagagagaccgtgagcatcgaggtgaaggaggtggtgaagcccctgctggtgagcaccctgggcgagaagagcggcaagggcctgaagacctgcaagagccccggcagaaagagcaaggagagcagccccaagggcagaagcagcagcgccagcagcccccccaagaaggagcaccaccaccaccaccaccacagcgagagccccaaggcccccgtgcccaccagaatcaaggccgccgtggtgagcagcccctacggctag

SEQ ID NO: 88756 - DNA, 1818 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgcagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88757 - DNA, 1761 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagcctgcagggcagacacagcggcagagaggacggctgcaaggtgtgggagaccgaggacaccgtggagcccaccagcaccagctggaaccccagaggctggcccggcacccacgtgagcctgagccccccccccgccagcatgatgtgggtgagctgcagaagaagctggtgccccagcagccagagctag

SEQ ID NO: 88758 - DNA, 1653 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgcagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggccgtggaccccggcctgcccagcgtgaagcaggagccccccgaccccgaggaggacaaggaggagaacaaggacgacagcgccagcaagctggcccccgaggaggaggccggcggcgccggcacccccgtggagcccaccacccagccccagtacagcggcaacttcgacaacgacctgtacgagatctacctgatcgacatctag

SEQ ID NO: 88759 - DNA, 1650 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88760 - DNA, 1512 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88761 - DNA, 1671 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgcagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88762 - DNA, 1818 bp, Artificial Sequence; identical to SEQ ID NO: 88756
  Description of Artificial Sequence: Synthetic coding sequence

SEQ ID NO: 88763 - DNA, 1512 bp, Artificial Sequence; identical to SEQ ID NO: 88760
  Description of Artificial Sequence: Synthetic coding sequence

SEQ ID NO: 88764 - DNA, 1650 bp, Artificial Sequence; identical to SEQ ID NO: 88759
  Description of Artificial Sequence: Synthetic coding sequence

SEQ ID NO: 88765 - DNA, 1818 bp, Artificial Sequence; identical to SEQ ID NO: 88756
  Description of Artificial Sequence: Synthetic coding sequence

SEQ ID NO: 88766 - DNA, 1971 bp, Artificial Sequence
  Description of Artificial Sequence: Synthetic coding sequence
atgggcggcttcagactgagaaccggcagaaacgccgccctgaacagcgacagactgctgctgctgcccgtggccagcatggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagacacctggcccacagactgagaagaagacaccagagatgccagagaagaacccccctggccgtggccccccccaccggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgcagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88767 - DNA, 1611 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88768 - DNA, 1893 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagacacctggcccacagactgagaagaagacaccagagatgccagagaagaacccccctggccgtggccccccccaccggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgcagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagaagcaaggacctgaagaagcccggcgccagaaagcagtag

SEQ ID NO: 88769 - DNA, 1704 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagatactaccacctggccctggactggaagtgcaactgcggctaccacctgtgctgcagaagcgtgctggtgccctag

SEQ ID NO: 88770 - DNA, 1608 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagagccggcaccagagagggcaagatggacgtgaagtgcggcagacccagaacccagtggagccccagagccagagccggcacccacgaggacggcctggagcccatgagcgtgagccaccacctgcagctgagatag

SEQ ID NO: 88771 - DNA, 1968 bp, Artificial Sequence
  Description of Artificial Sequence: Synthetic coding sequence
atggccgaggactggctggactgccccgccctgggccccggctggaagagaagagaggtgttcagaaagagcggcgccacctgcggcagaagcgacacctactaccagagccccaccggcgacagaatcagaagcaaggtggagctgaccagatacctgggccccgcctgcgacctgaccctgttcgacttcaagcagggcatcctgtgctaccccgcccccaaggcccaccccgtggccgtggccagcaagaagagaaagaagcccagcagacccgccaagaccagaaagagacaggtgggcccccagagcggcgaggtgagaaaggaggcccccagagacgagaccaaggccgacaccgacaccgcccccgccagcttccccgcccccggctgctgcgagaactgcggcatcagcttcagcggcgacggcacccagagacagagactgaagaccctgtgcaaggactgcagagcccagagaatcgccttcaacagagagcagagaatgttcaagagagtgggctgcggcgagtgcgccgcctgccaggtgaccgaggactgcggcgcctgcagcacctgcctgctgcagctgccccacgacgtggccagcggcctgttctgcaagtgcgagagaagaagatgcctgagaatcgtggagagaagcagaggctgcggcgtgtgcagaggctgccagacccaggaggactgcggccactgccccatctgcctgagaccccccagacccggcctgagaagacagtggaagtgcgtgcagagaagatgcctgagaggcaagcacgccagaagaaagggcggctgcgacagcaagatggccgccagaagaagacccggcgcccagcccctgcccccccccccccccagccagagccccgagcccaccgagccccaccccagagccctggcccccagcccccccgccgagttcatctactactgcgtggacgaggacgagctgcagccctacaccaacagaagacagaacagaaagtgcggcgcctgcgccgcctgcctgagaagaatggactgcggcagatgcgacttctgctgcgacaagcccaagttcggcggcagcaaccagaagagacagaagtgcagatggagacagtgcctgcagttcgccatgaagagactgctgcccagcgtgtggagcgagagcgaggacggcgccggcagcccccccccctacagaagaagaaagagacccagcagcgccagaagacaccacctgggccccaccctgaagcccaccctggccaccagaaccgcccagcccgaccacacccaggcccccaccaagcaggaggccggcggcggcttcgtgctgcccccccccggcaccgacctggtgttcctgagagagggcgccagcagccccgtgcaggtgcccggccccgtggccgccagcaccgaggccctgctgcaggaggcccagtgcagcggcctgagctgggtggtggccctgccccaggtgaagcaggagaaggccgacacccaggacgagtggacccccggcaccgccgtgctgaccagccccgtgctggtgcccggctgccccagcaaggccgtggaccccggcctgcccagcgtgaagcaggagccccccgaccccgaggaggacaaggaggagaacaaggacgacagcgccagcaagctggcccccgaggaggaggccggcggcgccggcacccccgtgatcaccgagatcttcagcctgggcggcaccagattcagagacaccgccgtgtggctgcccagcctgcagggcagacacagcggcagagaggacggctgcaaggtgtgggagaccgaggacaccgtggagcccaccagcaccagctggaaccccagaggctggcccggcacccacgtgagcctgagccccccccccgccagcatgatgtgggtgagctgcagaagaagctggtgccccagcagccagagctag

SEQ ID NO: 88772 - DNA, 1236 bp, Artificial Sequence
  Description of Artificial Sequence: Synthetic coding sequence
atgagagcccaccccggcggcggcagatgctgccccgagcaggaggagggcgagagcgccgccggcggcagcggcgccggcggcgacagcgccatcgagcagggcggccagggcagcgccctggcccccagccccgtgagcggcgtgagaagagagggcgccagaggcggcggcagaggcagaggcagatggaagcaggccggcagaggcggcggcgtgtgcggcagaggcagaggcagaggcagaggcagaggcagaggcagaggcagaggcagaggcagaggcagaccccccagcggcggcagcggcctgggcggcgacggcggcggctgcggcggcggcggcagcggcggcggcggcgcccccagaagagagcccgtgcccttccccagcggcagcgccggccccggccccagaggccccagagccaccgagagcggcaagagaatggactgccccgccctgccccccggctggaagaaggaggaggtgatcagaaagagcggcctgagcgccggcaagagcgacgtgtactacttcagccccagcggcaagaagttcagaagcaagccccagctggccagatacctgggcaacaccgtggacctgagcagcttcgacttcagaaccggcaagatgatgcccagcaagctgcagaagaacaagcagagactgagaaacgaccccctgaaccagaacaagggcaagcccgacctgaacaccaccctgcccatcagacagaccgccagcatcttcaagcagcccgtgaccaaggtgaccaaccaccccagcaacaaggtgaagagcgacccccagagaatgaacgagcagcccagacagctgttctgggagaagagactgcagggcctgagcgccagcgacgtgaccgagcagatcatcaagaccatggagctgcccaagggcctgcagggcgtgggccccggcagcaacgacgagaccctgctgagcgccgtggccagcgccctgcacaccagcagcgcccccatcaccggccaggtgagcgccgccgtggagaagaaccccgccgtgtggctgaacaccagccagcccctgtgcaaggccttcatcgtgaccgacgaggacatcagaaagcaggaggagagagtgcagcaggtgagaaagaagctggaggaggccctgatggccgacatcctgagcagagccgccgacaccgaggagatggacatcgagatggacagcggcgacgaggcctag

SEQ ID NO: 88773 - DNA, 909 bp, Artificial Sequence
  Description of Artificial Sequence: Synthetic coding sequence
atgagagcccaccccggcggcggcagatgctgccccgagcaggaggagggcgagagcgccgccggcggcagcggcgccggcggcgacagcgccatcgagcagggcggccagggcagcgccctggcccccagccccgtgagcggcgtgagaagagagggcgccagaggcggcggcagaggcagaggcagatggaagcaggccggcagaggcggcggcgtgtgcggcagaggcagaggcagaggcagaggcagaggcagaggcagaggcagaggcagaggcagaggcagaccccccagcggcggcagcggcctgggcggcgacggcggcggctgcggcggcggcggcagcggcggcggcggcgcccccagaagagagcccgtgcccttccccagcggcagcgccggccccggccccagaggccccagagccaccgagagcggcaagagaatggactgccccgccctgccccccggctggaagaaggaggaggtgatcagaaagagcggcctgagcgccggcaagagcgacgtgtactacttcagccccagcggcaagaagttcagaagcaagccccagctggccagatacctgggcaacaccgtggacctgagcagcttcgacttcagaaccggcaagatgatgcccagcaagctgcagaagaacaagcagagactgagaaacgaccccctgaaccagaacaagctgagatggaacacccacagacccgccccctggcacgccctgagcagactgtgcctgctgatcagatgcctgctgtgcctggagtgcgcctaccccctgcccctgcacctggtgaacagctacagcagcaagacccagctgcactgcctgcacctgtgggaggcctgccccgcctacagcagacagaaccagagcttccccccctag

SEQ ID NO: 88774 - DNA, 909 bp, Artificial Sequence; identical to SEQ ID NO: 88773
  Description of Artificial Sequence: Synthetic coding sequence

SEQ ID NO: 88775 - DNA, 876 bp, Artificial Sequence
  Description of Artificial Sequence: Synthetic coding sequence
atggagagaaagagatgggagtgccccgccctgccccagggctgggagagagaggaggtgcccagaagaagcggcctgagcgccggccacagagacgtgttctactacagccccagcggcaagaagttcagaagcaagccccagctggccagatacctgggcggcagcatggacctgagcaccttcgacttcagaaccggcaagatgctgatgagcaagatgaacaagagcagacagagagtgagatacgacagcagcaaccaggtgaagggcaagcccgacctgaacaccgccctgcccgtgagacagaccgccagcatcttcaagcagcccgtgaccaagatcaccaaccaccccagcaacaaggtgaagagcgacccccagaaggccgtggaccagcccagacagctgttctgggagaagaagctgagcggcctgaacgccttcgacatcgccgaggagctggtgaagaccatggacctgcccaagggcctgcagggcgtgggccccggctgcaccgacgagaccctgctgagcgccatcgccagcgccctgcacaccagcaccatgcccatcaccggccagctgagcgccgccgtggagaagaaccccggcgtgtggctgaacaccacccagcccctgtgcaaggccttcatggtgaccgacgaggacatcagaaagcaggaggagctggtgcagcaggtgagaaagagactggaggaggccctgatggccgacatgctggcccacgtggaggagctggccagagacggcgaggcccccctggacaaggcctgcgccgaggacgacgacgaggaggacgaggaggaggaggaggaggagcccgaccccgaccccgagatggagcacgtgtag

SEQ ID NO: 88776 - DNA, 780 bp, Artificial Sequence
  Description of Artificial Sequence: Synthetic coding sequence
atggagagaaagagccccagcggcaagaagttcagaagcaagccccagctggccagatacctgggcggcagcatggacctgagcaccttcgacttcagaaccggcaagatgctgatgagcaagatgaacaagagcagacagagagtgagatacgacagcagcaaccaggtgaagggcaagcccgacctgaacaccgccctgcccgtgagacagaccgccagcatcttcaagcagcccgtgaccaagatcaccaaccaccccagcaacaaggtgaagagcgacccccagaaggccgtggaccagcccagacagctgttctgggagaagaagctgagcggcctgaacgccttcgacatcgccgaggagctggtgaagaccatggacctgcccaagggcctgcagggcgtgggccccggctgcaccgacgagaccctgctgagcgccatcgccagcgccctgcacaccagcaccatgcccatcaccggccagctgagcgccgccgtggagaagaaccccggcgtgtggctgaacaccacccagcccctgtgcaaggccttcatggtgaccgacgaggacatcagaaagcaggaggagctggtgcagcaggtgagaaagagactggaggaggccctgatggccgacatgctggcccacgtggaggagctggccagagacggcgaggcccccctggacaaggcctgcgccgaggacgacgacgaggaggacgaggaggaggaggaggaggagcccgaccccgaccccgagatggagcacgtgtag

SEQ ID NO: 88777 - DNA, 4485 bp, Artificial Sequence
  Description of Artificial Sequence: Synthetic coding sequence
atgaacggcggcaaggagtgcgacggcggcgacaaggagggcggcctgcccgccatccaggtgcccgtgggctggcagagaagagtggaccagaacggcgtgctgtacgtgagccccagcggcagcctgctgagctgcctggagcaggtgaagacctacctgctgaccgacggcacctgcaagtgcggcctggagtgccccctgatcctgcccaaggtgttcaacttcgaccccggcgccgccgtgaagcagagaaccgccgaggacgtgaaggccgacgaggacgtgaccaagctgtgcatccacaagagaaagatcatcgccgtggccaccctgcacaagagcatggaggccccccaccccagcctggtgctgaccagccccggcggcggcaccaacgccacccccgtggtgcccagcagagccgccacccccagaagcgtgagaaacaagagccacgagggcatcaccaacagcgtgatgcccgagtgcaagaaccccttcaagctgatgatcggcagcagcaacgccatgggcagactgtacgtgcaggagctgcccggcagccagcagcaggagctgcaccccgtgtaccccagacagagactgggcagcagcgagcacggccagaagagccccttcagaggcagccacggcggcctgcccagccccgccagcagcggcagccagatctacggcgacggcagcatcagccccagaaccgaccccctgggcagccccgacgtgttcaccagaagcaaccccggcttccacggcgcccccaacagcagccccatccacctgaacagaacccccctgagcccccccagcgtgatgctgcacggcagccccgtgcagagcagctgcgccatggccggcagaaccaacatccccctgagccccaccctgaccaccaagagccccgtgatgaagaagcccatgtgcaacttcagcaccaacatggagatccccagagccatgttccaccacaagcccccccagggccccccccccccccccccccccagctgcgccctgcagaagaagcccctgaccagcgagaaggaccccctgggcatcctggaccccatccccagcaagcccgtgaaccagaaccccgtgatcatcaaccccaccagcttccacagcaacgtgcacagccaggtgcccatgatgaacgtgagcatgccccccgccgtggtgcccctgcccagcaacctgcccctgcccaccgtgaagcccggccacatgaaccacggcagccacgtgcagagagtgcagcacagcgccagcaccagcctgagccccagccccgtgaccagccccgtgcacatgatgggcaccggcatcggcagaatcgaggccagcccccagagaagcagaagcagcagcaccagcagcgaccacggcaacttcatgatgccccccgtgggcccccaggccaccagcagcggcatcaaggtgccccccagaagccccagaagcaccatcggcagccccagacccagcatgcccagcagccccagcaccaagagcgacggccaccaccagtacaaggacatccccaaccccctgatcgccggcatcagcaacgtgctgaacacccccagcagcgccgccttccccaccgccagcgccggcagcagcagcgtgaagagccagcccggcctgctgggcatgcccctgaaccagatcctgaaccagcacaacgccgccagcttccccgccagcagcctgctgagcgccgccgccaaggcccagctggccaaccagaacaagctggccggcaacaacagcagcagcagcagcaacagcggcgccgtggccggcagcggcaacaccgagggccacagcaccctgaacaccatgttcccccccaccgccaacatgctgctgcccaccggcgagggccagagcggcagagccgccctgagagacaagctgatgagccagcagaaggacgccctgagaaagagaaagcagccccccaccaccgtgctgagcctgctgagacagagccagatggacagcagcgccgtgcccaagcccggccccgacctgctgagaaagcagggccagggcagcttccccatcagcagcatgagccagctgctgcagagcatgagctgccagagcagccacctgagcagcaacagcacccccggctgcggcgccagcaacaccgccctgccctgcagcgccaaccagctgcacttcaccgaccccagcatgaacagcagcgtgctgcagaacatccccctgagaggcgaggccgtgcactgccacaacgccaacaccaacttcgtgcacagcaacagccccgtgcccaaccaccacctggccggcctgatcaaccagatccaggccagcggcaactgcggcatgctgagccagagcggcatggccctgggcaacagcctgcaccccaaccccccccagagcagaatcagcaccagcagcacccccgtgatccccaacagcatcgtgagcagctacaaccagaccagcagcgaggccggcggcagcggccccagcagcagcatcgccatcgccggcaccaaccaccccgccatcaccaagaccaccagcgtgctgcaggacggcgtgatcgtgaccaccgccgccggcaaccccctgcagagccagctgcccatcggcagcgacttccccttcgtgggccaggagcacgccctgcacttccccagcaacagcaccagcaacaaccacctgccccaccccctgaaccccagcctgctgagcagcctgcccatcagcctgcccgtgaaccagcagcacctgctgaaccagaacctgctgaacatcctgcagcccagcgccggcgagggcgacatgagcagcatcaacaacaccctgagcaaccaccagctgacccacctgcagagcctgctgaacaacaaccagatgttcccccccaaccagcagcagcagcagctgctgcagggctaccagaacctgcaggccttccagggccagagcaccatcccctgccccgccaacaacaaccccatggcctgcctgttccagaacttccaggtgagaatgcaggaggacgccgccctgctgaacaagagaatcagcacccagcccggcctgaccgccctgcccgagaaccccaacaccaccctgccccccttccaggacaccccctgcgagctgcagcccagaatcgaccccagcctgggccagcaggtgaaggacggcctggtggtgggcggccccggcgacgccagcgtggacgccatctacaaggccgtggtggacgccgccagcaagggcatgcaggtggtgatcaccaccgccgtgaacagcaccacccagatcagccccatccccgccctgagcgccatgagcgccttcaccgccagcatcggcgaccccctgaacctgagcagcgccgtgagcgccgtgatccacggcagaaacatgggcggcgtggaccacgacggcagactgagaaacagcagaggcgccagactgcccaagaacctggaccacggcaagaacgtgaacgagggcgacggcttcgagtacttcaagagcgccagctgccacaccagcaagaagcagtgggacggcgagcagagccccagaggcgagagaaacagatggaagtacgaggagttcctggaccaccccggccacatccacagcagcccctgccacgagagacccaacaacgtgagcaccctgcccttcctgcccggcgagcagcaccccatcctgctgccccccagaaactgccccggcgacaagatcctggaggagaacttcagatacaacaactacaagagaaccatgatgagcttcaaggagagactggagaacaccgtggagagatgcgcccacatcaacggcaacagacccagacagagcagaggcttcggcgagctgctgagcaccgccaagcaggacctggtgctggaggagcagagccccagcagcagcaacagcctggagaacagcctggtgaaggactacatccactacaacggcgacttcaacgccaagagcgtgaacggctgcgtgcccagccccagcgacgccaagagcatcagcagcgaggacgacctgagaaaccccgacagccccagcagcaacgagctgatccactacagacccagaaccttcaacgtgggcgacctggtgtggggccagatcaagggcctgaccagctggcccggcaagctggtgagagaggacgacgtgcacaacagctgccagcagagccccgaggagggcaaggtggagcccgagaagctgaagaccctgaccgagggcctggaggcctacagcagagtgagaaagagaaacagaaagagcggcaagctgaacaaccacctggaggccgccatccacgaggccatgagcgagctggacaagatgagcggcaccgtgcaccagatcccccagggcgacagacagatgagaccccccaagcccaagagaagaaagatcagcagatag

SEQ ID NO: 88778 - DNA, 2178 bp, Artificial Sequence
  Description of Artificial Sequence: Synthetic coding sequence
atggccgccgccagcgccgtgagcgtgctgctggtggccgccgagagaaacagatggcacagactgcccagcctgctgctgccccccagaacctgggtgtggagacagagaaccatgaagtacaccaccgccaccggcagaaacatcaccaaggtgctgatcgccaacagaggcgagatcgcctgcagagtgatgagaaccgccaagaagctgggcgtgcagaccgtggccgtgtacagcgaggccgacagaaacagcatgcacgtggacatggccgacgaggcctacagcatcggccccgcccccagccagcagagctacctgagcatggagaagatcatccaggtggccaagaccagcgccgcccaggccatccaccccggctgcggcttcctgagcgagaacatggagttcgccgagctgtgcaagcaggagggcatcatcttcatcggccccccccccagcgccatcagagacatgggcatcaagagcaccagcaagagcatcatggccgccgccggcgtgcccgtggtggagggctaccacggcgaggaccagagcgaccagtgcctgaaggagcacgccagaagaatcggctaccccgtgatgatcaaggccgtgagaggcggcggcggcaagggcatgagaatcgtgagaagcgagcaggagttccaggagcagctggagagcgccagaagagaggccaagaagagcttcaacgacgacgccatgctgatcgagaagttcgtggacacccccagacacgtggaggtgcaggtgttcggcgaccaccacggcaacgccgtgtacctgttcgagagagactgcagcgtgcagagaagacaccagaagatcatcgaggaggcccccgcccccggcatcaagagcgaggtgagaaagaagctgggcgaggccgccgtgagagccgccaaggccgtgaactacgtgggcgccggcaccgtggagttcatcatggacagcaagcacaacttctgcttcatggagatgaacaccagactgcaggtggagcaccccgtgaccgagatgatcaccggcaccgacctggtggagtggcagctgagaatcgccgccggcgagaagatccccctgagccaggaggagatcaccctgcagggccacgccttcgaggccagaatctacgccgaggaccccagcaacaacttcatgcccgtggccggccccctggtgcacctgagcacccccagagccgaccccagcaccagaatcgagaccggcgtgagacagggcgacgaggtgagcgtgcactacgaccccatgatcgccaagctggtggtgtgggccgccgacagacaggccgccctgaccaagctgagatacagcctgagacagtacaacatcgtgggcctgcacaccaacatcgacttcctgctgaacctgagcggccaccccgagttcgaggccggcaacgtgcacaccgacttcatcccccagcaccacaagcagctgctgctgagcagaaaggccgccgccaaggagagcctgtgccaggccgccctgggcctgatcctgaaggagaaggccatgaccgacaccttcaccctgcaggcccacgaccagttcagccccttcagcagcagcagcggcagaagactgaacatcagctacaccagaaacatgaccctgaaggacggcaagaacaacgtggccatcgccgtgacctacaaccacgacggcagctacagcatgcagatcgaggacaagaccttccaggtgctgggcaacctgtacagcgagggcgactgcacctacctgaagtgcagcgtgaacggcgtggccagcaaggccaagctgatcatcctggagaacaccatctacctgttcagcaaggagggcagcatcgagatcgacatccccgtgcccaagtacctgagcagcgtgagcagccaggagacccagggcggccccctggcccccatgaccggcaccatcgagaaggtgttcgtgaaggccggcgacaaggtgaaggccggcgacagcctgatggtgatgatcgccatgaagatggagcacaccatcaagagccccaaggacggcaccgtgaagaaggtgttctacagagagggcgcccaggccaacagacacacccccctggtggagttcgaggaggaggagagcgacaagagagagagcgagtag

SEQ ID NO: 88779 - DNA, 1728 bp, Artificial Sequence
  Description of Artificial Sequence: Synthetic coding sequence
atggagaagatcatccaggtggccaagaccagcgccgcccagcacatccagagcatcatggccgccgccggcgtgcccgtggtggagggctaccacggcgaggaccagagcgaccagtgcctgaaggagcacgccagaagaatcggctaccccgtgatgatcaaggccgtgagaggcggcggcggcaagggcatgagaatcgtgagaagcgagcaggagttccaggagcagctggagagcgccagaagagaggccaagaagagcttcaacgacgacgccatgctgatcgagaagttcgtggacacccccagacacgtggaggtgcaggtgttcggcgaccaccacggcaacgccgtgtacctgttcgagagagactgcagcgtgcagagaagacaccagaagatcatcgaggaggcccccgcccccggcatcaagagcgaggtgagaaagaagctgggcgaggccgccgtgagagccgccaaggccgtgaactacgtgggcgccggcaccgtggagttcatcatggacagcaagcacaacttctgcttcatggagatgaacaccagactgcaggtggagcaccccgtgaccgagatgatcaccggcaccgacctggtggagtggcagctgagaatcgccgccggcgagaagatccccctgagccaggaggagatcaccctgcagggccacgccttcgaggccagaatctacgccgaggaccccagcaacaacttcatgcccgtggccggccccctggtgcacctgagcacccccagagccgaccccagcaccagaatcgagaccggcgtgagacagggcgacgaggtgagcgtgcactacgaccccatgatcgccaagctggtggtgtgggccgccgacagacaggccgccctgaccaagctgagatacagcctgagacagtacaacatcgtgggcctgcacaccaacatcgacttcctgctgaacctgagcggccaccccgagttcgaggccggcaacgtgcacaccgacttcatcccccagcaccacaagcagctgctgctgagcagaaaggccgccgccaaggagagcctgtgccaggccgccctgggcctgatcctgaaggagaaggccatgaccgacaccttcaccctgcaggcccacgaccagttcagccccttcagcagcagcagcggcagaagactgaacatcagctacaccagaaacatgaccctgaaggacggcaagaacaacgtggccatcgccgtgacctacaaccacgacggcagctacagcatgcagatcgaggacaagaccttccaggtgctgggcaacctgtacagcgagggcgactgcacctacctgaagtgcagcgtgaacggcgtggccagcaaggccaagctgatcatcctggagaacaccatctacctgttcagcaaggagggcagcatcgagatcgacatccccgtgcccaagtacctgagcagcgtgagcagccaggagacccagggcggccccctggcccccatgaccggcaccatcgagaaggtgttcgtgaaggccggcgacaaggtgaaggccggcgacagcctgatggtgatgatcgccatgaagatggagcacaccatcaagagccccaaggacggcaccgtgaagaaggtgttctacagagagggcgcccaggccaacagacacacccccctggtggagttcgaggaggaggagagcgacaagagagagagcgagtag

SEQ ID NO: 88780 - DNA, 1425 bp, Artificial Sequence
  Description of Artificial Sequence: Synthetic coding sequence
atggccgccgccagcgccgtgagcgtgctgctggtggccgccgagagaaacagatggcacagactgcccagcctgctgctgccccccagaacctgggtgtggagacagagaaccatgaagtacaccaccgccaccgacgaggcctacagcatcggccccgcccccagccagcagagctacctgagcatggagaagatcatccaggtggccaagaccagcgccgcccaggccatccaccccggctgcggcttcctgagcgagaacatggagttcgccgagctgtgcaagcaggagggcatcatcttcatcggccccccccccagcgccatcagagacatgggcatcaagagcaccagcaagagcatcatggccgccgccggcgtgcccgtggtggagggctaccacggcgaggaccagagcgaccagtgcctgaaggagcacgccagaagaatcggctaccccgtgatgatcaaggccgtgagaggcggcggcggcaagggcatgagaatcgtgagaagcgagcaggagttccaggagcagctggagagcgccagaagagaggccaagaagagcttcaacgacgacgccatgctgatcgagaagttcgtggacacccccagacacgtggaggtgcaggtgttcggcgaccaccacggcaacgccgtgtacctgttcgagagagactgcagcgtgcagagaagacaccagaagatcatcgaggaggcccccgcccccggcatcaagagcgaggtgagaaagaagctgggcgaggccgccgtgagagccgccaaggccgtgaactacgtgggcgccggcaccgtggagttcatcatggacagcaagcacaacttctgcttcatggagatgaacaccagactgcaggtggagcaccccgtgaccgagatgatcaccggcaccgacctggtggagtggcagctgagaatcgccgccggcgagaagatccccctgagccaggaggagatcaccctgcagggccacgccttcgaggccagaatctacgccgaggaccccagcaacaacttcatgcccgtggccggccccctggtgcacctgagcacccccagagccgaccccagcaccagaatcgagaccggcgtgagacagggcgacgaggtgagcgtgcactacgaccccatgatcgccaagctggtggtgtgggccgccgacagacaggccgccctgaccaagctgagatacagcctgagacagtacaacatcgtgggcctgcacaccaacctgaccagctacagcacctgcctggccacccagagcctgaagctgggcacctgcaccctgatcagcagcctgaacaccaccaacagctgctgcagcgtgggcagactgcagcccaagagcctgtacgccagacagccctgggtgagcagcagcagaagaaagccctag

SEQ ID NO: 88781 - DNA, 1281 bp, Artificial Sequence
  Description of Artificial Sequence: Synthetic coding sequence
atggagttcgccgagctgtgcaagcaggagggcatcatcttcatcggccccccccccagcgccatcagagacatgggcatcaagagcaccagcaagagcatcatggccgccgccggcgtgcccgtggtggagggctaccacggcgaggaccagagcgaccagtgcctgaaggagcacgccagaagaatcggctaccccgtgatgatcaaggccgtgagaggcggcggcggcaagggcatgagaatcgtgagaagcgagcaggagttccaggagcagctggagagcgccagaagagaggccaagaagagcttcaacgacgacgccatgctgatcgagaagttcgtggacacccccagacacgtggaggtgcaggtgttcggcgaccaccacggcaacgccgtgtacctgttcgagagagactgcagcgtgcagagaagacaccagaagatcatcgaggaggcccccgcccccggcatcaagagcgaggtgagaaagaagctgggcgaggccgccgtgagagccgccaaggccgtgaactacgtgggcgccggcaccgtggagttcatcatggacagcaagcacaacttctgcttcatggagatgaacaccagactgcaggtggagcaccccgtgaccgagatgatcaccggcaccgacctggtggagtggcagctgagaatcgccgccggcgagaagatccccctgagccaggaggagatcaccctgcagggccacgccttcgaggccagaatctacgccgaggaccccagcaacaacttcatgcccgtggccggccccctggtgcacctgagcacccccagagccgaccccagcaccagaatcgagaccggcgtgagacagggcgacgaggtgagcgtgcactacgaccccatgatcgccaagctggtggtgtgggccgccgacagacaggccgccctgaccaagctgagatacagcctgagacagtacaacatcgtgggcctgcacaccaacatcgacttcctgctgaacctgagcggccaccccgagttcgaggccggcaacgtgcacaccgacttcatcccccagcaccacaagcagctgctgctgagcagaaaggccgccgccaaggagagcctgtgccaggccgccctgggcctgatcctgaaggagaaggccatgaccgacaccttcaccctgcaggcccacgaccagttcagccccttcagcagcagcagcggcagaagactgaacatcagctacaccagaaacatgaccctgaaggacggcaagaacaactag

SEQ ID NO: 88782 - DNA, 603 bp, Artificial Sequence
  Description of Artificial Sequence: Synthetic coding sequence
atggagaagatcatccaggtggccaagaccagcgccgcccaggccatccaccccggctgcggcttcctgagcgagaacatggagttcgccgagctgtgcaagcaggagggcatcatcttcatcggccccccccccagcgccatcagagacatgggcatcaagagcaccagcaagagcatcatggccgccgccggcgtgcccgtggtggagggctaccacggcgaggaccagagcgaccagtgcctgaaggagcacgccagaagaatcggctaccccgtgatgatcaaggccgtgagaggcggcggcggcaagggcatgagaatcgtgagaagcgagcaggagttccaggagcagctggagagcgccagaagagaggccaagaagagcttcaacgacgacgccatgctgatcgagaagttcgtggacacccccagacacgtggaggtgcaggtgttcggcgaccaccacggcaacgccgtgtacctgttcgagagagactgcagcgtgcagagaagacaccagaagatcatcgaggaggcccccgcccccggcatcaagagcgaggtgagaaagaagggcagaagctgcagccagagctgctag

SEQ ID NO: 88783 - DNA, 1578 bp, Artificial Sequence
  Description of Artificial Sequence: Synthetic coding sequence
atgtgggccgtgctgagactggccctgagaccctgcgccagagccagccccgccggccccagagcctaccacggcgacagcgtggccagcctgggcacccagcccgacctgggcagcgccctgtaccaggagaactacaagcagatgaaggccctggtgaaccagctgcacgagagagtggagcacatcaagctgggcggcggcgagaaggccagagccctgcacatcagcagaggcaagctgctgcccagagagagaatcgacaacctgatcgaccccggcagccccttcctggagctgagccagttcgccggctaccagctgtacgacaacgaggaggtgcccggcggcggcatcatcaccggcatcggcagagtgagcggcgtggagtgcatgatcatcgccaacgacgccaccgtgaagggcggcgcctactaccccgtgaccgtgaagaagcagctgagagcccaggagatcgccatgcagaacagactgccctgcatctacctggtggacagcggcggcgcctacctgcccagacaggccgacgtgttccccgacagagaccacttcggcagaaccttctacaaccaggccatcatgagcagcaagaacatcgcccaggtgaaggccgccaccggcgaggaggtgagcgccgaggacctgggcggcgccgacctgcactgcagaaagagcggcgtgagcgaccactgggccctggacgaccaccacgccctgcacctgaccagaaaggtggtgagaaacctgaactaccagaagaagctggacgtgaccatcgagcccagcgaggagcccctgttccccgccgacgagctgtacggcatcgtgggcgccaacctgaagagaagcttcgacgtgagagaggtgatcgccagaatcgtggacggcagcagattcaccgagttcaaggccttctacggcgacaccctggtgaccggcttcgccagaatcttcggctaccccgtgggcatcgtgggcaacaacggcgtgctgttcagcgagagcgccaagaagggcacccacttcgtgcagctgtgctgccagagaaacatccccctgctgttcctgcagaacatcaccggcttcatggtgggcagagagtacgaggccgagggcatcgccaaggacggcgccaagatggtggccgccgtggcctgcgcccaggtgcccaagatcaccctgatcatcggcggcagctacggcgccggcaactacggcatgtgcggcagagcctacagccccagattcctgtacatctggcccaacgccagaatcagcgtgatgggcggcgagcaggccgccaacgtgctggccaccatcaccaaggaccagagagccagagagggcaagcagttcagcagcgccgacgaggccgccctgaaggagcccatcatcaagaagttcgaggaggagggcaacccctactacagcagcgccagagtgtgggacgacggcatcatcgaccccgccgacaccagactggtgctgggcctgagcttcagcgccgccctgaacgcccccatcgagaagaccgacttcggcatcttcagaatgtag

SEQ ID NO: 88784 - DNA, 1692 bp, Artificial Sequence
  Description of Artificial Sequence: Synthetic coding sequence
atgtgggccgtgctgagactggccctgagaccctgcgccagagccagccccgccggccccagagcctaccacggcgacagcgtggccagcctgggcacccagcccgacctgggcagcgccctgtaccaggagaactacaagcagatgaaggccctggtgaaccagctgcacgagagagtggagcacatcaagctgggcggcggcgagaaggccagagccctgcacatcagcagaggcaagctgctgcccagagagagaatcgacaacctgatcgaccccggcagccccttcctggagctgagccagttcgccggctaccagctgtacgacaacgaggaggtgcccggcggcggcatcatcaccggcatcggcagagtgagcggcgtggagtgcatgatcatcgccaacgacgccaccgtgaagggcggcgcctactaccccgtgaccgtgaagaagcagctgagagcccaggagatcgccatgcagaacagactgccctgcatctacctggtggacagcggcggcgcctacctgcccagacaggccgacgtgttccccgacagagaccacttcggcagaaccttctacaaccaggccatcatgagcagcaagaacatcgcccagatcgccgtggtgatgggcagctgcaccgccggcggcgcctacgtgcccgccatggccgacgagaacatcatcgtgagaaagcagggcaccatcttcctggccggcccccccctggtgaaggccgccaccggcgaggaggtgagcgccgaggacctgggcggcgccgacctgcactgcagaaagagcggcgtgagcgaccactgggccctggacgaccaccacgccctgcacctgaccagaaaggtggtgagaaacctgaactaccagaagaagctggacgtgaccatcgagcccagcgaggagcccctgttccccgccgacgagctgtacggcatcgtgggcgccaacctgaagagaagcttcgacgtgagagaggtgatcgccagaatcgtggacggcagcagattcaccgagttcaaggccttctacggcgacaccctggtgaccggcttcgccagaatcttcggctaccccgtgggcatcgtgggcaacaacggcgtgctgttcagcgagagcgccaagaagggcacccacttcgtgcagctgtgctgccagagaaacatccccctgctgttcctgcagaacatcaccggcttcatggtgggcagagagtacgaggccgagggcatcgccaaggacggcgccaagatggtggccgccgtggcctgcgcccaggtgcccaagatcaccctgatcatcggcggcagctacggcgccggcaactacggcatgtgcggcagagcctacagccccagattcctgtacatctggcccaacgccagaatcagcgtgatgggcggcgagcaggccgccaacgtgctggccaccatcaccaaggaccagagagccagagagggcaagcagttcagcagcgccgacgaggccgccctgaaggagcccatcatcaagaagttcgaggaggagggcaacccctactacagcagcgccagagtgtgggacgacggcatcatcgaccccgccgacaccagactggtgctgggcctgagcttcagcgccgccctgaacgcccccatcgagaagaccgacttcggcatcttcagaatgtag

SEQ ID NO: 88785 - DNA, 870 bp, Artificial Sequence
  Description of Artificial Sequence: Synthetic coding sequence
atggccaagcacatccagaaggagatccagagaggcgtggagagctgggtgagcctgggcaacagaagaccccacctgagcatcatcctggtgggcgacaaccccgccagccacacctacgtgagaaacaagatcagagccgccagcgccgtgggcatctgcagcgagctgatcctgaagcccaaggacgtgagccaggaggagctgctggacgtgaccgaccagctgaacatggaccccagagtgagcggcatcctggtgcagctgcccctgcccgaccacgtggacgagagaaccatctgcaacggcatcgcccccgagaaggacgtggacggcttccacatcatcaacatcggcagactgtgcctggaccagcacagcctgatccccgccaccgccagcgccgtgtgggagatcatcaagagaaccggcatccagaccttcggcaagaacgtggtggtggccggcagaagcaagaacgtgggcatgcccatcgccatgctgctgcacaccgacggcgagcacgagagacccggcggcgacgccaccgtgaccatcgcccacagatacacccccaaggagcagctgaagatccacacccagctggccgacatcatcatcgtggccgccggcatccccaagctgatcaccagcgacatggtgaaggagggcgccgccgtgatcgacgtgggcatcaactacgtgcacgaccccgtgaccggcaagaccaagctggtgggcgacgtggacttcgaggccgtgaagaagaaggccggcttcatcacccccgtgcccggcggcgtgggccccatgaccgtggccatgctgctgaagaacaccctgctggccgccaagaagatcatctactag

SEQ ID NO: 88786 - DNA, 672 bp, Artificial Sequence
  Description of Artificial Sequence: Synthetic coding sequence
atggccaagcacatccagaaggagatccagagaggcgtggagagctgggtgagcctgggcaacagaagaccccacctgagcatcatcctggtgggcgacaaccccgccagccacacctacgtgagaaacaagatcagagccgccagcgccgtgggcatctgcagcgagctgatcctgaagcccaaggacgtgagccaggaggagctgctggacgtgaccgaccagctgaacatggaccccagagtgagcggcatcctggtgcagctgcccctgcccgaccacgtggacgagagaaccatctgcaacggcatcgcccccgagaaggacgtggacggcttccacatcatcaacatcggcagactgtgcctggaccagcacagcctgatccccgccaccgccagcgccgtgtgggagatcatcaagagaaccggcatccagaccttcggcaagaacgtggtggtggccggcagaagcaagaacgtgggcatgcccatcgccatgctgctgcacaccgacggcgagcacgagagacccggcggcgacgccaccgtgaccatcgcccacagatacacccccaaggagcagctgaagatccacacccagctggccgacatcatcatcgtggccgccgagagattccaccacttcgcccaggacctgagcaacagctag

SEQ ID NO: 88787 - DNA, 762 bp, Artificial Sequence
  Description of Artificial Sequence: Synthetic coding sequence
atggccaagcacatccagaaggagatccagagaggcgtggagagctgggtgagcctgggcaacagaagaccccacctgagcatcatcctggtgggcgacaaccccgccagccacacctacgtgagaaacaagatcagagccgccagcgccgtgggcatctgcagcgagctgatcctgaagcccaaggacgtgagccaggaggagctgctggacgtgaccgaccagctgaacatggaccccagagtgagcggcatcctggtgcagctgcccctgcccgaccacgtggacgagagaaccatctgcaacggcatcgcccccgagaaggacgtggacggcttccacatcatcaacatcggcagactgtgcctggaccagcacagcctgatccccgccaccgccagcgccgtgtgggagatcatcaagagaaccggcatccagaccttcggcaagaacgtggtggtggccggcagaagcaagaacgtgggcatgcccatcgccatgctgctgcacaccgacggcgagcacgagagacccggcggcgacgccaccgtgaccatcgcccacagatacacccccaaggagcagctgaagatccacacccagctggccgacatcatcatcgtggccgccggcatccccaagctgatcaccagcgacatggtgaaggagggcgccgccgtgatcgacgtgggcatcaactacgtgcacgaccccgtgaccggcaagaccaagctggtgggcgacgtggacttcgaggcctag

SEQ ID NO: 88788 - DNA, 1044 bp, Artificial Sequence
  Description of Artificial Sequence: Synthetic coding sequence
atgaccgtgcccgtgagaggcttcagcctgctgagaggcagactgggcagagcccccgccctgggcagaagcaccgcccccagcgtgagagcccccggcgagcccggcagcgccttcagaggcttcagaagcagcggcgtgagacacgaggccatcatcatcagcggcaccgagatggccaagcacatccagaaggagatccagagaggcgtggagagctgggtgagcctgggcaacagaagaccccacctgagcatcatcctggtgggcgacaaccccgccagccacacctacgtgagaaacaagatcagagccgccagcgccgtgggcatctgcagcgagctgatcctgaagcccaaggacgtgagccaggaggagctgctggacgtgaccgaccagctgaacatggaccccagagtgagcggcatcctggtgcagctgcccctgcccgaccacgtggacgagagaaccatctgcaacggcatcgcccccgagaaggacgtggacggcttccacatcatcaacatcggcagactgtgcctggaccagcacagcctgatccccgccaccgccagcgccgtgtgggagatcatcaagagaaccggcatccagaccttcggcaagaacgtggtggtggccggcagaagcaagaacgtgggcatgcccatcgccatgctgctgcacaccgacggcgagcacgagagacccggcggcgacgccaccgtgaccatcgcccacagatacacccccaaggagcagctgaagatccacacccagctggccgacatcatcatcgtggccgccggcatccccaagctgatcaccagcgacatggtgaaggagggcgccgccgtgatcgacgtgggcatcaactacgtgcacgaccccgtgaccggcaagaccaagctggtgggcgacgtggacttcgaggccgtgaagaagaaggccggcttcatcacccccgtgcccggcggcgtgggccccatgaccgtggccatgctgctgaagaacaccctgctggccgccaagaagatcatctactag

SEQ ID NO: 88789 - DNA, 441 bp, Artificial Sequence
  Description of Artificial Sequence: Synthetic coding sequence
atggaccccagagtgagcggcatcctggtgcagctgcccctgcccgaccacgtggacgagagaaccatctgcaacggcatcgcccccgagaaggacgtggacggcttccacatcatcaacatcggcagactgtgcctggaccagcacagcctgatccccgccaccgccagcgccgtgtgggagatcatcaagagaaccggcatccagaccttcggcaagaacgtggtggtggccggcagaagcaagaacgtgggcatgcccatcgccatgctgctgcacaccgacggcgagcacgagagacccggcggcgacgccaccgtgaccatcgcccacagatacacccccaaggagcagctgaagatccacacccagctggccgacatcatcatcgtggccgccgagagattccaccacttcgcccaggacctgagcaacagctag

SEQ ID NO: 88790 - DNA, 1257 bp, Artificial Sequence
  Description of Artificial Sequence: Synthetic coding sequence
atgcccatgctgctgccccacccccaccagcacttcctgaagggcctgctgagagcccccttcagatgctaccacttcatcttccacagcagcacccacctgggcagcggcatcccctgcgcccagcccttcaacagcctgggcctgcactgcaccaagtggatgctgctgagcgacggcctgaagagaaagctgtgcgtgcagaccaccctgaaggaccacaccgagggcctgagcgacaaggagcagagattcgtggacaagctgtacaccggcctgatccagggccagagagcctgcctggccgaggccatcaccctggtggagagcacccacagcagaaagaaggagctggcccaggtgctgctgcagaaggtgctgctgtaccacagagagcaggagcagagcaacaagggcaagcccctggccttcagagtgggcctgagcggcccccccggcgccggcaagagcaccttcatcgagtacttcggcaagatgctgaccgagagaggccacaagctgagcgtgctggccgtggaccccagcagctgcaccagcggcggcagcctgctgggcgacaagaccagaatgaccgagctgagcagagacatgaacgcctacatcagacccagccccaccagaggcaccctgggcggcgtgaccagaaccaccaacgaggccatcctgctgtgcgagggcgccggctacgacatcatcctgatcgagaccgtgggcgtgggccagagcgagttcgccgtggccgacatggtggacatgttcgtgctgctgctgccccccgccggcggcgacgagctgcagggcatcaagagaggcatcatcgagatggccgacctggtggccgtgaccaagagcgacggcgacctgatcgtgcccgccagaagaatccaggccgagtacgtgagcgccctgaagctgctgagaaagagaagccaggtgtggaagcccaaggtgatcagaatcagcgccagaagcggcgagggcatcagcgagatgtgggacaagatgaaggacttccaggacctgatgctggccagcggcgagctgaccgccaagagaagaaagcagcagaaggtgtggatgtggaacctgatccaggagagcgtgctggagcacttcagaacccaccccaccgtgagagagcagatccccctgctggagcagaaggtgctgatcggcgccctgagccccggcctggccgccgacttcctgctgaaggccttcaagagcagagactag

SEQ ID NO: 88791 - DNA, 1275 bp, Artificial Sequence
  Description of Artificial Sequence: Synthetic coding sequence
atgcccatgctgctgccccacccccaccagcacttcctgaagggcctgctgagagcccccttcagatgctaccacttcatcttccacagcagcacccacctgggcagcggcatcccctgcgcccagcccttcaacagcctgggcctgcactgcaccaagtggatgctgctgagcgacggcctgaagagaaagctgtgcgtgcagaccaccctgaaggaccacaccgagggcctgagcgacaaggagcagagattcgtggacaagctgtacaccggcctgatccagggccagagagcctgcctggccgaggccatcaccctggtggagagcacccacagcagaaagaaggagctggcccaggtgctgctgcagaaggtgctgctgtaccacagagagcaggagcagagcaacaagggcaagcccctggccttcagagtgggcctgagcggcccccccggcgccggcaagagcaccttcatcgagtacttcggcaagatgctgaccgagagaggccacaagctgagcgtgctggccgtggaccccagcagctgcaccagcggcggcagcctgctgggcgacaagaccagaatgaccgagctgagcagagacatgaacgcctacatcagacccagccccaccagaggcaccctgggcggcgtgaccagaaccaccaacgaggccatcctgctgtgcgagggcgccggctacgacatcatcctgatcgagaccgtgggcgtgggccagagcgagttcgccgtggccgacatggtggacatgttcgtgctgctgctgccccccgccggcggcgacgagctgcagggcatcaagagaggcatcatcgagatggccgacctggtggccgtgaccaagagcgacggcgacctgatcgtgcccgccagaagaatccaggccgagtacgtgagcgccctgaagctgctgagaaagagaagccaggtgtggaagcccaaggtgatcagaatcagcgccagaagcggcgagggcatcagcgagatgtgggacaagatgaaggacttccaggacctgatgctggccagcggcgagctgaccgccaagagaagaaagcagcagaaggtgtggatgtggaacctgatccaggagagcgtgctggagcacttcagaacccaccccaccgtgagagagcagatccccctgctggagcagaaggtgctgatcggcgccctgagccccggcctggccgccgacttcctgctgaaggccctgaaggccgagaccaacaagatccaccccgtgtag

SEQ ID NO: 88792 - DNA, 414 bp, Artificial Sequence
  Description of Artificial Sequence: Synthetic coding sequence
atggccgacctggtggccgtgaccaagagcgacggcgacctgatcgtgcccgccagaagaatccaggccgagtacgtgagcgccctgaagctgctgagaaagagaagccaggtgtggaagcccaaggtgatcagaatcagcgccagaagcggcgagggcatcagcgagatgtgggacaagatgaaggacttccaggacctgatgctggccagcggcgagctgaccgccaagagaagaaagcagcagaaggtgtggatgtggaacctgatccaggagagcgtgctggagcacttcagaacccaccccaccgtgagagagcagatccccctgctggagcagaaggtgctgatcggcgccctgagccccggcctggccgccgacttcctgctgaaggccttcaagagcagagactag

SEQ ID NO: 88793 - DNA, 480 bp, Artificial Sequence
  Description of Artificial Sequence: Synthetic coding sequence
atggccggcctgaccagattcgccctggagctggtgaccgagaagggccacaccttcgccgaggagctgcagaagatccagtgcaccctgcaggacgtgggcagcgccctggccaccccctgcagcagcgccagagaggcccacctgaagtacaccaccttcaaggccggccccatcctggagctggagcagtggatcgacaagtacaccagccagctgccccccctgaccgccttcatcctgcccagcggcggcaagatcagcagcgccctgcacttctgcagagccgtgtgcagaagagccgagagaagagtggtgcccctggtgcagatgggcgagaccgacgccaacgtggccaagttcctgaacagactgagcgactacctgttcaccctggccagatacgccgccatgaaggagggcaaccaggagaagatctacatgaagaacgaccccagcgccgagagcgagggcctgtag

SEQ ID NO: 88794 - DNA, 753 bp, Artificial Sequence
  Description of Artificial Sequence: Synthetic coding sequence
atggccgtgtgcggcctgggcagcagactgggcctgggcagcagactgggcctgagaggctgcttcggcgccgccagactgctgtaccccagattccagagcagaggcccccagggcgtggaggacggcgacagaccccagcccagcagcaagacccccagaatccccaagatctacaccaagaccggcgacaagggcttcagcagcaccttcaccggcgagagaagacccaaggacgaccaggtgttcgaggccgtgggcaccaccgacgagctgagcagcgccatcggcttcgccctggagctggtgaccgagaagggccacaccttcgccgaggagctgcagaagatccagtgcaccctgcaggacgtgggcagcgccctggccaccccctgcagcagcgccagagaggcccacctgaagtacaccaccttcaaggccggccccatcctggagctggagcagtggatcgacaagtacaccagccagctgccccccctgaccgccttcatcctgcccagcggcggcaagatcagcagcgccctgcacttctgcagagccgtgtgcagaagagccgagagaagagtggtgcccctggtgcagatgggcgagaccgacgccaacgtggccaagttcctgaacagactgagcgactacctgttcaccctggccagatacgccgccatgaaggagggcaaccaggagaagatctacatgaagaacgaccccagcgccgagagcgagggcctgtag

SEQ ID NO: 88795 - DNA, 849 bp, Artificial Sequence
  Description of Artificial Sequence: Synthetic coding sequence
atggagcccaaggtggccgagctgaagcagaagatcgaggacaccctgtgccccttcggcttcgaggtgtaccccttccaggtggcctggtacaacgagctgctgccccccgccttccacctgcccctgcccggccccaccctggccttcctggtgctgagcacccccgccatgttcgacagagccctgaagcccttcctgcagagctgccacctgagaatgctgaccgaccccgtggaccagtgcgtggcctaccacctgggcagagtgagagagagcctgcccgagctgcagatcgagatcatcgccgactacgaggtgcaccccaacagaagacccaagatcctggcccagaccgccgcccacgtggccggcgccgcctactactaccagagacaggacgtggaggccgacccctggggcaaccagagaatcagcggcgtgtgcatccaccccagattcggcggctggttcgccatcagaggcgtggtgctgctgcccggcatcgaggtgcccgacctgccccccagaaagccccacgactgcgtgcccaccagagccgacagaatcgccctgctggagggcttcaacttccactggagagactggacctacagagacgccgtgaccccccaggagagatacagcgaggagcagaaggcctacttcagcaccccccccgcccagagactggccctgctgggcctggcccagcccagcgagaagcccagcagccccagccccgacctgcccttcaccacccccgcccccaagaagcccggcaaccccagcagagccagaagctggctgagccccagagtgagcccccccgccagccccggcccctag

SEQ ID NO: 88796 - DNA, 891 bp, Artificial Sequence
  Description of Artificial Sequence: Synthetic coding sequence
atggccaacgtgctgtgcaacagagccagactggtgagctacctgcccggcttctgcagcctggtgaagagagtggtgaaccccaaggccttcagcaccgccggcagcagcggcagcgacgagagccacgtggccgccgccccccccgacatctgcagcagaaccgtgtggcccgacgagaccatgggccccttcggcccccaggaccagagattccagctgcccggcaacatcggcttcgactgccacctgaacggcaccgccagccagaagaagagcctggtgcacaagaccctgcccgacgtgctggccgagcccctgagcagcgagagacacgagttcgtgatggcccagtacgtgaacgagttccagggcaacgacgcccccgtggagcaggagatcaacagcgccgagacctacttcgagagcgccagagtggagtgcgccatccagacctgccccgagctgctgagaaaggacttcgagagcctgttccccgaggtggccaacggcaagctgatgatcctgaccgtgacccagaagaccaagaacgacatgaccgtgtggagcgaggaggtggagatcgagagagaggtgctgctggagaagttcatcaacggcgccaaggagatctgctacgccctgagagccgagggctactgggccgacttcatcgaccccagcagcggcctggccttcttcggcccctacaccaacaacaccctgttcgagaccgacgagagatacagacacctgggcttcagcgtggacgacctgggctgctgcaaggtgatcagacacagcctgtggggcacccacgtggtggtgggcagcatcttcaccaacgccacccccgacagccacatcatgaagaagctgagcggcaactag

SEQ ID NO: 88797 - DNA, 891 bp, Artificial Sequence; identical to SEQ ID NO: 88796
  Description of Artificial Sequence: Synthetic coding sequence

SEQ ID NO: 88798 - DNA, 531 bp, Artificial Sequence
  Description of Artificial Sequence: Synthetic coding sequence
atggccagagtgctgaaggccgccgccgccaacgccgtgggcctgttcagcagactgcaggcccccatccccaccgtgagagccagcagcaccagccagcccctggaccaggtgaccggcagcgtgtggaacctgggcagactgaaccacgtggccatcgccgtgcccgacctggagaaggccgccgccttctacaagaacatcctgggcgcccaggtgagcgaggccgtgcccctgcccgagcacggcgtgagcgtggtgttcgtgaacctgggcaacaccaagatggagctgctgcaccccctgggcagagacagccccatcgccggcttcctgcagaagaacaaggccggcggcatgcaccacatctgcatcgaggtggacaacatcaacgccgccgtgatggacctgaagaagaagaagatcagaagcctgagcgaggaggtgaagatcggcgcccacggcaagcccgtgatcttcctgcaccccaaggactgcggcggcgtgctggtggagctggagcaggcctag

SEQ ID NO: 88799 - DNA, 2070 bp, Artificial Sequence
  Description of Artificial Sequence: Synthetic coding sequence
atgatcgagatggccgccgagaaggagcccttcctggtgcccgccccccccccccccctgaaggacgagagcggcggcggcggcggccccaccgtgcccccccaccaggaggccgccagcggcgagctgagaggcggcaccgagagaggccccggcagatgcgcccccagcgccggcagccccgccgccgccgtgggcagagagagccccggcgccgccgccaccagcagcagcggcccccaggcccagcagcacagaggcggcggcccccaggcccagagccacggcgaggccagactgagcgacccccccggcagagccgccccccccgacgtgggcgaggagagaagaggcggcggcggcaccgagctgggcccccccgccccccccagacccagaaacggctaccagccccacagaccccccggcggcggcggcggcaagagaagaaacagctgcaacgtgggcggcggcggcggcggcttcaagcaccccgccttcaagagaagaagaagagtgaacagcgactgcgacagcgtgctgcccagcaacttcctgctgggcggcaacatcttcgaccccctgaacctgaacagcctgctggacgaggaggtgagcagaaccctgaacgccgagacccccaagagcagccccctgcccgccaagggcagagaccccgtggagatcctgatccccaaggacatcaccgaccccctgagcctgaacacctgcaccgacgagggccacgtggtgctggccagccccctgaagaccggcagaaagagacacagacacagaggccagcaccaccagcagcagcaggccgccggcggcagcgagagccaccccgtgccccccaccgcccccctgacccccctgctgcacggcgagggcgccagccagcagcccagacacagaggccagaacagagacgccccccagccctacgagctgaacaccgccatcaactgcagagacgaggtggtgagccccctgcccagcgccctgcagggccccagcggcagcctgagcgccccccccgccgccagcgtgatcagcgccccccccagcagcagcagcagacacagaaagagaagaagaaccagcagcaagagcgaggccggcgccagaggcggcggccagggcagcaaggagaagggcagaggcagctggggcggcagacaccaccaccaccaccccctgcccgccgccggcttcaagaagcagcagagaaagttccagtacggcaactactgcaagtactacggctacagaaaccccagctgcgaggacggcagactgagagtgctgaagcccgagtggttcagaggcagagacgtgctggacctgggctgcaacgtgggccacctgaccctgagcatcgcctgcaagtggggccccagcagaatggtgggcctggacatcgacagcagactgatccacagcgccagacagaacatcagacactacctgagcgaggagctgagactgcccccccagaccctggagggcgaccccggcgccgagggcgaggagggcaccaccaccgtgagaaagagaagctgcttccccgccagcctgaccgccagcagaggccccatcgccgccccccaggtgcccctggacggcgccgacaccagcgtgttccccaacaacgtggtgttcgtgaccggcaactacgtgctggacagagacgacctggtggaggcccagacccccgagtacgacgtggtgctgtgcctgagcctgaccaagtgggtgcacctgaactggggcgacgagggcctgaagagaatgttcagaagaatctacagacacctgagacccggcggcatcctggtgctggagccccagccctggagcagctacggcaagagaaagaccctgaccgagaccatctacaagaactactacagaatccagctgaagcccgagcagttcagcagctacctgaccagccccgacgtgggcttcagcagctacgagctggtggccaccccccacaacaccagcaagggcttccagagacccgtgtacctgttccacaaggccagaagccccagccactag

SEQ ID NO: 88800 - DNA, 663 bp, Artificial Sequence
  Description of Artificial Sequence: Synthetic coding sequence
atggtgggcctggacatcgacagcagactgatccacagcgccagacagaacatcagacactacctgagcgaggagctgagactgcccccccagaccctggagggcgaccccggcgccgagggcgaggagggcaccaccaccgtgagaaagagaagctgcttccccgccagcctgaccgccagcagaggccccatcgccgccccccaggtgcccctggacggcgccgacaccagcgtgttccccaacaacgtggtgttcgtgaccggcaactacgtgctggacagagacgacctggtggaggcccagacccccgagtacgacgtggtgctgtgcctgagcctgaccaagtgggtgcacctgaactggggcgacgagggcctgaagagaatgttcagaagaatctacagacacctgagacccggcggcatcctggtgctggagccccagccctggagcagctacggcaagagaaagaccctgaccgagaccatctacaagaactactacagaatccagctgaagcccgagcagttcagcagctacctgaccagccccgacgtgggcttcagcagctacgagctggtggccaccccccacaacaccagcaagggcttccagagacccgtgtacctgttccacaaggccagaagccccagccactag

SEQ ID NO: 88801 - DNA, 852 bp, Artificial Sequence
  Description of Artificial Sequence: Synthetic coding sequence
atggccagcggcaccaccaccaccgccgtgaagatcggcatcatcggcggcaccggcctggacgaccccgagatcctggagggcagaaccgagaagtacgtggacacccccttcggcaagcccagcgacgccctgatcctgggcaagatcaagaacgtggactgcgtgctgctggccagacacggcagacagcacaccatcatgcccagcaaggtgaactaccaggccaacatctgggccctgaaggaggagggctgcacccacgtgatcgtgaccaccgcctgcggcagcctgagagaggagatccagcccggcgacatcgtgatcatcgaccagttcatcgacagaaccaccatgagaccccagagcttctacgacggcagccacagctgcgccagaggcgtgtgccacatccccatggccgagcccttctgccccaagaccagagaggtgctgatcgagaccgccaagaagctgggcctgagatgccacagcaagggcaccatggtgaccatcgagggccccagattcagcagcagagccgagagcttcatgttcagaacctggggcgccgacgtgatcaacatgaccaccgtgcccgaggtggtgctggccaaggaggccggcatctgctacgccagcatcgccatggccaccgactacgactgctggaaggagcacgaggaggccgtgagcgtggacagagtgctgaagaccctgaaggagaacgccaacaaggccaagagcctgctgctgaccaccatcccccagatcggcagcaccgagtggagcgagaccctgcacaacctgaagaacatggcccagttcagcgtgctgctgcccagacactag

SEQ ID NO: 88802 - DNA, 468 bp, Artificial Sequence
  Description of Artificial Sequence: Synthetic coding sequence
atggccgccgagaccagaaacgtggccggcgccgaggccccccccccccagaagagatactacagacagagagcccacagcaaccccatggccgaccacaccctgagataccccgtgaagcccgaggagatggactggagcgagctgtaccccgagttcttcgcccccctgacccagaaccagagccacgacgaccccaaggacaagaaggagaagagagcccaggcccaggtggagttcgccgacatcggctgcggctacggcggcctgctggccgacaaggacgtgctgcccctgcccagacccaccttccaggccgacaaggcccaggtggccaaccaccagagccaccccgccagcagaatctgcctgagagccaagagctggggcgccggcgtgtaccacaacagatgcgccggcgccaccagactggacgtgcacagcttcagaagagcccccaccgtgtag

SEQ ID NO: 88803 - DNA, 831 bp, Artificial Sequence
  Description of Artificial Sequence: Synthetic coding sequence
atggccgccgagaccagaaacgtggccggcgccgaggccccccccccccagaagagatactacagacagagagcccacagcaaccccatggccgaccacaccctgagataccccgtgaagcccgaggagatggactggagcgagctgtaccccgagttcttcgcccccctgacccagaaccagagccacgacgaccccaaggacaagaaggagaagagagcccaggcccaggtggagttcgccgacatcggctgcggctacggcggcctgctggtggagctgagccccctgttccccgacaccctgatcctgggcctggagatcagagtgaaggtgagcgactacgtgcaggacagaatcagagccctgagagccgcccccgccggcggcttccagaacatcgcctgcctgagaagcaacgccatgaagcacctgcccaacttcttctacaagggccagctgaccaagatgttcttcctgttccccgacccccacttcaagagaaccaagcacaagtggagaatcatcagccccaccctgctggccgagtacgcctacgtgctgagagtgggcggcctggtgtacaccatcaccgacgtgctggagctgcacgactggatgtgcacccacttcgaggagcaccccctgttcgagagagtgcccctggaggacctgagcgaggaccccgtggtgggccacctgggcaccagcaccgaggagggcaagaaggtgctgagaaacggcggcaagaacttccccgccatcttcagaagaatccaggaccccgtgctgcaggccgtgaccagccagaccagcctgcccggccactag

SEQ ID NO: 88804 - DNA, 2274 bp, Artificial Sequence
  Description of Artificial Sequence: Synthetic coding sequence
atggccgaggtgggcagaaccggcatcagctaccccggcgccctgctgccccagggcttctgggccgccgtggaggtgtggctggagagaccccaggtggccaacaagagactgtgcggcgccagactggaggccagatggagcgccgccctgccctgcgccgaggccagaggccccggcaccagcgccggcagcgagcagaaggagagaggccccggccccggccagggcagccccggcggcggccccggccccagaagcctgagcggccccgagcagggcaccgcctgctgcgagctggaggaggcccagggccagtgccagcaggaggaggcccagagagaggccgccagcgtgcccctgagagacagcggccaccccggccacgccgagggcagagagggcgacttccccgccgccgacctggacagcctgtgggaggacttcagccagagcctggccagaggcaacagcgagctgctggccttcctgaccagcagcggcgccggcagccagcccgaggcccagagagagctggacgtggtgctgagaaccgtgatccccaagaccagcccccactgccccctgaccacccccagaagagagatcgtggtgcaggacgtgctgaacggcaccatcaccttcctgcccctggaggaggacgacgagggcaacctgaaggtgaagatgagcaacgtgtaccagatccagctgagccacagcaaggaggagtggttcatcagcgtgctgatcttctgccccgagagatggcacagcgacggcatcgtgtaccccaagcccacctggctgggcgaggagctgctggccaagctggccaagtggagcgtggagaacaagaagagcgacttcaagagcaccctgagcctgatcagcatcatgaagtacagcaaggcctaccaggagctgaaggagaagtacaaggagatggtgaaggtgtggcccgaggtgaccgaccccgagaagttcgtgtacgaggacgtggccatcgccgcctacctgctgatcctgtgggaggaggagagagccgagagaagactgaccgccagacagagcttcgtggacctgggctgcggcaacggcctgctggtgcacatcctgagcagcgagggccaccccggcagaggcatcgacgtgagaagaagaaagatctgggacatgtacggcccccagacccagctggaggaggacgccatcacccccaacgacaagaccctgttccccgacgtggactggctgatcggcaaccacagcgacgagctgaccccctggatccccgtgatcgccgccagaagcagctacaactgcagattcttcgtgctgccctgctgcttcttcgacttcatcggcagatacagcagaagacagagcaagaagacccagtacagagagtacctggacttcatcaaggaggtgggcttcacctgcggcttccacgtggacgaggactgcctgagaatccccagcaccaagagagtgtgcctggtgggcaagagcagaacctaccccagcagcagagaggccagcgtggacgagaagagaacccagtacatcaagagcagaagaggctgccccgtgagcccccccggctgggagctgagccccagccccagatgggtggccgccggcagcgccggccactgcgacggccagcaggccctggacgccagagtgggctgcgtgaccagagcctgggccgccgagcacggcgccggcccccaggccgagggcccctggctgcccggcttccaccccagagagaaggccgagagagtgagaaactgcgccgccctgcccagagacttcatcgaccaggtggtgctgcaggtggccaacctgctgctgggcggcaagcagctgaacaccagaagcagcagaaacggcagcctgaagacctggaacggcggcgagagcctgagcctggccgaggtggccaacgagctggacaccgagaccctgagaagactgaagagagagtgcggcggcctgcagaccctgctgagaaacagccaccaggtgttccaggtggtgaacggcagagtgcacatcagagactggagagaggagaccctgtggaagaccaagcagcccgaggccaagcagagactgctgagcgaggcctgcaagaccagactgtgctggttcttcatgcaccaccccgacggctgcgccctgagcaccgactgctgccccttcgcccacggccccgccgagctgagaccccccagaaccacccccagaaagaagatcagctag

SEQ ID NO: 88805 - DNA, 1236 bp, Artificial Sequence
  Description of Artificial Sequence: Synthetic coding sequence
atgtgcatcaagttcagcagcgtgatcgccaagaagaacgagagatggcacagcgacggcatcgtgtaccccaagcccacctggctgggcgaggagctgctggccaagctggccaagtggagcgtggagaacaagaagagcgacttcaagagcaccctgagcctgatcagcatcatgaagtacagcaaggcctaccaggagctgaaggagaagtacaaggagatggtgaaggtgtggcccgaggtgaccgaccccgagaagttcgtgtacgaggacgtggccatcgccgcctacctgctgatcctgtgggaggaggagagagccgagagaagactgaccgccagacagagcttcgtggacctgggctgcggcaacggcctgctggtgcacatcctgagcagcgagggccaccccggcagaggcatcgacgtgagaagaagaaagatctgggacatgtacggcccccagacccagctggaggaggacgccatcacccccaacgacaagaccctgttccccgacgtggactggctgatcggcaaccacagcgacgagctgaccccctggatccccgtgatcgccgccagaagcagctacaactgcagattcttcgtgctgccctgctgcttcttcgacttcatcggcagatacagcagaagacagagcaagaagacccagtacagagagtacctggacttcatcaaggaggtgggcttcacctgcggcttccacgtggacgaggactgcctgagaatccccagcaccaagagagtgtgcctggtgggcaagagcagaacctaccccagcagcagagaggccagcgtggacgagaagagaacccagtacatcaagagcagaagaggctgccccgtgagcccccccggctgggagctgagccccagccccagatgggtggccgccggcagcgccggccactgcgacggccagcaggccctggacgccagagtgggctgcgtgaccagagcctgggccgccgagcacggcgccggcccccaggccgagggcccctggctgcccggcttccaccccagagagaaggccgagagagtgagaaactgcgccgccctgcccagagacttcatcgaccaggtggtgctgcaggtggccaacctgctgctgggcggcaagcagctgaacaccagaagcagcagaaacggcagcctgaagacctggaacggcggcggcaagctgagcaccatcctgggcagaggctag

SEQ ID NO: 88806 - DNA, 1743 bp, Artificial Sequence
  Description of Artificial Sequence: Synthetic coding sequence
atgagcgacacctggagcagcatccaggcccacaagaagcagctggacagcctgagagagagactgcagagaagaagaaagcaggacagcggccacctggacctgagaaaccccgaggccgccctgagccccaccttcagaagcgacagccccgtgcccaccgcccccaccagcggcggccccaagcccagcaccgccagcgccgtgcccgagctggccaccgaccccgagctggagaagaagctgctgcaccacctgagcgacctggccctgaccctgcccaccgacgccgtgagcatctgcctggccatcagcacccccgacgcccccgccacccaggacggcgtggagagcctgctgcagaagttcgccgcccaggagctgatcgaggtgaagagaggcctgctgcaggacgacgcccaccccaccctggtgacctacgccgaccacagcaagctgagcgccatgatgggcgccgtggccgagaagaagggccccggcgaggtggccggcaccgtgaccggccagaagagaagagccgagcaggacagcaccaccgtggccgccttcgccagcagcctggtgagcggcctgaacagcagcgccagcgagcccgccaaggagcccgccaagaagagcagaaagcacgccgccagcgacgtggacctggagatcgagagcctgctgaaccagcagagcaccaaggagcagcagagcaagaaggtgagccaggagatcctggagctgctgaacaccaccaccgccaaggagcagagcatcgtggagaagttcagaagcagaggcagagcccaggtgcaggagttctgcgactacggcaccaaggaggagtgcatgaaggccagcgacgccgacagaccctgcagaaagctgcacttcagaagaatcatcaacaagcacaccgacgagagcctgggcgactgcagcttcctgaacacctgcttccacatggacacctgcaagtacgtgcactacgagatcgacgcctgcatggacagcgaggcccccggcagcaaggaccacacccccagccaggagctggccctgacccagagcgtgggcggcgacagcagcgccgacagactgttccccccccagtggatctgctgcgacatcagatacctggacgtgagcatcctgggcaagttcgccgtggtgatggccgaccccccctgggacatccacatggagctgccctacggcaccctgaccgacgacgagatgagaagactgaacatccccgtgctgcaggacgacggcttcctgttcctgtgggtgaccggcagagccatggagctgggcagagagtgcctgaacctgtggggctacgagagagtggacgagatcatctgggtgaagaccaaccagctgcagagaatcatcagaaccggcagaaccggccactggctgaaccacggcaaggagcactgcctggtgggcgtgaagggcaacccccagggcttcaaccagggcctggactgcgacgtgatcgtggccgaggtgagaagcaccagccacaagcccgacgagatctacggcatgatcgagagactgagccccggcaccagaaagatcgagctgttcggcagaccccacaacgtgcagcccaactggatcaccctgggcaaccagctggacggcatccacctgctggaccccgacgtggtggccagattcaagcagagataccccgacggcatcatcagcaagcccaagaacctgtag

SEQ ID NO: 88807 - DNA, 492 bp, Artificial Sequence
  Description of Artificial Sequence: Synthetic coding sequence
atgagcgacacctggagcagcatccaggcccacaagaagcagctggacagcctgagagagagactgcagagaagaagaaagcaggacagcggccacctggacctgagaaaccccgaggccgccctgagccccaccttcagaagcgacagccccgtgcccaccgcccccaccagcggcggccccaagcccagcaccgccagcgccgtgcccgagctggccaccgaccccgagctggagaagaagctgctgcaccacctgagcgacctggccctgaccctgcccaccgacgccgtgagcatctgcctggccatcagcacccccgacgcccccgccacccaggacggcgtggagagcctgctgcagaagttcgccgcccaggagctgatcgaggtgaagagaggcctgctgcaggacgacgcccaccccaccctggtgacctacgccgaccacagcaagctgagcgccatgatgggcgccgtggccgagaagtag

SEQ ID NO: 88808 - DNA, 462 bp, Artificial Sequence
  Description of Artificial Sequence: Synthetic coding sequence
atgagcgacacctggagcagcatccaggcccacaagaagcagctggacagcctgagagagagactgcagagaagaagaaagcaggacagcggccacctggacctgagaaaccccgaggccgccctgagccccaccttcagaagcgacagccccgtgcccaccgcccccaccagcggcggccccaagcccagcaccgccagcgccgtgcccgagctggccaccgaccccgagctggagaagaagctgctgcaccacctgagcgacctggccctgaccctgcccaccgacgccgtgagcatctgcctggccatcagcacccccgacgcccccgccacccaggacggcgtggagagcctgctgcagaagttcgccgcccaggagctgatcgagcacagaaaccagcagagaagccagcccagaaaccagggcaacatgctgccccagatgctgatctggagatag

SEQ ID NO: 88809 - DNA, 879 bp, Artificial Sequence
  Description of Artificial Sequence: Synthetic coding sequence
atgctgggcgcctgggccgtggagggcaccgccgtggccctgctgagactgctgctgctgctgctgccccccgccatcagaggccccggcctgggcgtggccggcgtggccggcgccgccggcgccggcctgcccgagagcgtgatctgggccgtgaacgccggcggcgaggcccacgtggacgtgcacggcatccacttcagaaaggaccccctggagggcagagtgggcagagccagcgactacggcatgaagctgcccatcctgagaagcaaccccgaggaccagatcctgtaccagaccgagagatacaacgaggagaccttcggctacgaggtgcccatcaaggaggagggcgactacgtgctggtgctgaagttcgccgaggtgtacttcgcccagagccagcagaaggtgttcgacgtgagactgaacggccacgtggtggtgaaggacctggacatcttcgacagagtgggccacagcaccgcccacgacgagatcatccccatgagcatcagaaagggcaagctgagcgtgcagggcgaggtgagcaccttcaccggcaagctgtacatcgagttcgtgaagggctactacgacaaccccaaggtgtgcgccctgtacatcatggccggcaccgtggacgacgtgcccaagctgcagccccaccccggcctggagaagaaggaggaggaggaggaggaggaggagtacgacgagggcagcaacctgaagaagcagaccaacaagaacagagtgcagagcggccccagaacccccaacccctacgccagcgacaacagcagcctgatgttccccatcctggtggccttcggcgtgttcatccccaccctgttctgcctgtgcagactgtag

SEQ ID NO: 88810 - DNA, 1035 bp, Artificial Sequence
  Description of Artificial Sequence: Synthetic coding sequence
atgctgagcgaggtgctgctggtgagcgcccccggcaaggtgatcctgcacggcgagcacgccgtggtgcacggcaaggtggccctggccgtgagcctgaacctgagaaccttcctgagactgcagccccacagcaacggcaaggtggacctgagcctgcccaacatcggcatcaagagagcctgggacgtggccagactgcagagcctggacaccagcttcctggagcagggcgacgtgaccacccccaccagcgagcaggtggagaagctgaaggaggtggccggcctgcccgacgactgcgccgtgaccgagagactggccgtgctggccttcctgtacctgtacctgagcatctgcagaaagcagagatggaccaaggaggacctggagctgatcaacaagtgggccttccagggcgagagaatgatccacggcaaccccagcggcgtggacaacgccgtgagcacctggggcggcgccctgagataccaccagggcaagatcagcagcctgaagagaagccccgccctgcagatcctgctgaccaacaccaaggtgcccagaaacaccagagccctggtggccggcgtgagaaacagactgctgaagttccccgagatcgtggcccccctgctgaccagcatcgacgccatcagcctggagtgcgagagagtgctgggcgagatgggcgaggcccccgcccccgagcagtacctggtgctggaggagctgatcgacatgaaccagcaccacctgaacgccctgggcgtgggccacgccagcctggaccagctgtgccaggtgaccagagccagaggcctgcacagcaagctgaccggcgccggcggcggcggctgcggcatcaccctgctgaagcccggcctggagcagcccgaggtggaggccaccaagcaggccctgaccagctgcggcttcgactgcctggagaccagcatcggcgcccccggcgtgagcatccacagcgccaccagcctggacagcagagtgcagcaggccctggacggcctgtag

SEQ ID NO: 88811 - DNA, 516 bp, Artificial Sequence
  Description of Artificial Sequence: Synthetic coding sequence
atgctgagcgaggtgctgctggtgagcgcccccggcaaggtgatcctgcacggcgagcacgccgtggtgcacggcaaggtggccctggccgtgagcctgaacctgagaaccttcctgagactgcagccccacagcaacggcaaggtggacctgagcctgcccaacatcggcatcaagagagcctgggacgtggccagactgcagagcctggacaccagcttcctggagcagggcgacgtgaccacccccaccagcgagcaggtggagaagctgaaggaggtggccggcctgcccgacgactgcgccgtgaccgagagactggccgtgctggccttcctgtacctgtacctgagcatctgcagaaagcagagagccctgcccagcctggacatcgtggtgtggagcgagctgccccccggcgccggcctgggcagcagcgccgcctacagcgtgtgcctggccgccgccctgctgaccgtgtgcgaggagatccccaaccccctgaaggacggctag

SEQ ID NO: 88812 - DNA, 1035 bp, Artificial Sequence; identical to SEQ ID NO: 88810
  Description of Artificial Sequence: Synthetic coding sequence

SEQ ID NO: 88813 - DNA, 609 bp, Artificial Sequence
  Description of Artificial Sequence: Synthetic coding sequence
atgatccacggcaaccccagcggcgtggacaacgccgtgagcacctggggcggcgccctgagataccaccagggcaagatcagcagcctgaagagaagccccgccctgcagatcctgctgaccaacaccaaggtgcccagaaacaccagagccctggtggccggcgtgagaaacagactgctgaagttccccgagatcgtggcccccctgctgaccagcatcgacgccatcagcctggagtgcgagagagtgctgggcgagatgggcgaggcccccgcccccgagcagtacctggtgctggaggagctgatcgacatgaaccagcaccacctgaacgccctgggcgtgggccacgccagcctggaccagctgtgccaggtgaccagagccagaggcctgcacagcaagctgaccggcgccggcggcggcggctgcggcatcaccctgctgaagcccggcctggagcagcccgaggtggaggccaccaagcaggccctgaccagctgcggcttcgactgcctggagaccagcatcggcgcccccggcgtgagcatccacagcgccaccagcctggacagcagagtgcagcaggccctggacggcctgtag

SEQ ID NO: 88814 - DNA, 606 bp, Artificial Sequence
  Description of Artificial Sequence: Synthetic coding sequence
atgctgagcgaggtgctgctggtgagcgcccccggcaaggtgatcctgcacggcgagcacgccgtggtgcacggcaaggtggccctggccgtgagcctgaacctgagaaccttcctgagactgcagccccacagcaacggcaaggtggacctgagcctgcccaacatcggcatcaagagagcctgggacgtggccagactgcagagcctggacaccagcttcctggagcagggcgacgtgaccacccccaccagcgagcaggtggagaagctgaaggaggtggccggcctgcccgacgactgcgccgtgaccgagagactggccgtgctggccttcctgtacctgtacctgagcatctgcagaaagcagagagccctgcccagcctggacatcgtggtgtggagcgagctgccccccggcgccggcctgggcagcagcgccgcctacagcgtgtgcctggccgccgccctgctgaccgtgtgcgaggagatccccaaccccctgaaggacggcgactgcgtgaacagatggaccaaggaggacctggagctgatcaacaagtgggccttccagggcgagagaatgatccacggcaaccccagctag

SEQ ID NO: 88815 - DNA, 1563 bp, Artificial Sequence
  Description of Artificial Sequence: Synthetic coding sequence
atgcccagcctggtggtgagcggcatcatggagagaaacggcggcttcggcgagctgggctgcttcggcggcagcgccaaggacagaggcctgctggaggacgagagagccctgcagctggccctggaccagctgtgcctgctgggcctgggcgagccccccgcccccaccgccggcgaggacggcggcggcggcggcggcggcgcccccgcccagcccgccgcccccccccagcccgcccccccccccccccccgccgccccccccgccgcccccaccgccgcccccgccgcccagaccccccagccccccaccgcccccaagggcgccagcgacgccaagctgtgcgccctgtacaaggaggccgagctgagactgaagggcagcagcaacaccaccgagtgcgtgcccgtgcccaccagcgagcacgtggccgagatcgtgggcagacagggctgcaagatcaaggccctgagagccaagaccaacacctacatcaagacccccgtgagaggcgaggagcccgtgttcatggtgaccggcagaagagaggacgtggccaccgccagaagagagatcatcagcgccgccgagcacttcagcatgatcagagccagcagaaacaagagcggcgccgccttcggcgtggcccccgccctgcccggccaggtgaccatcagagtgagagtgccctacagagtggtgggcctggtggtgggccccaagggcgccaccatcaagagaatccagcagcagaccaacacctacatcatcacccccagcagagacagagaccccgtgttcgagatcaccggcgcccccggcaacgtggagagagccagagaggagatcgagacccacatcgccgtgagaaccggcaagatcctggagtacaacaacgagaacgacttcctggccggcagccccgacgccgccatcgacagcagatacagcgacgcctggagagtgcaccagcccggctgcaagcccctgagcaccttcagacagaacagcctgggctgcatcggcgagtgcggcgtggacagcggcttcgaggcccccagactgggcgagcagggcggcgacttcggctacggcggctacctgttccccggctacggcgtgggcaagcaggacgtgtactacggcgtggccgagaccagcccccccctgtgggccggccaggagaacgccacccccaccagcgtgctgttcagcagcgccagcagcagcagcagcagcagcgccaaggccagagccggcccccccggcgcccacagaagccccgccaccagcgccggccccgagctggccggcctgcccagaagaccccccggcgagcccctgcagggcttcagcaagctgggcggcggcggcctgagaagccccggcggcggcagagactgcatggtgtgcttcgagagcgaggtgaccgccgccctggtgccctgcggccacaacctgttctgcatggagtgcgccgtgagaatctgcgagagaaccgaccccgagtgccccgtgtgccacatcaccgccacccaggccatcagaatcttcagctag

SEQ ID NO: 88816 - DNA, 1710 bp, Artificial Sequence
  Description of Artificial Sequence: Synthetic coding sequence
atgcccagcagcctgttcgccgacctggagagaaacggcagcggcggcggcggcggcggcagcagcggcggcggcgagaccctggacgaccagagagccctgcagctggccctggaccagctgagcctgctgggcctggacagcgacgagggcgccagcctgtacgacagcgagcccagaaagaagagcgtgaacatgaccgagtgcgtgcccgtgcccagcagcgagcacgtggccgagatcgtgggcagacagggctgcaagatcaaggccctgagagccaagaccaacacctacatcaagacccccgtgagaggcgaggagcccgtgttcgtggtgaccggcagaaaggaggacgtggccatggccagaagagagatcatcagcgccgccgagcacttcagcatgatcagagccagcagaaacaagaacaccgccctgaacggcgccgtgcccggcccccccaacctgcccggccagaccaccatccaggtgagagtgccctacagagtggtgggcctggtggtgggccccaagggcgccaccatcaagagaatccagcagcagacccacacctacatcgtgacccccagcagagacaaggagcccgtgttcgaggtgaccggcatgcccgagaacgtggacagagccagagaggagatcgaggcccacatcgccctgagaaccggcggcatcatcgagctgaccgacgagaacgacttccacgccaacggcaccgacgtgggcttcgacctgcaccacggcagcggcggcagcggccccggcagcctgtggagcaagcccacccccagcatcacccccacccccggcagaaagcccttcagcagctacagaaacgacagcagcagcagcctgggcagcgccagcaccgacagctacttcggcggcggcaccagcagcagcgccgccgccacccagagactggccgactacagcccccccagccccgccctgagcttcgcccacaacggcaacaacaacaacaacggcaacggctacacctacaccgccggcggcgaggccagcgtgcccagccccgacggctgccccgagctgcagcccaccttcgaccccgcccccgcccccccccccggcgcccccctgatctgggcccagttcgagagaagccccggcggcggccccgccgcccccgtgagcagcagctgcagcagcagcgccagcagcagcgccagcagcagcagcgtggtgttccccggcggcggcgccagcgcccccagcaacgccaacctgggcctgctggtgcacagaagactgcaccccggcaccagctgccccagactgagcccccccctgcacatggcccccggcgccggcgagcaccacctggccagaagagtgagaagcgaccccggcggcggcggcctggcctacgccgcctacgccaacggcctgggcgcccagctgcccggcctgcagcccagcgacaccagcggcagcagcagcagcagcagcagcagcagcagcagcagcagcagcagcagcggcctgagaagaaagggcagcagagactgcagcgtgtgcttcgagagcgaggtgatcgccgccctggtgccctgcggccacaacctgttctgcatggagtgcgccaacagaatctgcgagaagagcgagcccgagtgccccgtgtgccacaccgccgtgacccaggccatcagaatcttcagctag

SEQ ID NO: 88817 - DNA, 1980 bp, Artificial Sequence
  Description of Artificial Sequence: Synthetic coding sequence
atgcccagcggcagcagcgccgccctggccctggccgccgcccccgcccccctgccccagcccccccccccccccccccccccccccccccccctgcccccccccagcggcggccccgagctggagggcgacggcctgctgctgagagagagactggccgccctgggcctggacgaccccagccccgccgagcccggcgcccccgccctgagagcccccgccgccgccgcccagggccaggccagaagagccgccgagctgagccccgaggagagagccccccccggcagacccggcgcccccgaggccgccgagctggagctggaggaggacgaggaggagggcgaggaggccgagctggacggcgacctgctggaggaggaggagctggaggaggccgaggaggaggacagaagcagcctgctgctgctgagcccccccgccgccaccgccagccagacccagcagatccccggcggcagcctgggcagcgtgctgctgcccgccgccagattcgacgccagagaggccgccgccgccgccgccgccgccggcgtgctgtacggcggcgacgacgcccagggcatgatggccgccatgctgagccacgcctacggccccggcggctgcggcgccgccgccgccgccctgaacggcgagcaggccgccctgctgagaagaaagagcgtgaacaccaccgagtgcgtgcccgtgcccagcagcgagcacgtggccgagatcgtgggcagacagggctgcaagatcaaggccctgagagccaagaccaacacctacatcaagacccccgtgagaggcgaggagcccatcttcgtggtgaccggcagaaaggaggacgtggccatggccaagagagagatcctgagcgccgccgagcacttcagcatgatcagagccagcagaaacaagaacggccccgccctgggcggcctgagctgcagccccaacctgcccggccagaccaccgtgcaggtgagagtgccctacagagtggtgggcctggtggtgggccccaagggcgccaccatcaagagaatccagcagcagacccacacctacatcgtgacccccagcagagacaaggagcccgtgttcgaggtgaccggcatgcccgagaacgtggacagagccagagaggagatcgagatgcacatcgccatgagaaccggcaactacatcgagctgaacgaggagaacgacttccactacaacggcaccgacgtgagcttcgagggcggcaccctgggcagcgcctggctgagcagcaaccccgtgccccccagcagagccagaatgatcagcaactacagaaacgacagcagcagcagcctgggcagcggcagcaccgacagctacttcggcagcaacagactggccgacttcagccccaccagccccttcagcaccggcaacttctggttcggcgacaccctgcccagcgtgggcagcgaggacctggccgtggacagccccgccttcgacagcctgcccaccagcgcccagaccatctggacccccttcgagcccgtgaaccccctgagcggcttcggcagcgaccccagcggcaacatgaagacccagagaagaggcagccagcccagcacccccagactgagccccaccttccccgagagcatcgagcaccccctggccagaagagtgagaagcgacccccccagcaccggcaaccacgtgggcctgcccatctacatccccgccttcagcaacggcaccaacagctacagcagcagcaacggcggcagcaccagcagcagcccccccgagagcagaagaaagcacgactgcgtgatctgcttcgagaacgaggtgatcgccgccctggtgccctgcggccacaacctgttctgcatggagtgcgccaacaagatctgcgagaagagaacccccagctgccccgtgtgccagaccgccgtgacccaggccatccagatccacagctag

SEQ ID NO: 88818 - DNA, 498 bp, Artificial Sequence
  Description of Artificial Sequence: Synthetic coding sequence
tggagatggaccagctgcagaagaagcggctggggcgccctggccaccagaaccagaagaggcagacccggcaccccccccccccccagacccagcccccccgacgtgttcgccggcttcgccccccaccccgccgccctgggcccccccaccctgctggccgaccagatgagcgtgatcggcagcagaaagaagagcgtgaacatgaccgagtgcgtgcccgtgcccagcagcgagcacgtggccgagatcgtgggcagacagggctgcaagatcaaggccctgagagccaagaccaacacctacatcaagacccccgtgagaggcgaggagcccgtgttcatcgtgaccggcagaaaggaggacgtggagatggccaagagagagatcctgagcgccgccgagcacttcagcatcatcagagccaccagaagcaaggccggcggcctgcccggcgccgcccagggcccccccaacctgcccggccagaccacctag

SEQ ID NO: 88819 - DNA, 2001 bp, Artificial Sequence
  Description of Artificial Sequence: Synthetic coding sequence
atgcccagcagcctgggccagcccgacggcggcggcggcggcggcggcggcggcggcggcgtgggcgccgccggcgaggaccccggccccggccccgcccccccccccgagggcgcccaggaggccgcccccgcccccagacccccccccgagcccgacgacgccgccgccgccctgagactggccctggaccagctgagcgccctgggcctgggcggcgccggcgacaccgacgaggagggcgccgccggcgacggcgccgccgccgccggcggcgccgacggcggcgccgcccccgagcccgtgccccccgacggccccgaggccggcgccccccccaccctggcccccgccgtggcccccggcagcctgcccctgctggaccccaacgccagccccccccccccccccccccccagacccagcccccccgacgtgttcgccggcttcgccccccaccccgccgccctgggcccccccaccctgctggccgaccagatgagcgtgatcggcagcagaaagaagagcgtgaacatgaccgagtgcgtgcccgtgcccagcagcgagcacgtggccgagatcgtgggcagacagggctgcaagatcaaggccctgagagccaagaccaacacctacatcaagacccccgtgagaggcgaggagcccgtgttcatcgtgaccggcagaaaggaggacgtggagatggccaagagagagatcctgagcgccgccgagcacttcagcatcatcagagccaccagaagcaaggccggcggcctgcccggcgccgcccagggcccccccaacctgcccggccagaccaccatccaggtgagagtgccctacagagtggtgggcctggtggtgggccccaagggcgccaccatcaagagaatccagcagagaacccacacctacatcgtgacccccggcagagacaaggagcccgtgttcgccgtgaccggcatgcccgagaacgtggacagagccagagaggagatcgaggcccacatcaccctgagaaccggcgccttcaccgacgccggccccgacagcgacttccacgccaacggcaccgacgtgtgcctggacctgctgggcgccgccgccagcctgtgggccaagacccccaaccagggcagaagaccccccaccgccaccgccggcctgagaggcgacaccgccctgggcgcccccagcgcccccgaggccttctacgccggcagcagaggcggccccagcgtgcccgaccccggccccgccagcccctacagcggcagcggcaacggcggcttcgccttcggcgccgagggccccggcgcccccgtgggcaccgccgcccccgacgactgcgacttcggcttcgacttcgacttcctggccctggacctgaccgtgcccgccgccgccaccatctgggcccccttcgagagagccgcccccctgcccgccttcagcggctgcagcaccgtgaacggcgcccccggcccccccgccgccggcgccagaagaagcagcggcgccggcacccccagacacagccccaccctgcccgagcccggcggcctgagactggagctgcccctgagcagaagaggcgcccccgaccccgtgggcgccctgagctggagacccccccagggccccgtgagcttccccggcggcgccgccttcagcaccgccaccagcctgcccagcagccccgccgccgccgcctgcgcccccctggacagcggcgccagcgagaacagcagaaagccccccagcgccagcagcgcccccgccctggccagagagtgcgtggtgtgcgccgagggcgaggtgatggccgccctggtgccctgcggccacaacctgttctgcatggactgcgccgtgagaatctgcggcaagagcgagcccgagtgccccgcctgcagaacccccgccacccaggccatcagagtggagaccgagaccccccagcccggcggcgccagcgccctgcagagacagtactag

SEQ ID NO: 88820 - DNA, 1956 bp, Artificial Sequence
  Description of Artificial Sequence: Synthetic coding sequence
atgcccagcagcctgggccagcccgacggcggcggcggcggcggcggcggcggcggcggcgtgggcgccgccggcgaggaccccggccccggccccgcccccccccccgagggcgcccaggaggccgcccccgcccccagacccccccccgagcccgacgacgccgccgccgccctgagactggccctggaccagctgagcgccctgggcctgggcggcgccggcgacaccgacgaggagggcgccgccggcgacggcgccgccgccgccggcggcgccgacggcggcgccgcccccgagcccgtgccccccgacggccccgaggccggcgccccccccaccctggcccccgccgtggcccccggcagcctgcccctgctggaccccaacgccagccccccccccccccccccccccagacccagcccccccgacgtgttcgccggcttcgccccccaccccgccgccctgggcccccccaccctgctggccgaccagatgagcgtgatcggcagcagaaagaagagcgtgaacatgaccgagtgcgtgcccgtgcccagcagcgagcacgtggccgagatcgtgggcagacagggctgcaagatcaaggccctgagagccaagaccaacacctacatcaagacccccgtgagaggcgaggagcccgtgttcatcgtgaccggcagaaaggaggacgtggagatggccaagagagagatcctgagcgccgccgagcacttcagcatcatcagagccaccagaagcaaggccggcggcctgcccggcgccgcccagggcccccccaacctgcccggccagaccaccatccaggtgagagtgccctacagagtggtgggcctggtggtgggccccaagggcgccaccatcaagagaatccagcagagaacccacacctacatcgtgacccccggcagagacaaggagcccgtgttcgccgtgaccggcatgcccgagaacgtggacagagccagagaggagatcgaggcccacatcaccctgagaaccggcgccttcaccgacgccggccccgacagcgacttccacgccaacggcaccgacgtgtgcctggacctgctgggcgccgccgccagcctgtgggccaagacccccaaccagggcagaagaccccccaccgccaccgccggcctgagaggcgacaccgccctgggcgcccccagcgcccccgaggccttctacgccggcagcagaggcggccccagcgtgcccgaccccggccccgccagcccctacagcggcagcggcaacggcggcttcgccttcggcgccgagggccccggcgcccccgtgggcaccgccgcccccgacgactgcgacttcggcttcgacttcgacttcctggccctggacctgaccgtgcccgccgccgccaccatctgggcccccttcgagagagccgcccccctgcccgccttcagcggctgcagcaccgtgaacggcgcccccggcccccccgccgccggcgccagaagaagcagcggcgccggcacccccagacacagccccaccctgcccgagcccggcggcctgagactggagctgcccctgagcagaagaggcgcccccgaccccgtgggcgccctgagctggagacccccccagggccccgtgagcttccccggcggcgccgccttcagcaccgccaccagcctgcccagcagccccgccgccgccgcctgcgcccccctggacagcggcgccagcgagaacagcagaaagccccccagcgccagcagcgcccccgccctggccagagagtgcgtggtgtgcgccgagggcgaggtgatggccgccctggtgccctgcggccacaacctgttctgcatggactgcgccgtgagaatctgcggcaagagcgagcccgagtgccccgcctgcagaacccccgccacccaggccatccacatcttcagctag

SEQ ID NO: 88821 - DNA, 966 bp, Artificial Sequence
  Description of Artificial Sequence: Synthetic coding sequence
atgcagtgcagactgcccagaggcctggccggcgccctgctgaccctgctgtgcatgggcctgctgtgcctgagataccacctgaacctgagcccccagagagtgcagggcacccccgagctgagccagcccaaccccggcccccccaagctgcagctgcacgacgtgttcatcgccgtgaagaccaccagagccttccacagactgagactggagctgctgctggacacctgggtgagcagaaccagagagcagaccttcgtgttcaccgacagccccgacaagggcctgcaggagagactgggcagccacctggtggtgaccaactgcagcgccgagcacagccaccccgccctgagctgcaagatggccgccgagttcgacaccttcctggccagcggcctgagatggttctgccacgtggacgacgacaactacgtgaaccccagagccctgctgcagctgctgagagccttccccctggccagagacgtgtacgtgggcagacccagcctgaacagacccatccacgccagcgagccccagccccacaacagaaccagactggtgcagttctggttcgccaccggcggcgccggcttctgcatcaacagaaagctggccctgaagatggccccctgggccagcggcagcagattcatggacaccagcgccctgatcagactgcccgacgactgcaccatgggctacatcatcgagtgcaagctgggcggcagactgcagcccagccccctgttccacagccacctggagaccctgcagctgctgagaaccgcccagctgcccgagcaggtgaccctgagctacggcgtgttcgagggcaagctgaacgtgatcaagctgcagggccccttcagccccgaggaggaccccagcagattcagaagcctgcactgcctgctgtaccccgacaccccctggtgcccccagctgggcgccagatag

SEQ ID NO: 88822 - DNA, 924 bp, Artificial Sequence
  Description of Artificial Sequence: Synthetic coding sequence
atgcagtgcagactgcccagaggcctggccggcgccctgctgaccctgctgtgcatgggcctgctgtgcctgagataccacctgaacctgagcccccagagagtgcagggcacccccgagctgagccagcccaaccccggcccccccaagctgcagctgcacgacgtgttcatcgccgtgaagaccaccagagccttccacagactgagactggagctgctgctggacacctgggtgagcagaaccagagagcaggtgaccagaagccacctggtggtgaccaactgcagcgccgagcacagccaccccgccctgagctgcaagatggccgccgagttcgacaccttcctggccagcggcctgagatggttctgccacgtggacgacgacaactacgtgaaccccagagccctgctgcagctgctgagagccttccccctggccagagacgtgtacgtgggcagacccagcctgaacagacccatccacgccagcgagccccagccccacaacagaaccagactggtgcagttctggttcgccaccggcggcgccggcttctgcatcaacagaaagctggccctgaagatggccccctgggccagcggcagcagattcatggacaccagcgccctgatcagactgcccgacgactgcaccatgggctacatcatcgagtgcaagctgggcggcagactgcagcccagccccctgttccacagccacctggagaccctgcagctgctgagaaccgcccagctgcccgagcaggtgaccctgagctacggcgtgttcgagggcaagctgaacgtgatcaagctgcagggccccttcagccccgaggaggaccccagcagattcagaagcctgcactgcctgctgtaccccgacaccccctggtgcccccagctgggcgccagatag

SEQ ID NO: 88823 - DNA, 357 bp, Artificial Sequence
  Description of Artificial Sequence: Synthetic coding sequence
atgcagtgcagactgcccagaggcctggccggcgccctgctgaccctgctgtgcatgggcctgctgtgcctgagataccacctgaacctgagcccccagagagtgcagggcacccccgagctgagccagcccaaccccggcccccccaagctgcagctgcacgacgtgttcatcgccgtgaagaccaccagagccttccacagactgagactggagctgctgctggacacctgggtgagcagaaccagagagcagaccttcgtgttcaccgacagccccgacaagggcctgcaggagagactgggcagccccgacagcagcagcctgctgcagggccccaccctgtggagcccctag

SEQ ID NO: 88824 - DNA, 399 bp, Artificial Sequence
  Description of Artificial Sequence: Synthetic coding sequence
atggccgccgagttcgacaccttcctggccagcggcctgagatggttctgccacgtggacgacgacaactacgtgaaccccagagccctgctgcagctgctgagagccttccccctggccagagacgtgtacgtgggcagacccagcctgaacagacccatccacgccagcgagccccagccccacaacagaaccagactggtgcagttctggttcgccaccggcggcgccggcttctgcatcaacagaaagctggccctgaagatggccccctgggccagcggcagcagattcatggacaccagcgccctgatcagactgcccgacgactgcaccatgggctacatcatcgagtgcaagctgggcggcagactgcagcccagccccctgttccactag

SEQ ID NO: 88825 - DNA, 132 bp, Artificial Sequence
  Description of Artificial Sequence: Synthetic coding sequence
atggccgccgagttcgacaccttcctggccagcggcctgagatggttctgccacgtggacgacgacaactacgtgaaccccagagccctgctgcagctgctgagagccttccccctggccagagacgtgtag

SEQ ID NO: 88826 - DNA, 264 bp, Artificial Sequence
  Description of Artificial Sequence: Synthetic coding sequence
tgaagccacctggagaccctgcagctgctgagaaccgcccagctgcccgagcagatcagcctgccccccctgagcgccctgagcagatacaccctggtgagccccgccggctgccccatgaaccccgagctgctgggcaagggctgggccgagaccagcggctgcgccctggcccccaaggtggccctgtgggtgcccggcaagtgcctggtgatcggcagcccctggcagggcctgagagtggtgggcaagcccagaatctag

SEQ ID NO: 88827 - DNA, 999 bp, Artificial Sequence
  Description of Artificial Sequence: Synthetic coding sequence
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacctggagaccgaggagtggaccgtgccccagagcagcagagcccagaccctggccatgaacgtgagaaacttcctgaaggaggacgccatgaagaccaagacccactaccacgccatgcacgccgactgcctgcaggagctgagaagatacctggagagcggcgtggtgctgagaagaaccgtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 88828 - DNA, 585 bp, Artificial Sequence
  Description of Artificial Sequence: Synthetic coding sequence
atgggccagagagaccagggcctggacagagagagaaagggcccccaggacgaccccggcagctaccagggccccgagagaagaaacttcctgaaggaggacgccatgaagaccaagacccactaccacgccatgcacgccgactgcctgcaggagctgagaagatacctggagagcggcgtggtgctgagaagaaccgtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 88829 - DNA, 870 bp, Artificial Sequence
  Description of Artificial Sequence: Synthetic coding sequence
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccagagcagcagagcccagaccctggccatgaacgtgagaaacttcctgaaggaggacgccatgaagaccaagacccactaccacgccatgcacgccgactgcctgcaggagctgagaagatacctggagagcggcgtggtgctgagaagaaccgtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 88830 - DNA, 738 bp, Artificial Sequence
  Description of Artificial Sequence: Synthetic coding sequence
atgggccagagagaccagagactggacagagagagaaagggcccccaggacgaccccggcagctaccagggccccgagagaagaaacttcctgaaggaggacgccatgaagaccaagacccactaccacgccatgcacgccgactgcctgcaggagctgagaagatacctgaagagcggcgtggtgctgagaagaaccgtgccccccatggtgaacgtgaccagaagcgaggccagcgagggcaacatcaccgtgacctgcagagccagcggcttctacccctggaacatcaccctgagctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgacctgggcagcaccggcagcaccgagggcgcctag

SEQ ID NO: 88831 - DNA, 1152 bp, Artificial Sequence
  Description of Artificial Sequence: Synthetic coding sequence
atgggcctgggccccgtgttcctgctgctggccggcatcttccccttcgccccccccggcgccgccgccgagccccacagcctgagatacaacctgaccgtgctgagctgggacggcagcgtgcagagcggcttcctgaccgaggtgcacctggacggccagcccttcctgagatgcgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacctggagaccaaggagtggaccatgccccagagcagcagagcccagaccctggccatgaacgtgagaaacttcctgaaggaggacgccatgaagaccaagacccactaccacgccatgcacgccgactgcctgcaggagctgagaagatacctgaagagcggcgtggtgctgagaagaaccgtgccccccatggtgaacgtgaccagaagcgaggccagcgagggcaacatcaccgtgacctgcagagccagcggcttctacccctggaacatcaccctgagctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgacctgggcagcaccggcagcaccgagggcgcctag

SEQ ID NO: 88832 - DNA, 870 bp, Artificial Sequence; identical to SEQ ID NO: 88829
  Description of Artificial Sequence: Synthetic coding sequence

SEQ ID NO: 88833 - DNA, 999 bp, Artificial Sequence; identical to SEQ ID NO: 88827
  Description of Artificial Sequence: Synthetic coding sequence

SEQ ID NO: 88834 - DNA, 585 bp, Artificial Sequence; identical to SEQ ID NO: 88828
  Description of Artificial Sequence: Synthetic coding sequence

SEQ ID NO: 88835 - DNA, 831 bp, Artificial Sequence
  Description of Artificial Sequence: Synthetic coding sequence
ttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 88836 - DNA, 1158 bp, Artificial Sequence
  Description of Artificial Sequence: Synthetic coding sequence
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacgtggagaccgaggagtggaccgtgccccagagcagcagagcccagaccctggccatgaacgtgagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 88837 - DNA, 744 bp, Artificial Sequence
  Description of Artificial Sequence: Synthetic coding sequence
atgggccagagagaccagggcctggacagagagagaaagggcccccaggacgaccccggcagctaccagggccccgagagaagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 88838 - DNA, 672 bp, Artificial Sequence
  Description of Artificial Sequence: Synthetic coding sequence
ttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 88839 - DNA, 672 bp, Artificial Sequence; identical to SEQ ID NO: 88838
  Description of Artificial Sequence: Synthetic coding sequence

SEQ ID NO: 88840 - DNA, 672 bp, Artificial Sequence; identical to SEQ ID NO: 88838
  Description of Artificial Sequence: Synthetic coding sequence

SEQ ID NO: 88841 - DNA, 999 bp, Artificial Sequence; identical to SEQ ID NO: 88827
  Description of Artificial Sequence: Synthetic coding sequence

SEQ ID NO: 88842 - DNA, 1029 bp, Artificial Sequence
  Description of Artificial Sequence: Synthetic coding sequence
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccagagcagcagagcccagaccctggccatgaacgtgagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 88843 - DNA, 825 bp, Artificial Sequence
  Description of Artificial Sequence: Synthetic coding sequence
ttccccttcgccccccccggcgccgccgccgagccccacagcctgagatacaacctgaccgtgctgagctgggacggcagcgtgcagagcggcttcctgaccgaggtgcacctggacggccagcccttcctgagatgcgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccccatggtgaacgtgaccagaagcgaggccagcgagggcaacatcaccgtgacctgcagagccagcggcttctacccctggaacatcaccctgagctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgacctgggcagcaccggcagcaccgagggcgcctag

SEQ ID NO: 88844 - DNA, 585 bp, Artificial Sequence; identical to SEQ ID NO: 88828
  Description of Artificial Sequence: Synthetic coding sequence

SEQ ID NO: 88845 - DNA, 870 bp, Artificial Sequence; identical to SEQ ID NO: 88829
  Description of Artificial Sequence: Synthetic coding sequence

SEQ ID NO: 88846 - DNA, 999 bp, Artificial Sequence; identical to SEQ ID NO: 88827
  Description of Artificial Sequence: Synthetic coding sequence

SEQ ID NO: 88847 - DNA, 999 bp, Artificial Sequence; identical to SEQ ID NO: 88827
  Description of Artificial Sequence: Synthetic coding sequence

SEQ ID NO: 88848 - DNA, 1152 bp, Artificial Sequence; identical to SEQ ID NO: 88831
  Description of Artificial Sequence: Synthetic coding sequence

SEQ ID NO: 88849 - DNA, 999 bp, Artificial Sequence; identical to SEQ ID NO: 88827
  Description of Artificial Sequence: Synthetic coding sequence

SEQ ID NO: 88850 - DNA, 999 bp, Artificial Sequence
  Description of Artificial Sequence: Synthetic coding sequence
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacgtggagaccgaggagtggaccgtgccccagagcagcagagcccagaccctggccatgaacgtgagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgcctgctgctgctacttctgctactactacttcctgtgccccctgctgtag

SEQ ID NO: 88851 - DNA, 1152 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgagaacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 88852 - DNA, 1152 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgatctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 88853 - DNA, 1023 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgagaacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 88854 - DNA, 1023 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88855 - DNA, 126 bp, Artificial Sequence
  Description of Artificial Sequence: Synthetic coding sequence
atgggcctgggcagagtgctgctgttcctggccgtggccttccccttcgccccccccgccgccgccgccgtggagatgggcttccacagagtgagccaggacggcctggacctgctgaccagctag

SEQ ID NO: 88856 - DNA, 1083 bp, Artificial Sequence
  Description of Artificial Sequence: Synthetic coding sequence
tgaccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88857 - DNA, 1152 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88858 - DNA, 1023 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88859 - DNA, 1152 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88860 - DNA, 1023 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgatctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 88861 - DNA, 1023 bp, Artificial Sequence; identical to SEQ ID NO: 88858
  Description of Artificial Sequence: Synthetic coding sequence

SEQ ID NO: 88862 - DNA, 1023 bp, Artificial Sequence; identical to SEQ ID NO: 88853
  Description of Artificial Sequence: Synthetic coding sequence

SEQ ID NO: 88863 - DNA, 1152 bp, Artificial Sequence; identical to SEQ ID NO: 88857
  Description of Artificial Sequence: Synthetic coding sequence

SEQ ID NO: 88864 - DNA, 1152 bp, Artificial Sequence; identical to SEQ ID NO: 88851
  Description of Artificial Sequence: Synthetic coding sequence

SEQ ID NO: 88865 - DNA, 1023 bp, Artificial Sequence; identical to SEQ ID NO: 88854
  Description of Artificial Sequence: Synthetic coding sequence

SEQ ID NO: 88866 - DNA, 954 bp, Artificial Sequence
  Description of Artificial Sequence: Synthetic coding sequence
tgaccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88867 - DNA, 1152 bp, Artificial Sequence
  Description of Artificial Sequence: Synthetic coding sequence
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatgcacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88868 - DNA, 1056 bp, Artificial Sequence
  Description of Artificial Sequence: Synthetic coding sequence
atggtgctgagccaggacggcagcgtgcagagcggcttcctggccgagggccacctggacggccagcccttcctgagatacgacagacagaagagaagagccaagccccagggccagtgggccgagaacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 88869 - DNA, 126 bp, Artificial Sequence; identical to SEQ ID NO: 88855
  Description of Artificial Sequence: Synthetic coding sequence

SEQ ID NO: 88870 - DNA, 126 bp, Artificial Sequence; identical to SEQ ID NO: 88855
  Description of Artificial Sequence: Synthetic coding sequence

SEQ ID NO: 88871 - DNA, 1056 bp, Artificial Sequence
  Description of Artificial Sequence: Synthetic coding sequence
atggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatgcacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88872 - DNA, 1056 bp, Artificial Sequence
  Description of Artificial Sequence: Synthetic coding sequence
atggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgatctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 88873 - DNA, 126 bp, Artificial Sequence; identical to SEQ ID NO: 88855
  Description of Artificial Sequence: Synthetic coding sequence

SEQ ID NO: 88874 - DNA, 126 bp, Artificial Sequence; identical to SEQ ID NO: 88855
  Description of Artificial Sequence: Synthetic coding sequence

SEQ ID NO: 88875 - DNA, 1056 bp, Artificial Sequence; identical to SEQ ID NO: 88868
  Description of Artificial Sequence: Synthetic coding sequence

SEQ ID NO: 88876 - DNA, 126 bp, Artificial Sequence; identical to SEQ ID NO: 88855
  Description of Artificial Sequence: Synthetic coding sequence

SEQ ID NO: 88877 - DNA, 126 bp, Artificial Sequence; identical to SEQ ID NO: 88855
  Description of Artificial Sequence: Synthetic coding sequence

SEQ ID NO: 88878 - DNA, 1056 bp, Artificial Sequence
  Description of Artificial Sequence: Synthetic coding sequence
atggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 88879 - DNA, 2088 bp, Artificial Sequence
  Description of Artificial Sequence: Synthetic coding sequence
atgagcccccccaaggaccccagccccagcctgcccctgcccagcagcagcagccacagcagcagcccccccagcagcagcagcaccagcgtgagcggcaacgcccccgacggcagcagccccccccagatgaccgccagcgagcccctgagccaggtgagcagaggccaccccagcccccccacccccaacttcagaagaagagccgtggcccagggcgcccccagagagatccccctgtacctgccccaccaccccaagcccgagtgggccgagtactgcctggtgagccccggcgaggacggcctgagcgaccccgccgagatgaccagcgacgagtgccagcccgccgaggcccccctgggcgacatcggcagcaaccacagagacccccaccccatctggggcaaggacagaagctggaccggccaggagctgagccccctggccggcgaggacagagagaagggcagcaccggcgccagaaaggaggaggagggcggccccgtgctggtgaaggagaagctgggcctgaagaagctggtgctgacccaggagcagaagaccatgctgctggactggaacgacagcatccccgagagcgtgcacctgaaggccggcgagagaatcagccagaagagcgccgagaacggcagaggcggcagagtgctgaagcccgtgagacccctgctgctgcccagagccgccggcgagcccctgcccacccagagaggcgcccaggagaagatgggcacccccgccgagcaggcccagggcgagagaaacgtgcccccccccaagagccccctgagactgatcgccaacgccatcagaagaagcctggagcccctgctgagcaacagcgagggcggcaagaaggcctgggccaagcaggagagcaagaccctgcccgcccaggcctgcaccagaagcttcagcctgagaaagaccaacagcaacaaggacggcgaccagcacagccccggcagaaaccagagcagcgccttcagcccccccgaccccgccctgagaacccacagcctgcccaacagacccagcaaggtgttccccgccctgagaagccccccctgcagcaagatcgaggacgtgcccaccctgctggagaaggtgagcctgcaggagaacttccccgacgccagcaagccccccaagaagagaatcagcctgttcagcagcctgagactgaaggacaagagcttcgagagcttcctgcaggagagcagacagagaaaggacatcagagacctgttcggcagccccaagagaaaggtgctgcccgaggacagcgcccaggccctggagaagctgctgcagcccttcaagagcaccagcctgagacaggccgccccccccccccccccccccccccccccccccccccccccccccaccgccggcggcgccgacagcaagaacttccccctgagagcccaggtgaccgaggccagcagcagcgccagcagcaccagcagcagcagcgccgacgaggagttcgacccccagctgagcctgcagctgaaggagaagaagaccctgagaagaagaaagaagctggagaaggccatgaagcagctggtgaagcaggaggagctgaagagactgtacaaggcccaggccatccagagacagctggaggaggtggaggagagacagagagccagcgagatccagggcgtgagactggagaaggccctgagaggcgaggccgacagcggcacccaggacgaggcccagctgctgcaggagtggttcaagctggtgctggagaagaacaagctgatgagatacgagagcgagctgctgatcatggcccaggagctggagctggaggaccaccagagcagactggagcagaagctgagagagaagatgctgaaggaggagagccagaaggacgagaaggacctgaacgaggagcaggaggtgttcaccgagctgatgcaggtgatcgagcagagagacaagctggtggacagcctggaggagcagagaatcagagagaaggccgaggaccagcacttcgagagcttcgtgttcagcagaggctgccagctgagcagaacctag

SEQ ID NO: 88880 - DNA, 90 bp, Artificial Sequence
  Description of Artificial Sequence: Synthetic coding sequence
atgagcccccccaaggaccccagccccagcctgcccctgcccagcagcagcagccacagcagcagcccccccagcagcagcagcacctag

SEQ ID NO: 88881 - DNA, 522 bp, Artificial Sequence
  Description of Artificial Sequence: Synthetic coding sequence
atgagcctgctgggccccaaggtgctgctgttcctggccgccttcatcatcaccagcgactggatccccctgggcgtgaacagccagagaggcgacgacgtgacccaggccacccccgagaccttcaccgaggaccccaacctggtgaacgaccccgccaccgacgagaccgtgctggccgtgctggccgacatcgcccccagcaccgacgacctggccagcctgagcgagaagaacaccaccgccgagtgctgggacgagaagttcacctgcaccagactgtacagcgtgcacagacccgtgaagcagtgcatccaccagctgtgcttcaccagcctgagaagaatgtacatcgtgaacaaggagatctgcagcagactggtgtgcaaggagcacgaggccatgaaggacgagctgtgcagacagatggccggcctgccccccagaagactgagaagaagcaactacttcagactgcccccctgcgagaacgtggacctgcagagacccaacggcctgtag

SEQ ID NO: 88882 - DNA, 492 bp, Artificial Sequence
  Description of Artificial Sequence: Synthetic coding sequence
atgagcctgctgggccccaaggtgctgctgttcctggccgccttcatcatcaccagcgactggatccccctgggcgtgaacagccagagaggcgacgacgtgacccaggccacccccgagaccttcaccgaggaccccaacctggtgaacgaccccgccaccgacgagaccgtgctggccgtgctggccgacatcgcccccagcaccgacgacctggagtgctgggacgagaagttcacctgcaccagactgtacagcgtgcacagacccgtgaagcagtgcatccaccagctgtgcttcaccagcctgagaagaatgtacatcgtgaacaaggagatctgcagcagactggtgtgcaaggagcacgaggccatgaaggacgagctgtgcagacagatggccggcctgccccccagaagactgagaagaagcaactacttcagactgcccccctgcgagaacgtggacctgcagagacccaacggcctgtag

SEQ ID NO: 88883 - DNA, 447 bp, Artificial Sequence
  Description of Artificial Sequence: Synthetic coding sequence
atgagcctgctgggccccaaggtgctgctgttcctggccgccttcatcatcaccagcgactggatccccctgggcgtgaacagccagagaggcgacgacgtgacccaggccacccccgagaccttcaccgaggaccccaacctggtgaacgaccccgccaccgacgagaccgagtgctgggacgagaagttcacctgcaccagactgtacagcgtgcacagacccgtgaagcagtgcatccaccagctgtgcttcaccagcctgagaagaatgtacatcgtgaacaaggagatctgcagcagactggtgtgcaaggagcacgaggccatgaaggacgagctgtgcagacagatggccggcctgccccccagaagactgagaagaagcaactacttcagactgcccccctgcgagaacgtggacctgcagagacccaacggcctgtag

SEQ ID NO: 88884 - DNA, 492 bp, Artificial Sequence; identical to SEQ ID NO: 88882
  Description of Artificial Sequence: Synthetic coding sequence

SEQ ID NO: 88885 - DNA, 276 bp, Artificial Sequence
  Description of Artificial Sequence: Synthetic coding sequence
atgagcctgctgggccccaaggtgctgctgttcctggccgccttcatcatcaccagcgactggatccccctgggcgtgaacagccagagaggcgacgacgtgacccaggccacccccgagaccttcaccgaggaccccaacctggtgaacgaccccgccaccgacgagaccgtgctggccgtgctggccgacatcgcccccagcaccgacgacctggccagcctgagcgagaagaacaccaccgccgagtgctgggacgagaagttcacctgctag

SEQ ID NO: 88886 - DNA, 1320 bp, Artificial Sequence
  Description of Artificial Sequence: Synthetic coding sequence
atgagcgtgcccagcgccctgatgaagcagccccccatccagagcaccgccggcgccgtgcccgtgagaaacgagaagggcgagatcagcatggagaaggtgaaggtgaagagatacgtgagcggcaagagacccgactacgcccccatggagagcagcgacgaggaggacgaggagttccagttcatcaagaaggccaaggagcaggaggccgagcccgaggagcaggaggaggacagcagcagcgaccccagactgagaagactgcagaacagaatcagcgaggacgtggaggagagactggccagacacagaaagatcgtggagcccgaggtggtgggcgagagcgacagcgaggtggagggcgacgcctggagaatggagagagaggacagcagcgaggaggaggaggaggagatcgacgacgaggagatcgagagaagaagaggcatgatgagacagagagcccaggagagaaagaacgaggagatggaggtgatggaggtggaggacgagggcagaagcggcgaggagagcgagagcgagagcgagtacgaggagtacaccgacagcgaggacgagatggagcccagactgaagcccgtgttcatcagaaagaaggacagagtgaccgtgcaggagagagaggccgaggccctgaagcagaaggagctggagcaggaggccaagagaatggccgaggagagaagaaagtacaccctgaagatcgtggaggaggagaccaagaaggagctggaggagaacaagagaagcctggccgccctggacgccctgaacaccgacgacgagaacgacgaggaggagtacgaggcctggaaggtgagagagctgaagagaatcaagagagacagagaggacagagaggccctggagaaggagaaggccgagatcgagagaatgagaaacctgaccgaggaggagagaagagccgagctgagagccaacggcaaggtgatcaccaacaaggccgtgaagggcaagtacaagttcctgcagaagtactaccacagaggcgccttcttcatggacgaggacgaggaggtgtacaagagagacttcagcgcccccaccctggaggaccacttcaacaagaccatcctgcccaaggtgatgcaggtgaagaacttcggcagaagcggcagaaccaagtacacccacctggtggaccaggacaccaccagcttcgacagcgcctggggccaggagagcgcccagaacaccaagttcttcaagcagaaggccgccggcgtgagagacgtgttcgagagacccagcgccaagaagagaaagaccacctag

SEQ ID NO: 88887 - DNA, 549 bp, Artificial Sequence
  Description of Artificial Sequence: Synthetic coding sequence
atgagagccgcctacctgttcctgctgttcctgcccggcctgctggcccagggccagtacgacctggaccccctgccccccttccccgaccacgtgcagtacacccactacagcgaccagatcgacaaccccgactactacgactaccaggaggtgacccccagacccagcgaggagcagttccagttccagagccagcagcaggtgcagcaggaggtgatccccgcccccacccccgagcccggcaacgccgagctggagcccaccgagcccggccccctggactgcagagaggagcagtacccctgcaccagactgtacagcatccacagaccctgcaagcagtgcctgaacgaggtgtgcttctacagcctgagaagagtgtacgtgatcaacaaggagatctgcgtgagaaccgtgtgcgcccacgaggagctgctgagagccgacctgtgcagagacaagttcagcaagtgcggcgtgatggccagcagcggcctgtgccagagcgtggccgccagctgcgccagaagctgcggcagctgctag

SEQ ID NO: 88888 - DNA, 552 bp, Artificial Sequence
  Description of Artificial Sequence: Synthetic coding sequence
atgagagccgcctacctgttcctgctgttcctgcccgccggcctgctggcccagggccagtacgacctggaccccctgccccccttccccgaccacgtgcagtacacccactacagcgaccagatcgacaaccccgactactacgactaccaggaggtgacccccagacccagcgaggagcagttccagttccagagccagcagcaggtgcagcaggaggtgatccccgcccccacccccgagcccggcaacgccgagctggagcccaccgagcccggccccctggactgcagagaggagcagtacccctgcaccagactgtacagcatccacagaccctgcaagcagtgcctgaacgaggtgtgcttctacagcctgagaagagtgtacgtgatcaacaaggagatctgcgtgagaaccgtgtgcgcccacgaggagctgctgagagccgacctgtgcagagacaagttcagcaagtgcggcgtgatggccagcagcggcctgtgccagagcgtggccgccagctgcgccagaagctgcggcagctgctag

SEQ ID NO: 88889 - DNA, 549 bp, Artificial Sequence; identical to SEQ ID NO: 88887
  Description of Artificial Sequence: Synthetic coding sequence

SEQ ID NO: 88890 - DNA, 1089 bp, Artificial Sequence
  Description of Artificial Sequence: Synthetic coding sequence
atgaagctgcactgctgcctgttcaccctggtggccagcatcatcgtgcccgccgccttcgtgctggaggacgtggacttcgaccagatggtgagcctggaggccaacagaagcagctacaacgccagcttccccagcagcttcgagctgagcgccagcagccacagcgacgacgacgtgatcatcgccaaggagggcaccagcgtgagcatcgagtgcctgctgaccgccagccactacgaggacgtgcactggcacaacagcaagggccagcagctggacggcagaagcagaggcggcaagtggctggtgagcgacaacttcctgaacatcaccaacgtggccttcgacgacagaggcctgtacacctgcttcgtgaccagccccatcagagccagctacagcgtgaccctgagagtgatcttcaccagcggcgacatgagcgtgtactacatgatcgtgtgcctgatcgccttcaccatcaccctgatcctgaacgtgaccagactgtgcatgatgagcagccacctgagaaagaccgagaaggccatcaacgagttcttcagaaccgagggcgccgagaagctgcagaaggccttcgagatcgccaagagaatccccatcatcaccagcgccaagaccctggagctggccaaggtgacccagttcaagaccatggagttcgccagatacatcgaggagctggccagaagcgtgcccctgccccccctgatcctgaactgcagagccttcgtggaggagatgttcgaggccgtgagagtggacgaccccgacgacctgggcgagagaatcaaggagagacccgccctgaacgcccagggcggcatctacgtgatcaaccccgagatgggcagaagcaacagccccggcggcgacagcgacgacggcagcctgaacgagcagggccaggagatcgccgtgcaggtgagcgtgcacctgcagagcgagaccaagagcatcgacaccgagagccagggcagcagccacttcagcccccccgacgacatcggcagcgccgagagcaactgcaactacaaggacggcgcctacgagaactgccagctgtag

SEQ ID NO: 88891 - DNA, 1089 bp, Artificial Sequence; identical to SEQ ID NO: 88890
  Description of Artificial Sequence: Synthetic coding sequence

SEQ ID NO: 88892 - DNA, 651 bp, Artificial Sequence
  Description of Artificial Sequence: Synthetic coding sequence
atgagcgtgtactacatgatcgtgtgcctgatcgccttcaccatcaccctgatcctgaacgtgaccagactgtgcatgatgagcagccacctgagaaagaccgagaaggccatcaacgagttcttcagaaccgagggcgccgagaagctgcagaaggccttcgagatcgccaagagaatccccatcatcaccagcgccaagaccctggagctggccaaggtgacccagttcaagaccatggagttcgccagatacatcgaggagctggccagaagcgtgcccctgccccccctgatcctgaactgcagagccttcgtggaggagatgttcgaggccgtgagagtggacgaccccgacgacctgggcgagagaatcaaggagagacccgccctgaacgcccagggcggcatctacgtgatcaaccccgagatgggcagaagcaacagccccggcggcgacagcgacgacggcagcctgaacgagcagggccaggagatcgccgtgcaggtgagcgtgcacctgcagagcgagaccaagagcatcgacaccgagagccagggcagcagccacttcagcccccccgacgacatcggcagcgccgagagcaactgcaactacaaggacggcgcctacgagaactgccagctgtag

SEQ ID NO: 88893 - DNA, 54 bp, Artificial Sequence
  Description of Artificial Sequence: Synthetic coding sequence
atgaagctgcactgctgcctgttcaccctggtggccagcatcatcgtgccctag

SEQ ID NO: 88894 - DNA, 330 bp, Artificial Sequence
  Description of Artificial Sequence: Synthetic coding sequence
atgaagctgcactgctgcctgttcaccctggtggccagcatcatcgtgcccgccgccttcgtgctggaggacgtggacttcgaccagatggtgagcctggaggccaacagaagcagctacaacgccagcttccccagcagcttcgagctgagcgccagcagccacagcgacgacgacgtgatcatcgccaaggagggcaccagcgtgagcatcgagtgcctgctgaccgccagccactacgaggacgtgcactggcacaacagcaagggccagcagctggacggcagaagcagaggcggcaagtggctggtgagcgacaacttcctgtag

SEQ ID NO: 88895 - DNA, 372 bp, Artificial Sequence
  Description of Artificial Sequence: Synthetic coding sequence
atgaagctgcactgctgcctgttcaccctggtggccagcatcatcgtgcccgccgccttcgtgctggaggacgtggacttcgaccagatggtgagcctggaggccaacagaagcagctacaacgccagcttccccagcagcttcgagctgagcgccagcagccacagcgacgacgacgtgatcatcgccaaggagggcaccagcgtgagcatcgagtgcctgctgaccgccagccactacgaggacgtgcactggcacaacagcaagggccagcagctggacggcagaagcagaggcggcaagtggctggtgagcgacaacttcctgaacatcaccaacgtggccttcgacgacagaggcctgtacacctag

SEQ ID NO: 88896 - DNA, 768 bp, Artificial Sequence
  Description of Artificial Sequence: Synthetic coding sequence
atgaaggccctgctggccctgcccctgctgctgctgctgagcacccccccctgcgccccccaggtgagcggcatcagaggcgacgccctggagagattctgcctgcagcagcccctggactgcgacgacatctacgcccagggctaccagagcgacggcgtgtacctgatctaccccagcggccccagcgtgcccgtgcccgtgttctgcgacatgaccaccgagggcggcaagtggaccgtgttccagaagagattcaacggcagcgtgagcttcttcagaggctggaacgactacaagctgggcttcggcagagccgacggcgagtactggctgggcctgcagaacatgcacctgctgaccctgaagcagaagtacgagctgagagtggacctggaggacttcgagaacaacaccgcctacgccaagtacgccgacttcagcatcagccccaacgccgtgagcgccgaggaggacggctacaccctgttcgtggccggcttcgaggacggcggcgccggcgacagcctgagctaccacagcggccagaagttcagcaccttcgacagagaccaggacctgttcgtgcagaactgcgccgccctgagcagcggcgccttctggttcagaagctgccacttcgccaacctgaacggcttctacctgggcggcagccacctgagctacgccaacggcatcaactgggcccagtggaagggcttctactacagcctgaagagaaccgagatgaagatcagaagagcctag

SEQ ID NO: 88897 - DNA, 840 bp, Artificial Sequence
  Description of Artificial Sequence: Synthetic coding sequence
atgggcgagctgagccccctgcagagacccctggccaccgagggcaccatgaaggcccagggcgtgctgctgaagctggccctgctggccctgcccctgctgctgctgctgagcacccccccctgcgccccccaggtgagcggcatcagaggcgacgccctggagagattctgcctgcagcagcccctggactgcgacgacatctacgcccagggctaccagagcgacggcgtgtacctgatctaccccagcggccccagcgtgcccgtgcccgtgttctgcgacatgaccaccgagggcggcaagtggaccgtgttccagaagagattcaacggcagcgtgagcttcttcagaggctggaacgactacaagctgggcttcggcagagccgacggcgagtactggctgggcctgcagaacatgcacctgctgaccctgaagcagaagtacgagctgagagtggacctggaggacttcgagaacaacaccgcctacgccaagtacgccgacttcagcatcagccccaacgccgtgagcgccgaggaggacggctacaccctgttcgtggccggcttcgaggacggcggcgccggcgacagcctgagctaccacagcggccagaagttcagcaccttcgacagagaccaggacctgttcgtgcagaactgcgccgccctgagcagcggcgccttctggttcagaagctgccacttcgccaacctgaacggcttctacctgggcggcagccacctgagctacgccaacggcatcaactgggcccagtggaagggcttctactacagcctgaagagaaccgagatgaagatcagaagagcctag

SEQ ID NO: 88898 - DNA, 468 bp, Artificial Sequence
  Description of Artificial Sequence: Synthetic coding sequence
atggtggacctgacccaggtgatggacgacgaggtgttcatggccttcgccagctacgccaccatcatcctgagcaagatgatgctgatgagcaccgccaccgccttctacagactgaccagaaaggtgttcgccaaccccgaggactgcgtggccttcggcaagggcgagaacgccaagaagtacctgagaaccgacgacagagtggagagagtgagaagagcccacctgaacgacctggagaacatcatccccttcctgggcatcggcctgctgtacagcctgagcggccccgaccccagcaccgccatcctgcacttcagactgttcgtgggcgccagaatctaccacaccatcgcctacctgacccccctgccccagcccaacagagccctgagcttcttcgtgggctacggcgtgaccctgagcatggcctacagactgctgaagagcaagctgtacctgtag

SEQ ID NO: 88899 - DNA, 468 bp, Artificial Sequence; identical to SEQ ID NO: 88898
  Description of Artificial Sequence: Synthetic coding sequence

SEQ ID NO: 88900 - DNA, 468 bp, Artificial Sequence; identical to SEQ ID NO: 88898
  Description of Artificial Sequence: Synthetic coding sequence

SEQ ID NO: 88901 - DNA, 468 bp, Artificial Sequence; identical to SEQ ID NO: 88898
  Description of Artificial Sequence: Synthetic coding sequence

SEQ ID NO: 88902 - DNA, 234 bp, Artificial Sequence
  Description of Artificial Sequence: Synthetic coding sequence
atggtggacctgacccaggtgatggacgacgaggtgttcatggccttcgccagctacgccaccatcatcctgagcaagatgatgctgatgagcaccgccaccgccttctacagactgaccagaaaggtgttcgccaaccccgaggactgcgtggccttcggcaagggcgagaacgccaagaagtacctgagaaccgacgacagagtggagagagtgagaagagcccacctgtag

SEQ ID NO: 88903 - DNA, 129 bp, Artificial Sequence
  Description of Artificial Sequence: Synthetic coding sequence
atggtggacctgacccaggtgatggacgacgaggtgttcatggccttcgccagctacgccaccatcatcctgagcaagatgatgctgatgagcaccgccaccgccttctacagactgaccagaaagtag

SEQ ID NO: 88904 - DNA, 243 bp, Artificial Sequence
  Description of Artificial Sequence: Synthetic coding sequence
atggtggacctgacccaggtgatggacgacgaggtgttcatggccttcgccagctacgccaccatcatcctgagcaagatgatgctgatgagcaccgccaccgccttctacagactgaccagaaaggtgttcgccaaccccgaggactgcgtggccttcggcaagggcgagaacgccaagaagtacctgagaaccgacgacagagtggagagagtgagaagagcccacctgaacgacctgtag

SEQ ID NO: 88905 - DNA, 264 bp, Artificial Sequence
  Description of Artificial Sequence: Synthetic coding sequence
atggtggacctgacccaggtgatggacgacgaggtgttcatggccttcgccagctacgccaccatcatcctgagcaagatgatgctgatgagcaccgccaccgccttctacagactgaccagaaaggtgttcgccaaccccgaggactgcgtggccttcggcaagggcgagaacgccaagaagtacctgagaaccgacgacagagtggagagagtgagaagaatcaagcagaccctgagcatctacctggccagcagcatctag

SEQ ID NO: 88906 - DNA, 444 bp, Artificial Sequence
  Description of Artificial Sequence: Synthetic coding sequence
atggccggcaacagcatcctgctggccgccgtgagcatcctgagcgcctgccagcagagctacttcgccctgcaggtgggcaaggccagactgaagtacaaggtgaccccccccgccgtgaccggcagccccgagttcgagagagtgttcagagcccagcagaactgcgtggagttctaccccatcttcatcatcaccctgtggatggccggctggtacttcaaccaggtgttcgccacctgcctgggcctggtgtacatctacggcagacacctgtacttctggggctacagcgaggccgccaagaagagaatcaccggcttcagactgagcctgggcatcctggccctgctgaccctgctgggcgccctgggcatcgccaacagcttcctggacgagtacctggacctgaacatcgccaagaagctgagaagacagttctag

SEQ ID NO: 88907 - DNA, 444 bp, Artificial Sequence; identical to SEQ ID NO: 88906
  Description of Artificial Sequence: Synthetic coding sequence

SEQ ID NO: 88908 - DNA, 234 bp, Artificial Sequence
  Description of Artificial Sequence: Synthetic coding sequence
atggccggcaacagcatcctgctggccgccgtgagcatcctgagcgcctgccagcagagctacttcgccctgcaggtgggcaaggccagactgaagtacaaggtgaccccccccgccgtgaccggcagccccgagttcgagagagtgttcagagcccacttctgctacctgagcggcagcggcgtgcacatctggcccagccccatcctgctgggcatcttcagaagctgctag

SEQ ID NO: 88909 - DNA, 501 bp, Artificial Sequence
  Description of Artificial Sequence: Synthetic coding sequence
atgccctggagaggcagaagattcagactgtgcagaagaaagatggccgtgctgagcaaggagtacggcttcgtgctgctgaccggcgccgccagcttcatcatggtggcccacctggccatcaacgtgagcaaggccagaaagaagtacaaggtggagtaccccatcatgtacagcaccgaccccgagaacggccacatcttcaactgcatccagagagcccaccagaacaccctggaggtgtacccccccttcctgttcttcctggccgtgggcggcgtgtaccaccccagaatcgccagcggcctgggcctggcctggatcgtgggcagagtgctgtacgcctacggctactacaccggcgagcccagcaagagaagcagaggcgccctgggcagcatcgccctgctgggcctggtgggcaccaccgtgtgcagcgccttccagcacctgggctgggtgaagagcggcctgggcagcggccccaagtgctgccactag

SEQ ID NO: 88910 - DNA, 459 bp, Artificial Sequence
  Description of Artificial Sequence: Synthetic coding sequence
atggccgtgctgagcaaggagtacggcttcgtgctgctgaccggcgccgccagcttcatcatggtggcccacctggccatcaacgtgagcaaggccagaaagaagtacaaggtggagtaccccatcatgtacagcaccgaccccgagaacggccacatcttcaactgcatccagagagcccaccagaacaccctggaggtgtacccccccttcctgttcttcctggccgtgggcggcgtgtaccaccccagaatcgccagcggcctgggcctggcctggatcgtgggcagagtgctgtacgcctacggctactacaccggcgagcccagcaagagaagcagaggcgccctgggcagcatcgccctgctgggcctggtgggcaccaccgtgtgcagcgccttccagcacctgggctgggtgaagagcggcctgggcagcggccccaagtgctgccactag

SEQ ID NO: 88911 - DNA, 501 bp, Artificial Sequence; identical to SEQ ID NO: 88909
  Description of Artificial Sequence: Synthetic coding sequence

SEQ ID NO: 88912 - DNA, 501 bp, Artificial Sequence; identical to SEQ ID NO: 88909
  Description of Artificial Sequence: Synthetic coding sequence

SEQ ID NO: 88913 - DNA, 459 bp, Artificial Sequence; identical to SEQ ID NO: 88910
  Description of Artificial Sequence: Synthetic coding sequence

SEQ ID NO: 88914 - DNA, 501 bp, Artificial Sequence; identical to SEQ ID NO: 88909
  Description of Artificial Sequence: Synthetic coding sequence

SEQ ID NO: 88915 - DNA, 972 bp, Artificial Sequence
  Description of Artificial Sequence: Synthetic coding sequence
atgcccagactgaccttcgcccccaagggctggccccacccccccaccagcctgcactggtggctgttccaggagctgcccacccccagcgagaacagcatgccccccggcctgagcacccccaccgccagccaggagggcgccggccccgtgcccgaccccagccagcccaccagaagacagatcagactgagcagccccgagagacagagactgagcagcctgaacctgacccccgaccccgagatggagcccccccccaagccccccagaagctgcagcgccctggccagacacgccctggagagcagcttcgtgggctggggcctgcccgtgcagagcccccaggccctggtggccatggagaaggaggagaaggagagccccttcagcagcgaggaggaggaggaggacgtgcccctggacagcgacgtggagcaggccctgcagaccttcgccaagaccagcggcaccatgaacaactaccccacctggagaagaaccctgctgagaagagccaaggaggaggagatgaagagattctgcaaggcccagaccatccagagaagactgaacgagatcgaggccgccctgagagagctggaggccgagggcgtgaagctggagctggccctgagaagacagagcagcagccccgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgagaggctacatgaacagagaggagaacctgaagaccgccgccgacagacaggccgaggaccaggtgctgagaaagctggtggacctggtgaaccagagagacgccctgatcagattccaggaggagagaagactgagcgagctggccctgggcaccggcgcccagggctag

SEQ ID NO: 88916 - DNA, 2946 bp, Artificial Sequence
  Description of Artificial Sequence: Synthetic coding sequence
atggccagccccaccagcaccaaccccgcccacgcccacttcgagagcttcctgcaggcccagctgtgccaggacgtgctgagcagcttccaggagctgtgcggcgccctgggcctggagcccggcggcggcctgccccagtaccacaagatcaaggaccagctgaactactggagcgccaagagcctgtggaccaagctggacaagagagccggccagcccgtgtaccagcagggcagagcctgcaccagcaccaagtgcctggtggtgggcgccggcccctgcggcctgagagtggccgtggagctggccctgctgggcgccagagtggtgctggtggagaagagaaccaagttcagcagacacaacgtgctgcacctgtggcccttcaccatccacgacctgagagccctgggcgccaagaagttctacggcagattctgcaccggcaccctggaccacatcagcatcagacagctgcagctgctgctgctgaaggtggccctgctgctgggcgtggagatccactggggcgtgaccttcaccggcctgcagcccccccccagaaagggcagcggctggagagcccagctgcagcccaacccccccgcccagctggccaactacgagttcgacgtgctgatcagcgccgccggcggcaagttcgtgcccgagggcttcaaggtgagagagatgagaggcaagctggccatcggcatcaccgccaacttcgtgaacggcagaaccgtggaggagacccaggtgcccgagatcagcggcgtggccagaatctacaaccagagcttcttccagagcctgctgaaggccaccggcatcgacctggagaacatcgtgtactacaaggacgacacccactacttcgtgatgaccgccaagaagcagtgcctgctgagactgggcgtgctgagacagcccttctggcccctgggcaccggcgtggccagaggcttcctggccgccttcgacgccgcctggatggtgaagagatgggccgagggcgccgagagcctggaggtgctggccgagagagagagcctgtaccagctgctgagccagaccagccccgagaacatgcacagaaacgtggcccagtacggcctggaccccgccaccagataccccaacctgaacctgagagccgtgacccccaaccaggtgagagacctgtacgacgtgctggccaaggagcccgtgcagagaaacaacgacaagaccgacaccggcatgcccgccaccggcagcgccggcacccaggaggagctgctgagatggtgccaggagcagaccgccggctaccccggcgtgcacgtgagcgacctgagcagcagctgggccgacggcctggccctgtgcgccctggtgtacagactgcagcccggcctgctggagcccagcgagctgcagggcctgggcgccctggaggccaccgcctgggccctgaaggtggccgagaacgagctgggcatcacccccgtggtgagcgcccaggccgtggtggccggcagcgaccccctgggcctgatcgcctacctgagccacttccacagcgccttcaagagcatggcccacagccccggccccgtgagccaggccagccccggcaccagcagcgccgtgctgttcctgagcaagctgcagagaaccctgcagagaagcagagccaaggagaacgccgaggacgccggcggcaagaagctgagactggagatggaggccgagacccccagcaccgaggtgccccccgaccccgagcccggcgtgcccctgaccccccccagccagcaccaggaggccggcgccggcgacctgtgcgccctgtgcggcgagcacctgtacgtgctggagagactgtgcgtgaacggccacttcttccacagaagctgcttcagatgccacacctgcgaggccaccctgtggcccggcggctacgagcagcaccccggcgacggccacttctactgcctgcagcacctgccccagaccgaccacaaggccgagggcagcgacagaggccccgagagccccgagctgcccacccccagcgagaacagcatgccccccggcctgagcacccccaccgccagccaggagggcgccggccccgtgcccgaccccagccagcccaccagaagacagatcagactgagcagccccgagagacagagactgagcagcctgaacctgacccccgaccccgagatggagcccccccccaagccccccagaagctgcagcgccctggccagacacgccctggagagcagcttcgtgggctggggcctgcccgtgcagagcccccaggccctggtggccatggagaaggaggagaaggagagccccttcagcagcgaggaggaggaggaggacgtgcccctggacagcgacgtggagcaggccctgcagaccttcgccaagaccagcggcaccatgaacaactaccccacctggagaagaaccctgctgagaagagccaaggaggaggagatgaagagattctgcaaggcccagaccatccagagaagactgaacgagatcgaggccgccctgagagagctggaggccgagggcgtgaagctggagctggccctgagaagacagagcagcagccccgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgagaggctacatgaacagagaggagaacctgaagaccgccgccgacagacaggccgaggaccaggtgctgagaaagctggtggacctggtgaaccagagagacgccctgatcagattccaggaggagagaagactgagcgagctggccctgggcaccggcgcccagggctag

SEQ ID NO: 88917 - DNA, 3204 bp, Artificial Sequence
  Description of Artificial Sequence: Synthetic coding sequence
atggccagccccaccagcaccaaccccgcccacgcccacttcgagagcttcctgcaggcccagctgtgccaggacgtgctgagcagcttccaggagctgtgcggcgccctgggcctggagcccggcggcggcctgccccagtaccacaagatcaaggaccagctgaactactggagcgccaagagcctgtggaccaagctggacaagagagccggccagcccgtgtaccagcagggcagagcctgcaccagcaccaagtgcctggtggtgggcgccggcccctgcggcctgagagtggccgtggagctggccctgctgggcgccagagtggtgctggtggagaagagaaccaagttcagcagacacaacgtgctgcacctgtggcccttcaccatccacgacctgagagccctgggcgccaagaagttctacggcagattctgcaccggcaccctggaccacatcagcatcagacagctgcagctgctgctgctgaaggtggccctgctgctgggcgtggagatccactggggcgtgaccttcaccggcctgcagcccccccccagaaagggcagcggctggagagcccagctgcagcccaacccccccgcccagctggccaactacgagttcgacgtgctgatcagcgccgccggcggcaagttcgtgcccgagggcttcaaggtgagagagatgagaggcaagctggccatcggcatcaccgccaacttcgtgaacggcagaaccgtggaggagacccaggtgcccgagatcagcggcgtggccagaatctacaaccagagcttcttccagagcctgctgaaggccaccggcatcgacctggagaacatcgtgtactacaaggacgacacccactacttcgtgatgaccgccaagaagcagtgcctgctgagactgggcgtgctgagacaggactggcccgacaccaacagactgctgggcagcgccaacgtggtgcccgaggccctgcagagattcaccagagccgccgccgacttcgccacccacggcaagctgggcaagctggagttcgcccaggacgcccacggccagcccgacgtgagcgccttcgacttcaccagcatgatgagagccgagagcagcgccagagtgcaggagaagcacggcgccagactgctgctgggcctggtgggcgactgcctggtggagcccttctggcccctgggcaccggcgtggccagaggcttcctggccgccttcgacgccgcctggatggtgaagagatgggccgagggcgccgagagcctggaggtgctggccgagagagagagcctgtaccagctgctgagccagaccagccccgagaacatgcacagaaacgtggcccagtacggcctggaccccgccaccagataccccaacctgaacctgagagccgtgacccccaaccaggtgagagacctgtacgacgtgctggccaaggagcccgtgcagagaaacaacgacaagaccgacaccggcatgcccgccaccggcagcgccggcacccaggaggagctgctgagatggtgccaggagcagaccgccggctaccccggcgtgcacgtgagcgacctgagcagcagctgggccgacggcctggccctgtgcgccctggtgtacagactgcagcccggcctgctggagcccagcgagctgcagggcctgggcgccctggaggccaccgcctgggccctgaaggtggccgagaacgagctgggcatcacccccgtggtgagcgcccaggccgtggtggccggcagcgaccccctgggcctgatcgcctacctgagccacttccacagcgccttcaagagcatggcccacagccccggccccgtgagccaggccagccccggcaccagcagcgccgtgctgttcctgagcaagctgcagagaaccctgcagagaagcagagccaaggagaacgccgaggacgccggcggcaagaagctgagactggagatggaggccgagacccccagcaccgaggtgccccccgaccccgagcccggcgtgcccctgaccccccccagccagcaccaggaggccggcgccggcgacctgtgcgccctgtgcggcgagcacctgtacgtgctggagagactgtgcgtgaacggccacttcttccacagaagctgcttcagatgccacacctgcgaggccaccctgtggcccggcggctacgagcagcaccccggcgacggccacttctactgcctgcagcacctgccccagaccgaccacaaggccgagggcagcgacagaggccccgagagccccgagctgcccacccccagcgagaacagcatgccccccggcctgagcacccccaccgccagccaggagggcgccggccccgtgcccgaccccagccagcccaccagaagacagatcagactgagcagccccgagagacagagactgagcagcctgaacctgacccccgaccccgagatggagcccccccccaagccccccagaagctgcagcgccctggccagacacgccctggagagcagcttcgtgggctggggcctgcccgtgcagagcccccaggccctggtggccatggagaaggaggagaaggagagccccttcagcagcgaggaggaggaggaggacgtgcccctggacagcgacgtggagcaggccctgcagaccttcgccaagaccagcggcaccatgaacaactaccccacctggagaagaaccctgctgagaagagccaaggaggaggagatgaagagattctgcaaggcccagaccatccagagaagactgaacgagatcgaggccgccctgagagagctggaggccgagggcgtgaagctggagctggccctgagaagacagagcagcagccccgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgagaggctacatgaacagagaggagaacctgaagaccgccgccgacagacaggccgaggaccaggtgctgagaaagctggtggacctggtgaaccagagagacgccctgatcagattccaggaggagagaagactgagcgagctggccctgggcaccggcgcccagggctag

SEQ ID NO: 88918 - DNA, 3261 bp, Artificial Sequence
  Description of Artificial Sequence: Synthetic coding sequence
atgagctgcctgagccacagcagcctgcccagctgctgccccccccaggaggccagcatggccagccccaccagcaccaaccccgcccacgcccacttcgagagcttcctgcaggcccagctgtgccaggacgtgctgagcagcttccaggagctgtgcggcgccctgggcctggagcccggcggcggcctgccccagtaccacaagatcaaggaccagctgaactactggagcgccaagagcctgtggaccaagctggacaagagagccggccagcccgtgtaccagcagggcagagcctgcaccagcaccaagtgcctggtggtgggcgccggcccctgcggcctgagagtggccgtggagctggccctgctgggcgccagagtggtgctggtggagaagagaaccaagttcagcagacacaacgtgctgcacctgtggcccttcaccatccacgacctgagagccctgggcgccaagaagttctacggcagattctgcaccggcaccctggaccacatcagcatcagacagctgcagctgctgctgctgaaggtggccctgctgctgggcgtggagatccactggggcgtgaccttcaccggcctgcagcccccccccagaaagggcagcggctggagagcccagctgcagcccaacccccccgcccagctggccaactacgagttcgacgtgctgatcagcgccgccggcggcaagttcgtgcccgagggcttcaaggtgagagagatgagaggcaagctggccatcggcatcaccgccaacttcgtgaacggcagaaccgtggaggagacccaggtgcccgagatcagcggcgtggccagaatctacaaccagagcttcttccagagcctgctgaaggccaccggcatcgacctggagaacatcgtgtactacaaggacgacacccactacttcgtgatgaccgccaagaagcagtgcctgctgagactgggcgtgctgagacaggactggcccgacaccaacagactgctgggcagcgccaacgtggtgcccgaggccctgcagagattcaccagagccgccgccgacttcgccacccacggcaagctgggcaagctggagttcgcccaggacgcccacggccagcccgacgtgagcgccttcgacttcaccagcatgatgagagccgagagcagcgccagagtgcaggagaagcacggcgccagactgctgctgggcctggtgggcgactgcctggtggagcccttctggcccctgggcaccggcgtggccagaggcttcctggccgccttcgacgccgcctggatggtgaagagatgggccgagggcgccgagagcctggaggtgctggccgagagagagagcctgtaccagctgctgagccagaccagccccgagaacatgcacagaaacgtggcccagtacggcctggaccccgccaccagataccccaacctgaacctgagagccgtgacccccaaccaggtgagagacctgtacgacgtgctggccaaggagcccgtgcagagaaacaacgacaagaccgacaccggcatgcccgccaccggcagcgccggcacccaggaggagctgctgagatggtgccaggagcagaccgccggctaccccggcgtgcacgtgagcgacctgagcagcagctgggccgacggcctggccctgtgcgccctggtgtacagactgcagcccggcctgctggagcccagcgagctgcagggcctgggcgccctggaggccaccgcctgggccctgaaggtggccgagaacgagctgggcatcacccccgtggtgagcgcccaggccgtggtggccggcagcgaccccctgggcctgatcgcctacctgagccacttccacagcgccttcaagagcatggcccacagccccggccccgtgagccaggccagccccggcaccagcagcgccgtgctgttcctgagcaagctgcagagaaccctgcagagaagcagagccaaggagaacgccgaggacgccggcggcaagaagctgagactggagatggaggccgagacccccagcaccgaggtgccccccgaccccgagcccggcgtgcccctgaccccccccagccagcaccaggaggccggcgccggcgacctgtgcgccctgtgcggcgagcacctgtacgtgctggagagactgtgcgtgaacggccacttcttccacagaagctgcttcagatgccacacctgcgaggccaccctgtggcccggcggctacgagcagcaccccggcgacggccacttctactgcctgcagcacctgccccagaccgaccacaaggccgagggcagcgacagaggccccgagagccccgagctgcccacccccagcgagaacagcatgccccccggcctgagcacccccaccgccagccaggagggcgccggccccgtgcccgaccccagccagcccaccagaagacagatcagactgagcagccccgagagacagagactgagcagcctgaacctgacccccgaccccgagatggagcccccccccaagccccccagaagctgcagcgccctggccagacacgccctggagagcagcttcgtgggctggggcctgcccgtgcagagcccccaggccctggtggccatggagaaggaggagaaggagagccccttcagcagcgaggaggaggaggaggacgtgcccctggacagcgacgtggagcaggccctgcagaccttcgccaagaccagcggcaccatgaacaactaccccacctggagaagaaccctgctgagaagagccaaggaggaggagatgaagagattctgcaaggcccagaccatccagagaagactgaacgagatcgaggccgccctgagagagctggaggccgagggcgtgaagctggagctggccctgagaagacagagcagcagccccgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgagaggctacatgaacagagaggagaacctgaagaccgccgccgacagacaggccgaggaccaggtgctgagaaagctggtggacctggtgaaccagagagacgccctgatcagattccaggaggagagaagactgagcgagctggccctgggcaccggcgcccagggctag

SEQ ID NO: 88919 - DNA, 1776 bp, Artificial Sequence
  Description of Artificial Sequence: Synthetic coding sequence
cccaagtacgtgctgcccagcgaggcccaggtggtgcccgccaagcagctgcagccccaggacagaagcagcgtgcccgagcacagcctgctggccggcacccaggaggagctgctgagatggtgccaggagcagaccgccggctaccccggcgtgcacgtgagcgacctgagcagcagctgggccgacggcctggccctgtgcgccctggtgtacagactgcagcccggcctgctggagcccagcgagctgcagggcctgggcgccctggaggccaccgcctgggccctgaaggtggccgagaacgagctgggcatcacccccgtggtgagcgcccaggccgtggtggccggcagcgaccccctgggcctgatcgcctacctgagccacttccacagcgccttcaagagcatggcccacagccccggccccgtgagccaggccagccccggcaccagcagcgccgtgctgttcctgagcaagctgcagagaaccctgcagagaagcagagccaaggagaacgccgaggacgccggcggcaagaagctgagactggagatggaggccgagacccccagcaccgaggtgccccccgaccccgagcccggcgtgcccctgaccccccccagccagcaccaggaggccggcgccggcgacctgtgcgccctgtgcggcgagcacctgtacgtgctggagagactgtgcgtgaacggccacttcttccacagaagctgcttcagatgccacacctgcgaggccaccctgtggcccggcggctacgagcagcaccccggcgacggccacttctactgcctgcagcacctgccccagaccgaccacaaggccgagggcagcgacagaggccccgagagccccgagctgcccacccccagcgagaacagcatgccccccggcctgagcacccccaccgccagccaggagggcgccggccccgtgcccgaccccagccagcccaccagaagacagatcagactgagcagccccgagagacagagactgagcagcctgaacctgacccccgaccccgagatggagcccccccccaagccccccagaagctgcagcgccctggccagacacgccctggagagcagcttcgtgggctggggcctgcccgtgcagagcccccaggccctggtggccatggagaaggaggagaaggagagccccttcagcagcgaggaggaggaggaggacgtgcccctggacagcgacgtggagcaggccctgcagaccttcgccaagaccagcggcaccatgaacaactaccccacctggagaagaaccctgctgagaagagccaaggaggaggagatgaagagattctgcaaggcccagaccatccagagaagactgaacgagatcgaggccgccctgagagagctggaggccgagggcgtgaagctggagctggccctgagaagacagagcagcagccccgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgagaggctacatgaacagagaggagaacctgaagaccgccgccgacagacaggccgaggaccaggtgctgagaaagctggtggacctggtgaaccagagagacgccctgatcagattccaggaggagagaagactgagcgagctggccctgggcaccggcgcccagggctag

SEQ ID NO: 88920 - DNA, 735 bp, Artificial Sequence
  Description of Artificial Sequence: Synthetic coding sequence
atggccagccccaccagcaccaaccccgcccacgcccacttcgagagcttcctgcaggcccagctgtgccaggacgtgctgagcagcttccaggagctgtgcggcgccctgggcctggagcccggcggcggcctgccccagtaccacaagatcaaggaccagctgaactactggagcgccaagagcctgtggaccaagctggacaagagagccggccagcccgtgtaccagcagggcagagcctgcaccagcaccaagtgcctggtggtgggcgccggcccctgcggcctgagagtggccgtggagctggccctgctgggcgccagagtggtgctggtggagaagagaaccaagttcagcagacacaacgtgctgcacctgtggcccttcaccatccacgacctgagagccctgggcgccaagaagttctacggcagattctgcaccggcaccctggaccacatcagcatcagacagctgcagctgctgctgctgaaggtggccctgctgctgggcgtggagatccactggggcgtgaccttcaccggcctgcagcccccccccagaaagggcagcggctggagagcccagctgcagcccaacccccccgcccagctggccaactacgagttcgacgtgctgatcagcgccgccggcggcaagttcgtgcccgagggcttcaaggtgagagagatgagaggcaagctggccatcggcatcaccgccaacttctag

SEQ ID NO: 88921 - DNA, 3375 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgccatcgagctggcctacctgggcgccaaggtggtggtggtggagaagagagacagcttcagcagaaacaacgtgctgcacctgtggcccttcaccatccacgacctgagaggcctgggcgccaagaagttctacggcaagttctgcgccggcagcatcgaccacatcagcatcagacagctgcagctgatcctgttcaaggtggccctgatgctgggcgtggagatccacgtgaacgtggagttcgtgaaggtgctggagccccccgaggaccaggagaaccagaagatcggctggagagccgagttcctgcccaccgaccacagcctgagcgagttcgagttcgacgtgatcatcggcgccgacggcagaagaaacaccctggagggcttcagaagaaaggagttcagaggcaagctggccatcgccatcaccgccaacttcatcaacagaaacagcaccgccgaggccaaggtggaggagatcagcggcgtggccttcatcttcaaccagaagttcttccaggacctgaaggaggagaccggcatcgacctggagaacatcgtgtactacaaggactgcacccactacttcgtgatgaccgccaagaagcagagcctgctggacaagggcgtgatcatcaacgactacatcgacaccgagatgctgctgtgcgccgagaacgtgaaccaggacaacctgctgagctacgccagagaggccgccgacttcgccaccaactaccagctgcccagcctggacttcgccatgaaccactacggccagcccgacgtggccatgttcgacttcacctgcatgtacgccagcgagaacgccgccctggtgagagagagacaggcccaccagctgctggtggccctggtgggcgacagcctgctggagcccttctggcccatgggcaccggctgcgccagaggcttcctggccgccttcgacaccgcctggatggtgaagagctggaaccagggcaccccccccctggagctgctggccgagagagagagcctgtacagactgctgccccagaccacccccgagaacatcaacaagaacttcgagcagtacaccctggaccccggcaccagataccccaacctgaacagccactgcgtgagaccccaccaggtgaagcacctgtacatcaccaaggagctggagcactaccccctggagagactgggcagcgtgagaagaagcgtgaacctgagcagaaaggagagcgacatcagacccagcaagctgctgacctggtgccagcagcagaccgagggctaccagcacgtgaacgtgaccgacctgaccaccagctggagaagcggcctggccctgtgcgccatcatccacagattcagacccgagctgatcaacttcgacagcctgaacgaggacgacgccgtggagaacaaccagctggccttcgacgtggccgagagagagttcggcatcccccccgtgaccaccggcaaggagatggccagcgcccaggagcccgacaagctgagcatggtgatgtacctgagcaagttctacgagctgttcagaggcacccccctgagacccgtggacagctggagaaagaactacggcgagaacgccgacctgagcctggccaagagcagcatcagcaacaactacctgaacctgaccttccccagaaagagaacccccagagtggacggccagaccggcgagaacgacatgaacaagagaagaagaaagggcttcaccaacctggacgagcccagcaacttcagcagcagaagcctgggcagcaaccaggagtgcggcagcagcaaggagggcggcaaccagaacaaggtgaagagcatggccaaccagctgctggccaagttcgaggagagcaccagaaaccccagcctgatgaagcaggagagaagagtgagcggcatcggcaagcccgtgctgtgcagcagcagcggcccccccgtgcacagctgctgccccaagcccgaggaggccacccccagccccagcccccccctgaagagacagttccccagcgtggtggtgaccggccacgtgctgagagagctgaagcaggtgagcgccggcagcgagtgcctgagcagaccctggagagccagagccaagagcgacctgcagctgggcggcaccgagaacttcgccaccctgcccagcaccagacccagagcccaggccctgagcggcgtgctgtggagactgcagcaggtggaggagaagatcctgcagaagagagcccagaacctggccaacagagagttccacaccaagaacatcaaggagaaggccgcccacctggccagcatgttcggccacggcgacttcccccagaacaagctgctgagcaagggcctgagccacacccacccccccagcccccccagcagactgcccagccccgaccccgccgccagcagcagccccagcaccgtggacagcgccagccccgccagaaaggagaagaagagccccagcggcttccacttccaccccagccacctgagaaccgtgcacccccagctgaccgtgggcaaggtgagcagcggcatcggcgccgccgccgaggtgctggtgaacctgtacatgaacgaccacagacccaaggcccaggccaccagccccgacctggagagcatgagaaagagcttccccctgaacctgggcggcagcgacacctgctacttctgcaagaagagagtgtacgtgatggagagactgagcgccgagggccacttcttccacagagagtgcttcagatgcagcatctgcgccaccaccctgagactggccgcctacaccttcgactgcgacgagggcaagttctactgcaagccccacttcatccactgcaagaccaacagcaagcagagaaagagaagagccgagctgaagcagcagagagaggaggaggccacctggcaggagcaggaggcccccagaagagacacccccaccgagagcagctgcgccgtggccgccatcggcaccctggagggcagcccccccgtgcacttcagcctgcccgtgctgcaccccctgctgggctag

SEQ ID NO: 88922 - DNA, 3312 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgccatcgagctggcctacctgggcgccaaggtggtggtggtggagaagagagacagcttcagcagaaacaacgtgctgcacctgtggcccttcaccatccacgacctgagaggcctgggcgccaagaagttctacggcaagttctgcgccggcagcatcgaccacatcagcatcagacagctgcagctgatcctgttcaaggtggccctgatgctgggcgtggagatccacgtgaacgtggagttcgtgaaggtgctggagccccccgaggaccaggagaaccagaagatcggctggagagccgagttcctgcccaccgaccacagcctgagcgagttcgagttcgacgtgatcatcggcgccgacggcagaagaaacaccctggagggcttcagaagaaaggagttcagaggcaagctggccatcgccatcaccgccaacttcatcaacagaaacagcaccgccgaggccaaggtggaggagatcagcggcgtggccttcatcttcaaccagaagttcttccaggacctgaaggaggagaccggcatcgacctggagaacatcgtgtactacaaggactgcacccactacttcgtgatgaccgccaagaagcagagcctgctggacaagggcgtgatcatcaacgactacatcgacaccgagatgctgctgtgcgccgagaacgtgaaccaggacaacctgctgagctacgccagagaggccgccgacttcgccaccaactaccagctgcccagcctggacttcgccatgaaccactacggccagcccgacgtggccatgttcgacttcacctgcatgtacgccagcgagaacgccgccctggtgagagagagacaggcccaccagctgctggtggccctggtgggcgacagcctgctggagcccttctggcccatgggcaccggctgcgccagaggcttcctggccgccttcgacaccgcctggatggtgaagagctggaaccagggcaccccccccctggagctgctggccgagagagagagcctgtacagactgctgccccagaccacccccgagaacatcaacaagaacttcgagcagtacaccctggaccccggcaccagataccccaacctgaacagccactgcgtgagaccccaccaggtgaagcacctgtacatcaccaaggagctggagcactaccccctggagagactgggcagcgtgagaagaagcgtgaacctgagcagaaaggagagcgacatcagacccagcaagctgctgacctggtgccagcagcagaccgagggctaccagcacgtgaacgtgaccgacctgaccaccagctggagaagcggcctggccctgtgcgccatcatccacagattcagacccgagctgatcaacttcgacagcctgaacgaggacgacgccgtggagaacaaccagctggccttcgacgtggccgagagagagttcggcatcccccccgtgaccaccggcaaggagatggccagcgcccaggagcccgacaagctgagcatggtgatgtacctgagcaagttctacgagctgttcagaggcacccccctgagacccgtggacagctggagaaagaactacggcgagaacgccgacctgagcctggccaagagcagcatcagcaacaactacctgaacctgaccttccccagaaagagaacccccagagtggacggccagaccggcgagaacgacatgaacaagagaagaagaaagggcttcaccaacctggacgagcccagcaacttcagcagcagaagcctgggcagcaaccaggagtgcggcagcagcaaggagggcggcaaccagaacaaggtgaagagcatggccaaccagctgctggccaagttcgaggagagcaccagaaaccccagcctgatgaagcaggagagaagagtgagcggcatcggcaagcccgtgctgtgcagcagcagcggcccccccgtgcacagctgctgccccaagcccgaggaggccacccccagccccagcccccccctgaagagacagttccccagcgtggtggtgaccggccacgtgctgagagagctgaagcaggtgagcgccggcagcgagtgcctgagcagaccctggagagccagagccaagagcgacctgcagctgggcggcaccgagaacttcgccaccctgcccagcaccagacccagagcccaggccctgagcggcgtgctgtggagactgcagcaggtggaggagaagatcctgcagaagagagcccagaacctggccaacagagagttccacaccaagaacatcaaggagaaggccgcccacctggccagcatgttcggccacggcgacttcccccagaacaagctgctgagcaagggcctgagccacacccacccccccagcccccccagcagactgcccagccccgaccccgccgccagcagcagccccagcaccgtggacagcgccagccccgccagaaagctgaccgtgggcaaggtgagcagcggcatcggcgccgccgccgaggtgctggtgaacctgtacatgaacgaccacagacccaaggcccaggccaccagccccgacctggagagcatgagaaagagcttccccctgaacctgggcggcagcgacacctgctacttctgcaagaagagagtgtacgtgatggagagactgagcgccgagggccacttcttccacagagagtgcttcagatgcagcatctgcgccaccaccctgagactggccgcctacaccttcgactgcgacgagggcaagttctactgcaagccccacttcatccactgcaagaccaacagcaagcagagaaagagaagagccgagctgaagcagcagagagaggaggaggccacctggcaggagcaggaggcccccagaagagacacccccaccgagagcagctgcgccgtggccgccatcggcaccctggagggcagcccccccgtgcacttcagcctgcccgtgctgcaccccctgctgggctag

SEQ ID NO: 88923 - DNA, 2931 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgccatcgagctggcctacctgggcgccaaggtggtggtggtggagaagagagacagcttcagcagaaacaacgtgctgcacctgtggcccttcaccatccacgacctgagaggcctgggcgccaagaagttctacggcaagttctgcgccggcagcatcgaccacatcagcatcagacagctgcagctgatcctgttcaaggtggccctgatgctgggcgtggagatccacgtgaacgtggagttcgtgaaggtgctggagccccccgaggaccaggagaaccagaagatcggctggagagccgagttcctgcccaccgaccacagcctgagcgagttcgagttcgacgtgatcatcggcgccgacggcagaagaaacaccctggagggcttcagaagaaaggagttcagaggcaagctggccatcgccatcaccgccaacttcatcaacagaaacagcaccgccgaggccaaggtggaggagatcagcggcgtggccttcatcttcaaccagaagttcttccaggacctgaaggaggagaccggcatcgacctggagaacatcgtgtactacaaggactgcacccactacttcgtgatgaccgccaagaagcagagcctgctggacaagggcgtgatcatcaacgactacatcgacaccgagatgctgctgtgcgccgagaacgtgaaccaggacaacctgctgagctacgccagagaggccgccgacttcgccaccaactaccagctgcccagcctggacttcgccatgaaccactacggccagcccgacgtggccatgttcgacttcacctgcatgtacgccagcgagaacgccgccctggtgagagagagacaggcccaccagctgctggtggccctggtgggcgacagcctgctggagcccttctggcccatgggcaccggctgcgccagaggcttcctggccgccttcgacaccgcctggatggtgaagagctggaaccagggcaccccccccctggagctgctggccgagagagagagcctgtacagactgctgccccagaccacccccgagaacatcaacaagaacttcgagcagtacaccctggaccccggcaccagataccccaacctgaacagccactgcgtgagaccccaccaggtgaagcacctgtacatcaccaaggagctggagcactaccccctggagagactgggcagcgtgagaagaagcgtgaacctgagcagaaaggagagcgacatcagacccagcaagctgctgacctggtgccagcagcagaccgagggctaccagcacgtgaacgtgaccgacctgaccaccagctggagaagcggcctggccctgtgcgccatcatccacagattcagacccgagctgatcaacttcgacagcctgaacgaggacgacgccgtggagaacaaccagctggccttcgacgtggccgagagagagttcggcatcccccccgtgaccaccggcaaggagatggccagcgcccaggagcccgacaagctgagcatggtgatgtacctgagcaagttctacgagctgttcagaggcacccccctgagacccgtggacagctggagaaagaactacggcgagaacgccgacctgagcctggccaagagcagcatcagcaacaactacctgaacctgaccttccccagaaagagaacccccagagtggacggccagaccggcgagaacgacatgaacaagagaagaagaaagggcttcaccaacctggacgagcccagcaacttcagcagcagaagcctgggcagcaaccaggagtgcggcagcagcaaggagggcggcaaccagaacaaggtgaagagcatggccaaccagctgctggccaagttcgaggagagcaccagaaaccccagcctgatgaagcaggagaagaagagccccagcggcttccacttccaccccagccacctgagaaccgtgcacccccaggagagcatgagaaagagcttccccctgaacctgggcggcagcgacacctgctacttctgcaagaagagagtgtacgtgatggagagactgagcgccgagggccacttcttccacagagagtgcttcagatgcagcatctgcgccaccaccctgagactggccgcctacaccttcgactgcgacgagggcaagttctactgcaagccccacttcatccactgcaagaccaacagcaagcagagaaagagaagagccgagctgaagcagcagagagaggaggaggccacctggcaggagcaggaggcccccagaagagacacccccaccgagagcagctgcgccgtggccgccatcggcaccctggagggcagcccccccggcatcagcaccagcttcttcagaaaggtgctgggctggcccctgagactgcccagagacctgtgcaactggatgcagggcctgctgcaggccgccggcctgcacatcagagacaacgcctacaactactgctacatgtacgagctgctgagcctgggcctgcccctgctgtgggccttcagcgaggtgctggccgccatgtacagagagagcgagggcagcctggagagcatctgcaactgggtgctgagatgcttccccgtgaagctgagatag

SEQ ID NO: 88924 - DNA, 363 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgccatcgagctggcctacctgggcgccaaggtggtggtggtggagaagagagacagctag

SEQ ID NO: 88925 - DNA, 405 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgccatcgagctggcctacctgggcgccaaggtggtggtggtggagaagagagacagcttcagcagaaacaacgtgctgcacctgtggcccttcaccatctag

SEQ ID NO: 88926 - DNA, 267 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtag

SEQ ID NO: 88927 - DNA, 12 bp, Artificial Sequence
  Description of Artificial Sequence: Synthetic coding sequence
atgggcgagtag

SEQ ID NO: 88928 - DNA, 297 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggctag

SEQ ID NO: 88929 - DNA, 267 bp, Artificial Sequence; identical to SEQ ID NO: 88926
  Description of Artificial Sequence: Synthetic coding sequence

SEQ ID NO: 88930 - DNA, 309 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgcctag

SEQ ID NO: 88931 - DNA, 2805 bp, Artificial Sequence
  Description of Artificial Sequence: Synthetic coding sequence
atgggcgagaacgaggacgagaagcaggcccaggccggccaggtgttcgagaacttcgtgcaggccagcacctgcaagggcaccctgcaggccttcaacatcctgaccagacacctggacctggaccccctggaccacagaaacttctacagcaagctgaagagcaaggtgaccacctggaaggccaaggccctgtggtacaagctggacaagagaggcagccacaaggagtacaagagaggcaagagctgcaccaacaccaagtgcctgatcgtgggcggcggcccctgcggcctgagaaccgccatcgagctggcctacctgggcgccaaggtggtggtggtggagaagagagacagcttcagcagaaacaacgtgctgcacctgtggcccttcaccatccacgacctgagaggcctgggcgccaagaagttctacggcaagttctgcgccggcagcatcgaccacatcagcatcagacagctgcagctgatcctgttcaaggtggccctgatgctgggcgtggagatccacgtgaacgtggagttcgtgaaggtgctggagccccccgaggaccaggagaaccagaagatcggctggagagccgagttcctgcccaccgaccacagcctgagcgagttcgagttcgacgtgatcatcggcgccgacggcagaagaaacaccctggagggcttcagaagaaaggagttcagaggcaagctggccatcgccatcaccgccaacttcatcaacagaaacagcaccgccgaggccaaggtggaggagatcagcggcgtggccttcatcttcaaccagaagttcttccaggacctgaaggaggagaccggcatcgacctggagaacatcgtgtactacaaggactgcacccactacttcgtgatgaccgccaagaagcagagcctgctggacaagggcgtgatcatcaacgactacatcgacaccgagatgctgctgtgcgccgagaacgtgaaccaggacaacctgctgagctacgccagagaggccgccgacttcgccaccaactaccagctgcccagcctggacttcgccatgaaccactacggccagcccgacgtggccatgttcgacttcacctgcatgtacgccagcgagaacgccgccctggtgagagagagacaggcccaccagctgctggtggccctggtgggcgacagcctgctggagcccttctggcccatgggcaccggctgcgccagaggcttcctggccgccttcgacaccgcctggatggtgaagagctggaaccagggcaccccccccctggagctgctggccgagagagagagcctgtacagactgctgccccagaccacccccgagaacatcaacaagaacttcgagcagtacaccctggaccccggcaccagataccccaacctgaacagccactgcgtgagaccccaccaggtgaagcacctgtacatcaccaaggagctggagcactaccccctggagagactgggcagcgtgagaagaagcgtgaacctgagcagaaaggagagcgacatcagacccagcaagctgctgacctggtgccagcagcagaccgagggctaccagcacgtgaacgtgaccgacctgaccaccagctggagaagcggcctggccctgtgcgccatcatccacagattcagacccgagctgatcaacttcgacagcctgaacgaggacgacgccgtggagaacaaccagctggccttcgacgtggccgagagagagttcggcatcccccccgtgaccaccggcaaggagatggccagcgcccaggagcccgacaagctgagcatggtgatgtacctgagcaagttctacgagctgttcagaggcacccccctgagacccgtggacagctggagaaagaactacggcgagaacgccgacctgagcctggccaagagcagcatcagcaacaactacctgaacctgaccttccccagaaagagaacccccagagtggacggccagaccggcgagaacgacatgaacaagagaagaagaaagggcttcaccaacctggacgagcccagcaacttcagcagcagaagcctgggcagcaaccaggagtgcggcagcagcaaggagggcggcaaccagaacaaggtgaagagcatggccaaccagctgctggccaagttcgaggagagcaccagaaaccccagcctgatgaagcaggagaagaagagccccagcggcttccacttccaccccagccacctgagaaccgtgcacccccagctgaccgtgggcaaggtgagcagcggcatcggcgccgccgccgaggtgctggtgaacctgtacatgaacgaccacagacccaaggcccaggccaccagccccgacctggagagcatgagaaagagcttccccctgaacctgggcggcagcgacacctgctacttctgcaagaagagagtgtacgtgatggagagactgagcgccgagggccacttcttccacagagagtgcttcagatgcagcatctgcgccaccaccctgagactggccgcctacaccttcgactgcgacgagggcaagttctactgcaagccccacttcatccactgcaagaccaacagcaagcagagaaagagaagagccgagctgaagcagcagagagaggaggaggccacctggcaggagcaggaggcccccagaagagacacccccaccgagagcagctgcgccgtggccgccatcggcaccctggagggcagcccccccgtgcacttcagcctgcccgtgctgcaccccctgctgggctag

SEQ ID NO: 88932 - DNA, 1638 bp, Artificial Sequence
  Description of Artificial Sequence: Synthetic coding sequence
atgagaagcagccccgacctgaacagccactgcgtgagaccccaccaggtgaagcacctgtacatcaccaaggagctggagcactaccccctggagagactgggcagcgtgagaagaagcgtgaacctgagcagaaaggagagcgacatcagacccagcaagctgctgacctggtgccagcagcagaccgagggctaccagcacgtgaacgtgaccgacctgaccaccagctggagaagcggcctggccctgtgcgccatcatccacagattcagacccgagctgatcaacttcgacagcctgaacgaggacgacgccgtggagaacaaccagctggccttcgacgtggccgagagagagttcggcatcccccccgtgaccaccggcaaggagatggccagcgcccaggagcccgacaagctgagcatggtgatgtacctgagcaagttctacgagctgttcagaggcacccccctgagacccgtggacagctggagaaagaactacggcgagaacgccgacctgagcctggccaagagcagcatcagcaacaactacctgaacctgaccttccccagaaagagaacccccagagtggacggccagaccggcgagaacgacatgaacaagagaagaagaaagggcttcaccaacctggacgagcccagcaacttcagcagcagaagcctgggcagcaaccaggagtgcggcagcagcaaggagggcggcaaccagaacaaggtgaagagcatggccaaccagctgctggccaagttcgaggagagcaccagaaaccccagcctgatgaagcaggagaagaagagccccagcggcttccacttccaccccagccacctgagaaccgtgcacccccagctgaccgtgggcaaggtgagcagcggcatcggcgccgccgccgaggtgctggtgaacctgtacatgaacgaccacagacccaaggcccaggccaccagccccgacctggagagcatgagaaagagcttccccctgaacctgggcggcagcgacacctgctacttctgcaagaagagagtgtacgtgatggagagactgagcgccgagggccacttcttccacagagagtgcttcagatgcagcatctgcgccaccaccctgagactggccgcctacaccttcgactgcgacgagggcaagttctactgcaagccccacttcatccactgcaagaccaacagcaagcagagaaagagaagagccgagctgaagcagcagagagaggaggaggccacctggcaggagcaggaggcccccagaagagacacccccaccgagagcagctgcgccgtggccgccatcggcaccctggagggcagcccccccggcatcagcaccagcttcttcagaaaggtgctgggctggcccctgagactgcccagagacctgtgcaactggatgcagggcctgctgcaggccgccggcctgcacatcagagacaacgcctacaactactgctacatgtacgagctgctgagcctgggcctgcccctgctgtgggccttcagcgaggtgctggccgccatgtacagagagagcgagggcagcctggagagcatctgcaactgggtgctgagatgcttccccgtgaagctgagatag

SEQ ID NO: 88933 - DNA, 3273 bp, Artificial Sequence
  Description of Artificial Sequence: Synthetic coding sequence
atggccaccctgctgagccacccccagcagagaccccccttcctgagacaggccatcaagatcagaagaagaagagtgagagacctgcaggacccccccccccagatggcccccgagatccagccccccagccaccacttcagccccgagcagagagccctgctgtacgaggacgccctgtacaccgtgctgcacagactgggccaccccgagcccaaccacgtgaccgaggccagcgagctgctgagatacctgcaggaggccttccacgtggagcccgaggagcaccagcagaccctgcagagagtgagagagctggagaagcccatcttctgcctgaaggccaccgtgaagcaggccaagggcatcctgggcaaggacgtgagcggcttcagcgacccctactgcctgctgggcatcgagcagggcgtgggcgtgcccggcggcagccccggcagcagacacagacagaaggccgtggtgagacacaccatccccgaggaggagacccacagaacccaggtgatcacccagaccctgaaccccgtgtgggacgagaccttcatcctggagttcgaggacatcaccaacgccagcttccacctggacatgtgggacctggacaccgtggagagcgtgagacagaagctgggcgagctgaccgacctgcacggcctgagaagaatcttcaaggaggccagaaaggacaagggccaggacgacttcctgggcaacgtggtgctgagactgcaggacctgagatgcagagaggaccagtggtaccccctggagcccagaaccgagacctaccccgacagaggccagtgccacctgcagttccagctgatccacaagagaagagccaccagcgccagcagaagccagcccagctacaccgtgcacctgcacctgctgcagcagctggtgagccacgaggtgacccagcacgaggccggcagcaccagctgggacggcagcctgagcccccaggccgccaccgtgctgttcctgcacgccacccagaaggacctgagcgacttccaccagagcatggcccagtggctggcctacagcagactgtaccagagcctggagttccccagcagctgcctgctgcaccccatcaccagcatcgagtaccagtggatccagggcagactgaaggccgagcagcaggaggagctggccgccagcttcagcagcctgctgacctacggcctgagcctgatcagaagattcagaagcgtgttccccctgagcgtgagcgacagccccgccagactgcagagcctgctgagagtgctggtgcagatgtgcaagatgaaggccttcggcgagctgtgccccaacaccgcccccctgccccagctggtgaccgaggccctgcagaccggcaccaccgagtggttccacctgaagcagcagcaccaccagcccatggtgcagggcatccccgaggccggcaaggccctgctgggcctggtgcaggacgtgatcggcgacctgcaccagtgccagagaacctgggacaagatcttccacaacaccctgaagatccacctgttcagcatggccttcagagagctgcagtggctggtggccaagagagtgcaggaccacaccaccgtggtgggcgacgtggtgagccccgagatgggcgagagcctgttccagctgtacatcagcctgaaggagctgtgccagctgagaatgagcagcagcgagagagacggcgtgctggccctggacaacttccacagatggttccagcccgccatccccagctggctgcagaagacctacaacgaggccctggccagagtgcagagagccgtgcagatggacgagctggtgcccctgggcgagctgaccaagcacagcaccagcgccgtggacctgagcacctgcttcgcccagatcagccacaccgccagacagctggactggcccgaccccgaggaggccttcatgatcaccgtgaagttcgtggaggacacctgcagactggccctggtgtactgcagcctgatcaaggccagagccagagagctgagcagcggccagaaggaccagggccaggccgccaacatgctgtgcgtggtggtgaacgacatggagcagctgagactggtgatcggcaagctgcccgcccagctggcctgggaggccctggagcagagagtgggcgccgtgctggagcagggccagctgcagaacaccctgcacgcccagctgcagagcgccctggccggcctgggccacgagatcagaaccggcgtgagaaccctggccgagcagctggaggtgggcatcgccaagcacatccagaagctggtgggcgtgagagagagcgtgctgcccgaggacgccatcctgcccctgatgaagttcctggaggtggagctgtgctacatgaacaccaacctggtgcaggagaacttcagcagcctgctgaccctgctgtggacccacaccctgaccgtgctggtggaggccgccgccagccagagaagcagcagcctggccagcaacagactgaagatcgccctgcagaacctggagatctgcttccacgccgagggctgcggcctgccccccaaggccctgcacaccgccaccttccaggccctgcagagagacctggagctgcaggccgccagcagcagagagctgatcagaaagtacttctgcagcagaatccagcagcaggccgagaccaccagcgaggagctgggcgccgtgaccgtgaaggccagctacagagccagcgagcagaagctgagagtggagctgctgagcgccagcagcctgctgcccctggacagcaacggcagcagcgaccccttcgtgcagctgaccctggagcccagacacgagttccccgagctggccgccagagagacccagaagcacaagaaggacctgcaccccctgttcgacgagaccttcgagttcctggtgcccgccgagccctgcagaaaggccggcgcctgcctgctgctgaccgtgctggactacgacaccctgggcgccgacgacctggagggcgaggccttcctgcccctgagagaggtgcccggcctgagcggcagcgaggagcccggcgaggtgccccagaccagactgcccctgacctaccccgcccccaacggcgaccccatcctgcagctgctggagggcagaaagggcgacagagaggcccaggtgttcgtgagactgagaagacacagagccaagcaggccagccagcacgccctgagacccgccccctag

SEQ ID NO: 88934 - DNA, 2847 bp, Artificial Sequence
  Description of Artificial Sequence: Synthetic coding sequence
atggaggagagaaagcacgagaccatgaaccccgcccacgtgctgttcgacagattcgtgcaggccaccacctgcaagggcaccctgaaggccttccaggagctgtgcgaccacctggagctgaagcccaaggactacagaagcttctaccacaagctgaagagcaagctgaactactggaaggccaaggccctgtgggccaagctggacaagagaggcagccacaaggactacaagaagggcaaggcctgcaccaacaccaagtgcctgatcatcggcgccggcccctgcggcctgagaaccgccatcgacctgagcctgctgggcgccaaggtggtggtgatcgagaagagagacgccttcagcagaaacaacgtgctgcacctgtggcccttcaccatccacgacctgagaggcctgggcgccaagaagttctacggcaagttctgcgccggcgccatcgaccacatcagcatcagacagctgcagctgatcctgctgaaggtggccctgatcctgggcatcgagatccacgtgaacgtggagttccagggcctgatccagccccccgaggaccaggagaacgagagaatcggctggagagccctggtgcaccccaagacccaccccgtgagcgagtacgagttcgaggtgatcatcggcggcgacggcagaagaaacaccctggagggcttcagaagaaaggagttcagaggcaagctggccatcgccatcaccgccaacttcatcaacagaaacaccaccgccgaggccaaggtggaggagatcagcggcgtggccttcatcttcaaccagaagttcttccaggagctgagagaggccaccggcatcgacctggagaacatcgtgtactacaaggacgacacccactacttcgtgatgaccgccaagaagcagagcctgctggacaagggcgtgatcctgcacgactacgccgacaccgagctgctgctgagcagagagaacgtggaccaggaggccctgctgagctacgccagagaggccgccgacttcagcacccagcagcagctgcccagcctggacttcgccatcaaccactacggccagcccgacgtggccatgttcgacttcacctgcatgtacgccagcgagaacgccgccctggtgagagagcagaacggccaccagctgctggtggccctggtgggcgacagcctgctggagcccttctggcccatgggcaccggcatcgccagaggcttcctggccgccatggacagcgcctggatggtgagaagctggagcctgggcaccagccccctggaggtgctggccgagagagagagcatctacagactgctgccccagaccacccccgagaacgtgagcaagaacttcagccagtacagcatcgaccccgtgaccagataccccaacatcaacgtgaacttcctgagacccagccaggtgagacacctgtacgacaccggcgagaccaaggacatccacctggagatggagagcctggtgaacagcagaaccacccccaagctgaccagaaacgagagcgtggccagaagcagcaagctgctgggctggtgccagagacagaccgacggctacgccggcgtgaacgtgaccgacctgaccatgagctggaagagcggcctggccctgtgcgccatcatccacagatacagacccgacctgatcgacttcgacagcctggacgagcagaacgtggagaagaacaaccagctggccttcgacatcgccgagaaggagctgggcatcagccccatcatgaccggcaaggagatggccagcgtgggcgagcccgacaagctgagcatggtgatgtacctgacccagttctacgagatgttcaaggacagcctgcccagcagcgacaccctggacctgaacgccgaggagaaggccgtgctgatcgccagcaccagaagccccatcagcttcctgagcaagctgggccagaccatcagcagaaagagaagccccaaggacaagaaggagaaggacctggacggcgccggcaagagaagaaagaccagccagagcgaggaggaggaggcccccagaggccacagaggcgagagacccaccctggtgagcaccctgaccgacagaagaatggacgtggccgtgggcaaccagaacaaggtgaagtacatggccacccagctgctggccaagttcgaggagaacgcccccgcccagagcatcggcatcagaagacagggcagcatgaagaaggagttcccccagaacctgggcggcagcgacacctgctacttctgccagaagagagtgtacgtgatggagagactgagcgccgagggcaagttcttccacagaagctgcttcaagtgcgagtactgcgccaccaccctgagactgagcgcctacgcctacgacatcgaggacggcaagttctactgcaagccccactactgctacagactgagcggctacgcccagagaaagagacccgccgtggcccccctgagcggcaaggaggccaagggccccctgcaggacggcgccaccaccgacgccaacggcagagccaacgccgtggccagcagcaccgagagaacccccggcagcggcgtgaacggcctggaggagcccagcatcgccaagagactgagaggcacccccgagagaatcgagctggagaactacagactgagcctgagacaggccgaggccctgcaggaggtgcccgaggagacccaggccgagcacaacctgagcagcgtgctggacaccggcgccgaggaggacgtggccagcagaagcgccagaagagccgccggcagaccccccgccaccagaccctag

SEQ ID NO: 88935 - DNA, 2901 bp, Artificial Sequence
  Description of Artificial Sequence: Synthetic coding sequence
atggaggagagaaagcacgagaccatgaaccccgcccacgtgctgttcgacagattcgtgcaggccaccacctgcaagggcaccctgaaggccttccaggagctgtgcgaccacctggagctgaagcccaaggactacagaagcttctaccacaagctgaagagcaagctgaactactggaaggccaaggccctgtgggccaagctggacaagagaggcagccacaaggactacaagaagggcaaggcctgcaccaacaccaagtgcctgatcatcggcgccggcccctgcggcctgagaaccgccatcgacctgagcctgctgggcgccaaggtggtggtgatcgagaagagagacgccttcagcagaaacaacgtgctgcacctgtggcccttcaccatccacgacctgagaggcctgggcgccaagaagttctacggcaagttctgcgccggcgccatcgaccacatcagcatcagacagctgcagctgatcctgctgaaggtggccctgatcctgggcatcgagatccacgtgaacgtggagttccagggcctgatccagccccccgaggaccaggagaacgagagaatcggctggagagccctggtgcaccccaagacccaccccgtgagcgagtacgagttcgaggtgatcatcggcggcgacggcagaagaaacaccctggagggcttcagaagaaaggagttcagaggcaagctggccatcgccatcaccgccaacttcatcaacagaaacaccaccgccgaggccaaggtggaggagatcagcggcgtggccttcatcttcaaccagaagttcttccaggagctgagagaggccaccggcatcgacctggagaacatcgtgtactacaaggacgacacccactacttcgtgatgaccgccaagaagcagagcctgctggacaagggcgtgatcctgcacgactacgccgacaccgagctgctgctgagcagagagaacgtggaccaggaggccctgctgagctacgccagagaggccgccgacttcagcacccagcagcagctgcccagcctggacttcgccatcaaccactacggccagcccgacgtggccatgttcgacttcacctgcatgtacgccagcgagaacgccgccctggtgagagagcagaacggccaccagctgctggtggccctggtgggcgacagcctgctggagcccttctggcccatgggcaccggcatcgccagaggcttcctggccgccatggacagcgcctggatggtgagaagctggagcctgggcaccagccccctggaggtgctggccgagagagagagcatctacagactgctgccccagaccacccccgagaacgtgagcaagaacttcagccagtacagcatcgaccccgtgaccagataccccaacatcaacgtgaacttcctgagacccagccaggtgagacacctgtacgacaccggcgagaccaaggacatccacctggagatggagagcctggtgaacagcagaaccacccccaagctgaccagaaacgagagcgtggccagaagcagcaagctgctgggctggtgccagagacagaccgacggctacgccggcgtgaacgtgaccgacctgaccatgagctggaagagcggcctggccctgtgcgccatcatccacagatacagacccgacctgatcgacttcgacagcctggacgagcagaacgtggagaagaacaaccagctggccttcgacatcgccgagaaggagctgggcatcagccccatcatgaccggcaaggagatggccagcgtgggcgagcccgacaagctgagcatggtgatgtacctgacccagttctacgagatgttcaaggacagcctgcccagcagcgacaccctggacctgaacgccgaggagaaggccgtgctgatcgccagcaccagaagccccatcagcttcctgagcaagctgggccagaccatcagcagaaagagaagccccaaggacaagaaggagaaggacctggacggcgccggcaagagaagaaagaccagccagagcgaggaggaggaggcccccagaggccacagaggcgagagacccaccctggtgagcaccctgaccgacagaagaatggacgtggccgtgggcaaccagaacaaggtgaagtacatggccacccagctgctggccaagttcgaggagaacgcccccgcccagagcatcggcatcagaagacagggcagcatgaagaaggagttcccccagaacctgggcggcagcgacacctgctacttctgccagaagagagtgtacgtgatggagagactgagcgccgagggcaagttcttccacagaagctgcttcaagtgcgagtactgcgccaccaccctgagactgagcgcctacgcctacgacatcgaggacggcaagttctactgcaagccccactactgctacagactgagcggctacgcccagagaaagagacccgccgtggcccccctgagcggcaaggaggccaagggccccctgcaggacggcgccaccaccgacgccaacggcagagccaacgccgtggccagcagcaccgagagaacccccggcagcggcgtgaacggcctggaggagcccagcatcgccaagagactgagaggcacccccgagagaatcgagctggagaactacagactgagcctgagacaggccgaggccctgcaggaggtgcccgaggagacccaggccgagcacaacctgagcagcgtgctggacaccggcgccgaggaggacgtggccagcagagactgggtgagcccctggctgcccagaatggtgagcaacagctgggcccagatgatccaccccccccagccccccaccgtgctgggcagccagatgtag

SEQ ID NO: 88936 - DNA, 4713 bp, Artificial Sequence
  Description of Artificial Sequence: Synthetic coding sequence
atgagcgacagcctgtggaccgccctgagcaacttcagcatgcccagcttccccggcggcagcatgttcagaagaaccaagagctgcagaaccagcaacagaaagagcctgatcctgaccagcaccagccccaccctgcccagaccccacagccccctgcccggccacctgggcagcagccccctggacagccccagaaacttcagccccaacacccccgcccacttcagcttcgccagcagcagaagagccgacggcagaagatggagcctggccagcctgcccagcagcggctacggcaccaacacccccagcagcaccgtgagcagcagctgcagcagccaggagagactgcaccagctgccctaccagcccaccgtggacgagctgcacttcctgagcaagcacttcggcagcaccgagagcatcaccgacgaggacggcggcagaagaagccccgccgtgagacccagaagcagaagcctgagccccggcagaagccccagcagctacgacaacgagatcgtgatgatgaaccacgtgtacaaggagagattccccaaggccaccgcccagatggaggagaagctgagagacttcaccagagcctacgagcccgacagcgtgctgcccctggccgacggcgtgctgagcttcatccaccaccagatcatcgagctggccagagactgcctgaccaagagcagagacggcctgatcaccaccgtgtacttctacgagctgcaggagaacctggagaagctgctgcaggacgcctacgagagaagcgagagcctggaggtggccttcgtgacccagctggtgaagaagctgctgatcatcatcagcagacccgccagactgctggagtgcctggagttcaaccccgaggagttctaccacctgctggaggccgccgagggccacgccaaggagggccacctggtgaagaccgacatccccagatacatcatcagacagctgggcctgaccagagaccccttccccgacgtggtgcacctggaggagcaggacagcggcggcagcaacacccccgagcaggacgacctgagcgagggcagaagcagcaaggccaagaagccccccggcgagaacgacttcgacaccatcaagctgatcagcaacggcgcctacggcgccgtgtacctggtgagacacagagacaccagacagagattcgccatgaagaagatcaacaagcagaacctgatcctgagaaaccagatccagcaggccttcgtggagagagacatcctgaccttcgccgagaaccccttcgtggtgggcatgttctgcagcttcgagaccagaagacacctgtgcatggtgatggagtacgtggagggcggcgactgcgccaccctgctgaagaacatcggcgccctgcccgtggagatggccagaatgtacttcgccgagaccgtgctggccctggagtacctgcacaactacggcatcgtgcacagagacctgaagcccgacaacctgctgatcaccagcatgggccacatcaagctgaccgacttcggcctgagcaagatgggcctgatgagcctgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgacatcctgtggcccgagggcgacgaggccctgcccaccgaggcccagctgctgatcagcagcctgctgcagaccaaccccctggtgagactgggcgccggcggcgccttcgaggtgaagcagcacagcttcttcagagacctggactggaccggcctgctgagacagaaggccgagttcatcccccacctggagagcgaggacgacaccagctacttcgacaccagaagcgacagataccaccacgtgaacagctacgacgaggacgacaccaccgaggaggagcccgtggagatcagacagttcagcagctgcagccccagattcagcaaggtgtacagcagcatggagcagctgagccagcacgagcccaagacccccgtggccgccgccggcagcagcaagagagagcccagcaccaagggccccgaggagaaggtggccggcaagagagagggcctgggcggcctgaccctgagagagaagacctggagaggcggcagccccgagatcaagagattcagcgccagcgaggccagcttcctggagggcgaggccagcccccccctgggcgccagaagaagattcagcgccctgctggagcccagcagattcagcgccccccaggaggacgaggacgaggccagactgagaagaccccccagacccagcagcgaccccgccggcagcctggacgccagagcccccaaggaggagacccagggcgagggcaccagcagcgccggcgacagcgaggccaccgacagacccagacccggcgacctgtgcccccccagcaaggacggcgacgccagcggccccagagccaccaacgacctggtgctgagaagagccagacaccagcagatgagcggcgacgtggccgtggagaagagacccagcagaaccggcggcaaggtgatcaagagcgccagcgccaccgccctgagcgtgatgatccccgccgtggacccccacggcagcagccccctggccagccccatgagccccagaagcctgagcagcaaccccagcagcagagacagcagccccagcagagactacagccccgccgtgagcggcctgagaagccccatcaccatccagagaagcggcaagaagtacggcttcaccctgagagccatcagagtgtacatgggcgacaccgacgtgtacagcgtgcaccacatcgtgtggcacgtggaggagggcggccccgcccaggaggccggcctgtgcgccggcgacctgatcacccacgtgaacggcgagcccgtgcacggcatggtgcaccccgaggtggtggagctgatcctgaagagcggcaacaaggtggccgtgaccaccacccccttcgagaacaccagcatcagaatcggccccgccagaagaagcagctacaaggccaagatggccagaagaaacaagagacccagcgccaaggagggccaggagagcaagaagagaagcagcctgttcagaaagatcaccaagcagagcaacctgctgcacaccagcagaagcctgagcagcctgaacagaagcctgagcagcagcgacagcctgcccggcagccccacccacggcctgcccgccagaagccccacccacagctacagaagcacccccgacagcgcctacctgggcgccagcagccagagcagcagccccgccagcagcacccccaacagccccgccagcagcgccagccaccacatcagacccagcaccctgcacggcctgagccccaagctgcacagacagtacagaagcgccagatgcaagagcgccggcaacatccccctgagccccctggcccacacccccagccccacccaggccagccccccccccctgcccggccacaccgtgggcagcagccacaccacccagagcttccccgccaagctgcacagcagcccccccgtggtgagacccagacccaagagcgccgagccccccagaagccccctgctgaagagagtgcagagcgccgagaagctgggcgccagcctgagcgccgacaagaagggcgccctgagaaagcacagcctggaggtgggccaccccgacttcagaaaggacttccacggcgagctggccctgcacagcctggccgagagcgacggcgagaccccccccgtggagggcctgggcgcccccagacaggtggccgtgagaagactgggcagacaggagagccccctgagcctgggcgccgaccccctgctgcccgagggcgccagcagaccccccgtgagcagcaaggagaaggagagccccggcggcgccgaggcctgcaccccccccagagccaccacccccggcggcagaaccctggagagagacgtgggctgcaccagacaccagagcgtgcagaccgaggacggcaccggcggcatggccagagccgtggccaaggccgccctgagccccgtgcaggagcacgagaccggcagaagaagcagcagcggcgaggccggcacccccctggtgcccatcgtggtggagcccgccagacccggcgccaaggccgtggtgccccagcccctgggcgccgacagcaagggcctgcaggagcccgcccccctggcccccagcgtgcccgaggcccccagaggcagagagagatgggtgctggaggtggtggaggagagaaccaccctgagcggccccagaagcaagcccgccagccccaagctgagccccgagccccagacccccagcctggcccccgccaagtgcagcgcccccagcagcgccgtgacccccgtgccccccgccagcctgctgggcagcggcaccaagccccaggtgggcctgaccagcagatgccccgccgaggccgtgccccccgccggcctgaccaagaagggcgtgagcagccccgccccccccggcccctag

SEQ ID NO: 88937 - DNA, 2178 bp, Artificial Sequence
  Description of Artificial Sequence: Synthetic coding sequence
atgagcgacagcctgtggaccgccctgagcaacttcagcatgcccagcttccccggcggcagcatgttcagaagaaccaagagctgcagaaccagcaacagaaagagcctgatcctgaccagcaccagccccaccctgcccagaccccacagccccctgcccggccacctgggcagcagccccctggacagccccagaaacttcagccccaacacccccgcccacttcagcttcgccagcagcagaagagccgacggcagaagatggagcctggccagcctgcccagcagcggctacggcaccaacacccccagcagcaccgtgagcagcagctgcagcagccaggagagactgcaccagctgccctaccagcccaccgtggacgagctgcacttcctgagcaagcacttcggcagcaccgagagcatcaccgacgaggacggcggcagaagaagccccgccgtgagacccagaagcagaagcctgagccccggcagaagccccagcagctacgacaacgagatcgtgatgatgaaccacgtgtacaaggagagattccccaaggccaccgcccagatggaggagaagctgagagacttcaccagagcctacgagcccgacagcgtgctgcccctggccgacggcgtgctgagcttcatccaccaccagatcatcgagctggccagagactgcctgaccaagagcagagacggcctgatcaccaccgtgtacttctacgagctgcaggagaacctggagaagctgctgcaggacgcctacgagagaagcgagagcctggaggtggccttcgtgacccagctggtgaagaagctgctgatcatcatcagcagacccgccagactgctggagtgcctggagttcaaccccgaggagttctaccacctgctggaggccgccgagggccacgccaaggagggccacctggtgaagaccgacatccccagatacatcatcagacagctgggcctgaccagagaccccttccccgacgtggtgcacctggaggagcaggacagcggcggcagcaacacccccgagcaggacgacctgagcgagggcagaagcagcaaggccaagaagccccccggcgagaacgacttcgacaccatcaagctgatcagcaacggcgcctacggcgccgtgtacctggtgagacacagagacaccagacagagattcgccatgaagaagatcaacaagcagaacctgatcctgagaaaccagatccagcaggccttcgtggagagagacatcctgaccttcgccgagaaccccttcgtggtgggcatgttctgcagcttcgagaccagaagacacctgtgcatggtgatggagtacgtggagggcggcgactgcgccaccctgctgaagaacatcggcgccctgcccgtggagatggccagaatgtacttcgccgagaccgtgctggccctggagtacctgcacaactacggcatcgtgcacagagacctgaagcccgacaacctgctgatcaccagcatgggccacatcaagctgaccgacttcggcctgagcaagatgggcctgatgagcctgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgacatcctgtggcccgagggcgacgaggccctgcccaccgaggcccagctgctgatcagcagcctgctgcagaccaaccccctggtgagactgggcgccggcggcgccttcgaggtgaagcagcacagcttcttcagagacctggactggaccggcctgctgagacagaaggccgagttcatcccccacctggagagcgaggacgacaccagctacttcgacaccagaagcgacagataccaccacgtgaacagctacgacgaggacgacaccaccgaggaggagcccgtggagatcagacagttcagcagctgcagccccagattcagcaaggtgtacagcctgagaatccacatgtacacctacaagtag

SEQ ID NO: 88938 - DNA, 5397 bp, Artificial Sequence
  Description of Artificial Sequence: Synthetic coding sequence
atgaagagaagcagatgcagagacagaccccagccccccccccccgacagaagagaggacggcgtgcagagagccgccgagctgagccagagcctgccccccagaagaagagccccccccggcagacagagactggaggagagaaccggccccgccggccccgagggcaaggagcaggacgtggtgaccggcgtgagccccctgctgttcagaaagctgagcaaccccgacatcttcagcagcaccggcaaggtgaagctgcagagacagctgagccaggacgactgcaagctgtggagaggcaacctggccagcagcctgagcggcaagcagctgctgcccctgagcagcagcgtgcacagcagcgtgggccaggtgacctggcagagcagcggcgaggccagcaacctggtgagaatgagaaaccagagcctgggccagagcgcccccagcctgaccgccggcctgaaggagctgagcctgcccagaagaggcagcttctgcagaaccagcaacagaaagagcctgatcgtgaccagcagcaccagccccaccctgcccagaccccacagccccctgcacggccacaccggcaacagccccctggacagccccagaaacttcagccccaacgcccccgcccacttcagcttcgtgcccgccagaagaaccgacggcagaagatggagcctggccagcctgcccagcagcggctacggcaccaacacccccagcagcaccgtgagcagcagctgcagcagccaggagaagctgcaccagctgcccttccagcccaccgccgacgagctgcacttcctgaccaagcacttcagcaccgagagcgtgcccgacgaggagggcagacagagccccgccatgagacccagaagcagaagcctgagccccggcagaagccccgtgagcttcgacagcgagatcatcatgatgaaccacgtgtacaaggagagattccccaaggccaccgcccagatggaggagagactggccgagttcatcagcagcaacacccccgacagcgtgctgcccctggccgacggcgccctgagcttcatccaccaccaggtgatcgagatggccagagactgcctggacaagagcagaagcggcctgatcaccagccagtacttctacgagctgcaggacaacctggagaagctgctgcaggacgcccacgagagaagcgagagcagcgaggtggccttcgtgatgcagctggtgaagaagctgatgatcatcatcgccagacccgccagactgctggagtgcctggagttcgaccccgaggagttctaccacctgctggaggccgccgagggccacgccaaggagggccagggcatcaagtgcgacatccccagatacatcgtgagccagctgggcctgaccagagaccccctggaggagatggcccagctgagcagctgcgacagccccgacacccccgagaccgacgacagcatcgagggccacggcgccagcctgcccagcaagaagacccccagcgaggaggacttcgagaccatcaagctgatcagcaacggcgcctacggcgccgtgttcctggtgagacacaagagcaccagacagagattcgccatgaagaagatcaacaagcagaacctgatcctgagaaaccagatccagcaggccttcgtggagagagacatcctgaccttcgccgagaaccccttcgtggtgagcatgttctgcagcttcgacaccaagagacacctgtgcatggtgatggagtacgtggagggcggcgactgcgccaccctgctgaagaacatcggcgccctgcccgtggacatggtgagactgtacttcgccgagaccgtgctggccctggagtacctgcacaactacggcatcgtgcacagagacctgaagcccgacaacctgctgatcaccagcatgggccacatcaagctgaccgacttcggcctgagcaagatcggcctgatgagcctgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcgtgtggcccgagggcgacgaggccctgccccccgacgcccaggacctgaccagcaagctgctgcaccagaaccccctggagagactgggcaccggcagcgcctacgaggtgaagcagcaccccttcttcaccggcctggactggaccggcctgctgagacagaaggccgagttcatcccccagctggagagcgaggacgacaccagctacttcgacaccagaagcgagagataccaccacatggacagcgaggacgaggaggaggtgagcgaggacggctgcctggagatcagacagttcagcagctgcagccccagattcaacaaggtgtacagcagcatggagagactgagcctgctggaggagagaagaacccccccccccaccaagagaagcctgagcgaggagaaggaggaccacagcgacggcctggccggcctgaagggcagagacagaagctgggtgatcggcagccccgagatcctgagaaagagactgagcgtgagcgagagcagccacaccgagagcgacagcagcccccccatgaccgtgagaagaagatgcagcggcctgctggacgcccccagattccccgagggccccgaggaggccagcagcaccctgagaagacagccccaggagggcatctgggtgctgaccccccccagcggcgagggcgtgagcggccccgtgaccgagcacagcggcgagcagagacccaagctggacgaggaggccgtgggcagaagcagcggcagcagccccgccatggagaccagaggcagaggcaccagccagctggccgagggcgccaccgccaaggccatcagcgacctggccgtgagaagagccagacacagactgctgagcggcgacagcaccgagaagagaaccgccagacccgtgaacaaggtgatcaagagcgccagcgccaccgccctgagcctgctgatccccagcgagcaccacacctgcagccccctggccagccccatgagcccccacagccagagcagcaaccccagcagcagagacagcagccccagcagagacttcctgcccgccctgggcagcatgagaccccccatcatcatccacagagccggcaagaagtacggcttcaccctgagagccatcagagtgtacatgggcgacagcgacgtgtacaccgtgcaccacatggtgtggcacgtggaggacggcggccccgccagcgaggccggcctgagacagggcgacctgatcacccacgtgaacggcgagcccgtgcacggcctggtgcacaccgaggtggtggagctgatcctgaagagcggcaacaaggtggccatcagcaccacccccctggagaacaccagcatcaaggtgggccccgccagaaagggcagctacaaggccaagatggccagaagaagcaagagaagcagaggcaaggacggccaggagagcagaaagagaagcagcctgttcagaaagatcaccaagcaggccagcctgctgcacaccagcagaagcctgagcagcctgaacagaagcctgagcagcggcgagagcggccccggcagccccacccacagccacagcctgagccccagaagccccacccagggctacagagtgacccccgacgccgtgcacagcgtgggcggcaacagcagccagagcagcagccccagcagcagcgtgcccagcagccccgccggcagcggccacaccagacccagcagcctgcacggcctggcccccaagctgcagagacagtacagaagccccagaagaaagagcgccggcagcatccccctgagccccctggcccacacccccagcccccccccccccaccgccagcccccagagaagccccagccccctgagcggccacgtggcccaggccttccccaccaagctgcacctgagcccccccctgggcagacagctgagcagacccaagagcgccgagccccccagaagccccctgctgaagagagtgcagagcgccgagaagctggccgccgccctggccgccagcgagaagaagctggccaccagcagaaagcacagcctggacctgccccacagcgagctgaagaaggagctgccccccagagaggtgagccccctggaggtggtgggcgccagaagcgtgctgagcggcaagggcgccctgcccggcaagggcgtgctgcagcccgcccccagcagagccctgggcaccctgagacaggacagagccgagagaagagagagcctgcagaagcaggaggccatcagagaggtggacagcagcgaggacgacaccgaggagggccccgagaacagccagggcgcccaggagctgagcctggccccccaccccgaggtgagccagagcgtggcccccaagggcgccggcgagagcggcgaggaggaccccttccccagcagagaccccagaagcctgggccccatggtgcccagcctgctgaccggcatcaccctgggcccccccagaatggagagccccagcggcccccacagaagactgggcagcccccaggccatcgaggaggccgccagcagcagcagcgccggccccaacctgggccagagcggcgccaccgaccccatcccccccgagggctgctggaaggcccagcacctgcacacccaggccctgaccgccctgagccccagcaccagcggcctgacccccaccagcagctgcagcccccccagcagcaccagcggcaagctgagcatgtggagctggaagagcctgatcgagggccccgacagagccagccccagcagaaaggccaccatggccggcggcctggccaacctgcaggacctggagaacaccacccccgcccagcccaagaacctgagccccagagagcagggcaagacccagccccccagcgcccccagactggcccaccccagctacgaggaccccagccagggctggctgtgggagagcgagtgcgcccaggccgtgaaggaggaccccgccctgagcatcacccaggtgcccgacgccagcggcgacagaagacaggacgtgccctgcagaggctgccccctgacccagaagagcgagcccagcctgagaagaggccaggagcccggcggccaccagaagcacagagacctggccctggtgcccgacgagctgctgaagcagacctag

SEQ ID NO: 88939 - DNA, 2379 bp, Artificial Sequence
  Description of Artificial Sequence: Synthetic coding sequence
atgttcagccccaccagcgcccccgccctgttcctgaccaaggtgcccttcagcgccgactgcgccctggccaccagccccctggccatcttcctgaaccccagagcccacagcagccccggcaccccctgcagcagcagacccctgccctggagctgcagaaccagcaacagaaagagcctgatcgtgaccagcagcaccagccccaccctgcccagaccccacagccccctgcacggccacaccggcaacagccccctggacagccccagaaacttcagccccaacgcccccgcccacttcagcttcgtgcccgccagaagaaccgacggcagaagatggagcctggccagcctgcccagcagcggctacggcaccaacacccccagcagcaccgtgagcagcagctgcagcagccaggagaagctgcaccagctgcccttccagcccaccgccgacgagctgcacttcctgaccaagcacttcagcaccgagagcgtgcccgacgaggagggcagacagagccccgccatgagacccagaagcagaagcctgagccccggcagaagccccgtgagcttcgacagcgagatcatcatgatgaaccacgtgtacaaggagagattccccaaggccaccgcccagatggaggagagactggccgagttcatcagcagcaacacccccgacagcgtgctgcccctggccgacggcgccctgagcttcatccaccaccaggtgatcgagatggccagagactgcctggacaagagcagaagcggcctgatcaccagccagtacttctacgagctgcaggacaacctggagaagctgctgcaggacgcccacgagagaagcgagagcagcgaggtggccttcgtgatgcagctggtgaagaagctgatgatcatcatcgccagacccgccagactgctggagtgcctggagttcgaccccgaggagttctaccacctgctggaggccgccgagggccacgccaaggagggccagggcatcaagtgcgacatccccagatacatcgtgagccagctgggcctgaccagagaccccctggaggagatggcccagctgagcagctgcgacagccccgacacccccgagaccgacgacagcatcgagggccacggcgccagcctgcccagcaagaagacccccagcgaggaggacttcgagaccatcaagctgatcagcaacggcgcctacggcgccgtgttcctggtgagacacaagagcaccagacagagattcgccatgaagaagatcaacaagcagaacctgatcctgagaaaccagatccagcaggccttcgtggagagagacatcctgaccttcgccgagaaccccttcgtggtgagcatgttctgcagcttcgacaccaagagacacctgtgcatggtgatggagtacgtggagggcggcgactgcgccaccctgctgaagaacatcggcgccctgcccgtggacatggtgagactgtacttcgccgagaccgtgctggccctggagtacctgcacaactacggcatcgtgcacagagacctgaagcccgacaacctgctgatcaccagcatgggccacatcaagctgaccgacttcggcctgagcaagatcggcctgatgagcctgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcgtgtggcccgagggcgacgaggccctgccccccgacgcccaggacctgaccagcaagctgctgcaccagaaccccctggagagactgggcaccggcagcgcctacgaggtgaagcagcaccccttcttcaccggcctggactggaccggcctgctgagacagaaggccgagttcatcccccagctggagagcgaggacgacaccagctacttcgacaccagaagcgagagataccaccacatggacagcgaggacgaggaggaggtgagcgaggacggctgcctggagatcagacagttcagcagctgcagccccagattcaacaaggtgtacagcagcatggagagactgagcctgctggaggagagaagaacccccccccccaccaagagaagcctgagcgaggagaaggaggaccacagcgacggcctggccggcctgaagggcagagacagaagctgggtgatcggcagccccgagcaccaccccagcgcctag

SEQ ID NO: 88940 - DNA, 4827 bp, Artificial Sequence
  Description of Artificial Sequence: Synthetic coding sequence
atgaagagaagcagatgcagagacagaccccagccccccccccccgacagaagagaggacggcgtgcagagagccgccgagctgagccagagcctgccccccagaagaagagccccccccggcagacagagactggaggagagaaccggccccgccggccccgagggcaaggagcaggacgtggtgaccggcgtgagccccctgctgttcagaaagctgagcaaccccgacatcttcagcagcaccggcaaggtgaagctgcagagacagctgagccaggacgactgcaagctgtggagaggcaacctggccagcagcctgagcggcaagcagctgctgcccctgagcagcagcgtgcacagcagcgtgggccaggtgacctggcagagcagcggcgaggccagcaacctggtgagaatgagaaaccagagcctgggccagagcgcccccagcctgaccgccggcctgaaggagctgagcctgcccagaagaggcagcttctgcagaaccagcaacagaaagagcctgatcgtgaccagcagcaccagccccaccctgcccagaccccacagccccctgcacggccacaccggcaacagccccctggacagccccagaaacttcagccccaacgcccccgcccacttcagcttcgtgcccgccagaagaaccgacggcagaagatggagcctggccagcctgcccagcagcggctacggcaccaacacccccagcagcaccgtgagcagcagctgcagcagccaggagaagctgcaccagctgcccttccagcccaccgccgacgagctgcacttcctgaccaagcacttcagcaccgagagcgtgcccgacgaggagggcagacagagccccgccatgagacccagaagcagaagcctgagccccggcagaagccccgtgagcttcgacagcgagatcatcatgatgaaccacgtgtacaaggagagattccccaaggcccacgagagaagcgagagcagcgaggtggccttcgtgatgcagctggtgaagaagctgatgatcatcatcgccagacccgccagactgctggagtgcctggagttcgaccccgaggagttctaccacctgctggaggccgccgagggccacgccaaggagggccagggcatcaagtgcgacatccccagatacatcgtgagccagctgggcctgaccagagaccccctggaggagatggcccagctgagcagctgcgacagccccgacacccccgagaccgacgacagcatcgagggccacggcgccagcctgcccagcaagaagacccccagcgaggaggacttcgagaccatcaagctgatcagcaacggcgcctacggcgccgtgttcctggtgagacacaagagcaccagacagagattcgccatgaagaagatcaacaagcagaacctgatcctgagaaaccagatccagcaggccttcgtggagagagacatcctgaccttcgccgagaaccccttcgtggtgagcatgttctgcagcttcgacaccaagagacacctgtgcatggtgatggagtacgtggagggcggcgactgcgccaccctgctgaagaacatcggcgccctgcccgtggacatggtgagactgtacttcgccgagaccgtgctggccctggagtacctgcacaactacggcatcgtgcacagagacctgaagcccgacaacctgctgatcaccagcatgggccacatcaagctgaccgacttcggcctgagcaagatcggcctgatgagcctgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcgtgtggcccgagggcgacgaggccctgccccccgacgcccaggacctgaccagcaagctgctgcaccagaaccccctggagagactgggcaccggcagcgcctacgaggtgaagcagcaccccttcttcaccggcctggactggaccggcctgctgagacagaaggccgagttcatcccccagctggagagcgaggacgacaccagctacttcgacaccagaagcgagagataccaccacatggacagcgaggacgaggaggaggtgagcgaggacggctgcctggagatcagacagttcagcagctgcagccccagattcaacaaggtgtacagcagcatggagagactgagcctgctggaggagagaagaacccccccccccaccaagagaagcctgagcgaggagaaggaggaccacagcgacggcctggccggcctgaagggcagagacagaagctgggtgatcggcagccccgagatcctgagaaagagactgagcgtgagcgagagcagccacaccgagagcgacagcagcccccccatgaccgtgagaagaagatgcagcggcctgctggacgcccccagattccccgagggccccgaggaggccagcagcaccctgagaagacagccccaggagggcatctgggtgctgaccccccccagcggcgagggcgtgagcggccccgtgaccgagcacagcggcgagcagagacccaagctggacgaggaggccgtgggcagaagcagcggcagcagccccgccatggagaccagaggcagaggcaccagccagctggccgagggcgccaccgccaaggccatcagcgacctggccgtgagaagagccagacacagactgctgagcggcgacagcaccgagaagagaaccgccagacccgtgaacaaggtgatcaagagcgccagcgccaccgccctgagcctgctgatccccagcgagcaccacacctgcagccccctggccagccccatgagcccccacagccagagcagcaaccccagcagcagagacagcagcccctacggcttcaccctgagagccatcagagtgtacatgggcgacagcgacgtgtacaccgtgcaccacatggtgtggcacgtggaggacggcggccccgccagcgaggccggcctgagacagggcgacctgatcacccacgtgaacggcgagcccgtgcacggcctggtgcacaccgaggtggtggagctgatcctgaagagcggcaacaaggtggccatcagcaccacccccctggagaacaccagcatcaaggtgggccccgccagaaagggcagctacaaggccaagatggccagaagaagcaagagaagcagaggcaaggacggccaggagagcagaaagagaagcagcctgttcagaaagatcaccaagcaggccagcctgctgcacaccagcagaagcctgagcagcctgaacagaagcctgagcagcggcgagagcggccccggcagccccacccacagccacagcctgagccccagaagccccacccagggctacagagtgacccccgacgccgtgcacagcgagctgagcagacccaagagcgccgagccccccagaagccccctgctgaagagagtgcagagcgccgagaagctggccgccgccctggccgccagcgagaagaagctggccaccagcagaaagcacagcctggacctgccccacagcgagctgaagaaggagctgccccccagagaggtgagccccctggaggtggtgggcgccagaagcgtgctgagcggcaagggcgccctgcccggcaagggcgtgctgcagcccgcccccagcagagccctgggcaccctgagacaggacagagccgagagaagagagagcctgcagaagcaggaggccatcagagaggtggacagcagcgaggacgacaccgaggagggccccgagaacagccagggcgcccaggagctgagcctggccccccaccccgaggtgagccagagcgtggcccccaagggcgccggcgagagcggcgaggaggaccccttccccagcagagaccccagaagcctgggccccatggtgcccagcctgctgaccggcatcaccctgggcccccccagaatggagagccccagcggcccccacagaagactgggcagcccccaggccatcgaggaggccgccagcagcagcagcgccggccccaacctgggccagagcggcgccaccgaccccatcccccccgagggctgctggaaggcccagcacctgcacacccaggccctgaccgccctgagccccagcaccagcggcctgacccccaccagcagctgcagcccccccagcagcaccagcggcaagctgagcatgtggagctggaagagcctgatcgagggccccgacagagccagccccagcagaaaggccaccatggccggcggcctggccaacctgcaggacctggagaacaccacccccgcccagcccaagaacctgagccccagagagcagggcaagacccagccccccagcgcccccagactggcccaccccagctacgaggaccccagccagggctggctgtgggagagcgagtgcgcccaggccgtgaaggaggaccccgccctgagcatcacccaggtgcccgacgccagcggcgacagaagacaggacgtgccctgcagaggctgccccctgacccagaagagcgagcccagcctgagaagaggccaggagcccggcggccaccagaagcacagagacctggccctggtgcccgacgagctgctgaagcagacctag

SEQ ID NO: 88941 - DNA, 1893 bp, Artificial Sequence
  Description of Artificial Sequence: Synthetic coding sequence
atgagacccagaagcagaagcctgagccccggcagaagccccgtgagcttcgacagcgagatcatcatgatgaaccacgtgtacaaggagagattccccaaggccaccgcccagatggaggagagactggccgagttcatcagcagcaacacccccgacagcgtgctgcccctggccgacggcgccctgagcttcatccaccaccaggtgatcgagatggccagagactgcctggacaagagcagaagcggcctgatcaccagccagtacttctacgagctgcaggacaacctggagaagctgctgcaggacgagttcgaccccgaggagttctaccacctgctggaggccgccgagggccacgccaaggagggccagggcatcaagtgcgacatccccagatacatcgtgagccagctgggcctgaccagagaccccctggaggagatggcccagctgagcagctgcgacagccccgacacccccgagaccgacgacagcatcgagggccacggcgccagcctgcccagcaagaagacccccagcgaggaggacttcgagaccatcaagctgatcagcaacggcgcctacggcgccgtgttcctggtgagacacaagagcaccagacagagattcgccatgaagaagatcaacaagcagaacctgatcctgagaaaccagatccagcaggccttcgtggagagagacatcctgaccttcgccgagaaccccttcgtggtgagcatgttctgcagcttcgacaccaagagacacctgtgcatggtgatggagtacgtggagggcggcgactgcgccaccctgctgaagaacatcggcgccctgcccgtggacatggtgagactgtacttcgccgagaccgtgctggccctggagtacctgcacaactacggcatcgtgcacagagacctgaagcccgacaacctgctgatcaccagcatgggccacatcaagctgaccgacttcggcctgagcaagatcggcctgatgagcctgaccaccaacctgtacgagggccacatcgagaaggacgccagagagttcctggacaagcaggtgtgcggcacccccgagtacatcgcccccgaggtgatcctgagacagggctacggcaagcccgtggactggtgggccatgggcatcatcctgtacgagttcctggtgggctgcgtgcccttcttcggcgacacccccgaggagctgttcggccaggtgatcagcgacgagatcgtgtggcccgagggcgacgaggccctgccccccgacgcccaggacctgaccagcaagctgctgcaccagaaccccctggagagactgggcaccggcagcgcctacgaggtgaagcagcaccccttcttcaccggcctggactggaccggcctgctgagacagaaggccgagttcatcccccagctggagagcgaggacgacaccagctacttcgacaccagaagcgagagataccaccacatggacagcgaggacgaggaggaggtgagcgaggacggctgcctggagatcagacagttcagcagctgcagccccagattcaacaaggtgtacagcagcatggagagactgagcctgctggaggagagaagaacccccccccccaccaagagaagcctgagcgaggagaaggaggaccacagcgacggcctggccggcctgaagggcagagacagaagctgggtgatcggcagccccgagatcctgagaaagagactgagcgtgagcgagagcagcctgctgaaggtggccggcagacccagcaccttcagccagcacttcggcacccacccccaccagcagctgctgagcagccagctgcacctgtgggaggccgagcacgtggtgctggagatcccctactag

SEQ ID NO: 88942 - DNA, 1035 bp, Artificial Sequence
  Description of Artificial Sequence: Synthetic coding sequence
atggacgacagcagcatcctgagaagaagaggcctgcagaaggagctgagcctgcccagaagaggcagcttctgcagaaccagcaacagaaagagcctgatcgtgaccagcagcaccagccccaccctgcccagaccccacagccccctgcacggccacaccggcaacagccccctggacagccccagaaacttcagccccaacgcccccgcccacttcagcttcgtgcccgccagaagccacagccacagagccgacagaaccgacggcagaagatggagcctggccagcctgcccagcagcggctacggcaccaacacccccagcagcaccgtgagcagcagctgcagcagccaggagaagctgcaccagctgcccttccagcccaccgccgacgagctgcacttcctgaccaagcacttcagcaccgagagcgtgcccgacgaggagggcagacagagccccgccatgagacccgcccccagcagagccctgggcaccctgagacaggacagagccgagagaagagagagcctgcagaagcaggaggccatcagagaggtggacagcagcgaggacgacaccgaggagggccccgagaacagccagggcgcccaggagctgagcctggccccccaccccgaggtgagccagagcgtggcccccaagggcgccggcgagagcggcgaggaggaccccttccccagcagagaccccagaagcctgggccccatggtgcccagcctgctgaccggcatcaccctgggcccccccagaatggagagccccagcggcccccacagaagactgggcagcccccaggccatcgaggaggccgccagcagcagcagcgccggccccaacctgggccagagcggcgccaccgaccccatcccccccgagggctgctggaaggcccagcacctgcacacccaggccctgaccgccctgagccccagcaccagcggcctggcccacctgatgagaatccccgccagagccggctacggcagcctgagcgtgcacaagcagtag

SEQ ID NO: 88943 - DNA, 3930 bp, Artificial Sequence
  Description of Artificial Sequence: Synthetic coding sequence
atggacgagagcagcctgctgagaagaagaggcctgcagaaggagctgagcctgcccagaagaggcagaggctgcagaagcggcaacagaaagagcctggtggtgggcacccccagccccaccctgagcagacccctgagccccctgagcgtgcccaccgccggcagcagccccctggacagccccagaaacttcagcgccgccagcgccctgaacttccccttcgccagaagagccgacggcagaagatggagcctggccagcctgcccagcagcggctacggcaccaacacccccagcagcaccctgagcagcagcagcagcagcagagagagactgcaccagctgcccttccagcccacccccgacgagctgcacttcctgagcaagcacttcagaagcagcgagaacgtgctggacgaggagggcggcagaagccccagactgagacccagaagcagaagcctgagccccggcagagccaccggcaccttcgacaacgagatcgtgatgatgaaccacgtgtacagagagagattccccaaggccaccgcccagatggagggcagactgcaggagttcctgaccgcctacgcccccggcgccagactggccctggccgacggcgtgctgggcttcatccaccaccagatcgtggagctggccagagactgcctggccaagagcggcgagaacctggtgaccagcagatacttcctggagatgcaggagaagctggagagactgctgcaggacgcccacgagagaagcgacagcgaggaggtgagcttcatcgtgcagctggtgagaaagctgctgatcatcatcagcagacccgccagactgctggagtgcctggagttcgaccccgaggagttctaccacctgctggaggccgccgagggccacgccagagagggccagggcatcaagaccgacctgccccagtacatcatcggccagctgggcctggccaaggaccccctggaggagatggtgcccctgagccacctggaggaggagcagccccccgcccccgagagccccgagagcagagccctggtgggccagagcagaagaaagccctgcgagagcgacttcgagaccatcaagctgatcagcaacggcgcctacggcgccgtgtacctggtgagacacagagacaccagacagagattcgccatcaagaagatcaacaagcagaacctgatcctgagaaaccagatccagcaggtgttcgtggagagagacatcctgaccttcgccgagaaccccttcgtggtgagcatgttctgcagcttcgagaccagaagacacctgtgcatggtgatggagtacgtggagggcggcgactgcgccaccctgctgaagaacatgggccccctgcccgtggacatggccagactgtacttcgccgagaccgtgctggccctggagtacctgcacaactacggcatcgtgcacagagacctgaagcccgacaacctgctgatcaccagcctgggccacatcaagctgaccgacttcggcctgagcaagatcggcctgatgagcatggccaccaacctgtacgagggccacatcgagaaggacgccagagagttcatcgacaagcaggtgtgcggcacccccgagtacatcgcccccgaggtgatcttcagacagggctacggcaagcccgtggactggtgggccatgggcgtggtgctgtacgagttcctggtgggctgcgtgcccttcttcggcgacacccccgaggagctgttcggccaggtggtgagcgacgagatcatgtggcccgagggcgacgaggccctgcccgccgacgcccaggacctgatcaccagactgctgagacagagccccctggacagactgggcaccggcggcacccacgaggtgaagcagcaccccttcttcctggccctggactgggccggcctgctgagacacaaggccgagttcgtgccccagctggaggccgaggacgacaccagctacttcgacaccagaagcgagagatacagacacctgggcagcgaggacgacgagaccaacgacgaggagagcagcaccgagatcccccagttcagcagctgcagccacagattcagcaaggtgtacagcagcagcgagttcctggccgtgcagcccacccccaccttcgccgagagaagcttcagcgaggacagagaggagggctgggagagaagcgaggtggactacggcagaagactgagcgccgacatcagactgagaagctggaccagcagcggcagcagctgccagagcagcagcagccagcccgagagaggccccagccccagcctgctgaacaccatcagcctggacaccatgcccaagttcgccttcagcagcgaggacgagggcgtgggccccggccccgccggccccaagagacccgtgttcatcctgggcgagcccgaccccccccccgccgccacccccgtgatgcccaagcccagcagcctgagcgccgacaccgccgccctgagccacgccagactgagaagcaacagcatcggcgccagacacagcacccccagacccctggacgccggcagaggcagaagactgggcggccccagagaccccgcccccgagaagagcagagccagcagcagcggcggcagcggcggcggcagcggcggcagagtgcccaagagcgccagcgtgagcgccctgagcctgatcatcaccgccgacgacggcagcggcggccccctgatgagccccctgagccccagaagcctgagcagcaaccccagcagcagagacagcagccccagcagagaccccagccccgtgtgcggcagcctgagaccccccatcgtgatccacagcagcggcaagaagtacggcttcagcctgagagccatcagagtgtacatgggcgacagcgacgtgtacaccgtgcaccacgtggtgtggagcgtggaggacggcagccccgcccaggaggccggcctgagagccggcgacctgatcacccacatcaacggcgagagcgtgctgggcctggtgcacatggacgtggtggagctgctgctgaagagcggcaacaagatcagcctgagaaccaccgccctggagaacaccagcatcaaggtgggccccgccagaaagaacgtggccaagggcagaatggccagaagaagcaagagaagcagaagaagagagacccaggacagaagaaagagcctgttcaagaagatcagcaagcagaccagcgtgctgcacaccagcagaagcttcagcagcggcctgcaccacagcctgagcagcagcgagagcctgcccggcagccccacccacagcctgagccccagccccaccaccccctgcagaagccccgcccccgacgtgcccgccgacaccaccgccagcccccccagcgccagccccagcagcagcagccccgccagccccgccgccgccggccacaccagacccagcagcctgcacggcctggccgccaagctgggcccccccagacccaagaccggcagaagaaagagcaccagcagcatcccccccagccccctggcctgcccccccatcagcgcccccccccccagaagccccagccccctgcccggccacccccccgcccccgccagaagccccagactgagaagaggccagagcgccgacaagctgggcaccggcgagagactggacggcgaggccggcagaagaaccagaggccccgaggccgagctggtggtgatgagaagactgcacctgagcgagagaagagacagcttcaagaagcaggaggccgtgcaggaggtgagcttcgacgagccccaggaggaggccaccggcctgcccaccagcgtgccccagatcgccgtggagggcgaggaggccgtgcccgtggccctgggccccaccggcagagactag

SEQ ID NO: 88944 - DNA, 2523 bp, Artificial Sequence
  Description of Artificial Sequence: Synthetic coding sequence
atggaccccaccgccggcagcaagaaggagcccggcggcggcgccgccaccgaggagggcgtgaacagaatcgccgtgcccaagccccccagcatcgaggagttcagcatcgtgaagcccatcagcagaggcgccttcggcaaggtgtacctgggccagaagggcggcaagctgtacgccgtgaaggtggtgaagaaggccgacatgatcaacaagaacatgacccaccaggtgcaggccgagagagacgccctggccctgagcaagagccccttcatcgtgcacctgtactacagcctgcagagcgccaacaacgtgtacctggtgatggagtacctgatcggcggcgacgtgaagagcctgctgcacatctacggctacttcgacgaggagatggccgtgaagtacatcagcgaggtggccctggccctggactacctgcacagacacggcatcatccacagagacctgaagcccgacaacatgctgatcagcaacgagggccacatcaagctgaccgacttcggcctgagcaaggtgaccctgaacagagacatcaacatgatggacatcctgaccacccccagcatggccaagcccagacaggactacagcagaacccccggccaggtgctgagcctgatcagcagcctgggcttcaacacccccatcgccgagaagaaccaggaccccgccaacatcctgagcgcctgcctgagcgagaccagccagctgagccagggcctggtgtgccccatgagcgtggaccagaaggacaccaccccctacagcagcaagctgctgaagagctgcctggagaccgtggccagcaaccccggcatgcccgtgaagtgcctgaccagcaacctgctgcagagcagaaagagactggccaccagcagcgccagcagccagagccacaccttcatcagcagcgtggagagcgagtgccacagcagccccaagtgggagaaggactgccaggagagcgacgaggccctgggccccaccatgatgagctggaacgccgtggagaagctgtgcgccaagagcgccaacgccatcgagaccaagggcttcaacaagaaggacctggagctggccctgagccccatccacaacagcagcgccctgcccaccaccggcagaagctgcgtgaacctggccaagaagtgcttcagcggcgaggtgagctgggaggccgtggagctggacgtgaacaacatcaacatggacaccgacaccagccagctgggcttccaccagagcaaccagtgggccgtggacagcggcggcatcagcgaggagcacctgggcaagagaagcctgaagagaaacttcgagctggtggacagcagcccctgcaagaagatcatccagaacaagaagacctgcgtggagtacaagcacaacgagatgaccaactgctacaccaaccagaacaccggcctgaccgtggaggtgcaggacctgaagctgagcgtgcacaagagccagcagaacgactgcgccaacaaggagaacatcgtgaacagcttcaccgacaagcagcagacccccgagaagctgcccatccccatgatcgccaagaacctgatgtgcgagctggacgaggactgcgagaagaacagcaagagagactacctgagcagcagcttcctgtgcagcgacgacgacagagccagcaagaacatcagcatgaacagcgacagcagcttccccggcatcagcatcatggagagccccctggagagccagcccctggacagcgacagaagcatcaaggagagcagcttcgaggagagcaacatcgaggaccccctgatcgtgacccccgactgccaggagaagaccagccccaagggcgtggagaaccccgccgtgcaggagagcaaccagaagatgctgggcccccccctggaggtgctgaagaccctggccagcaagagaaacgccgtggccttcagaagcttcaacagccacatcaacgccagcaacaacagcgagcccagcagaatgaacatgaccagcctggacgccatggacatcagctgcgcctacagcggcagctaccccatggccatcacccccacccagaagagaagaagctgcatgccccaccagacccccaaccagatcaagagcggcaccccctacagaacccccaagagcgtgagaagaggcgtggcccccgtggacgacggcagaatcctgggcacccccgactacctggcccccgagctgctgctgggcagagcccacgacatcccctggcccgagggcgaggagaagctgagcgacaacgcccagagcgccgtggagatcctgctgaccatcgacgacaccaagagagccggcatgaaggagctgaagagacaccccctgttcagcgacgtggactgggagaacctgcagcaccagaccatgcccttcatcccccagcccgacgacgagaccgacaccagctacttcgaggccagaaacaccgcccagcacctgaccgtgagcggcttcagcctgtag

SEQ ID NO: 88945 - DNA, 2640 bp, Artificial Sequence
  Description of Artificial Sequence: Synthetic coding sequence
atggaccccaccgccggcagcaagaaggagcccggcggcggcgccgccaccgaggagggcgtgaacagaatcgccgtgcccaagccccccagcatcgaggagttcagcatcgtgaagcccatcagcagaggcgccttcggcaaggtgtacctgggccagaagggcggcaagctgtacgccgtgaaggtggtgaagaaggccgacatgatcaacaagaacatgacccaccaggtgcaggccgagagagacgccctggccctgagcaagagccccttcatcgtgcacctgtactacagcctgcagagcgccaacaacgtgtacctggtgatggagtacctgatcggcggcgacgtgaagagcctgctgcacatctacggctacttcgacgaggagatggccgtgaagtacatcagcgaggtggccctggccctggactacctgcacagacacggcatcatccacagagacctgaagcccgacaacatgctgatcagcaacgagggccacatcaagctgaccgacttcggcctgagcaaggtgaccctgaacagagacatcaacatgatggacatcctgaccacccccagcatggccaagcccagacaggactacagcagaacccccggccaggtgctgagcctgatcagcagcctgggcttcaacacccccatcgccgagaagaaccaggaccccgccaacatcctgagcgcctgcctgagcgagaccagccagctgagccagggcctggtgtgccccatgagcgtggaccagaaggacaccaccccctacagcagcaagctgctgaagagctgcctggagaccgtggccagcaaccccggcatgcccgtgaagtgcctgaccagcaacctgctgcagagcagaaagagactggccaccagcagcgccagcagccagagccacaccttcatcagcagcgtggagagcgagtgccacagcagccccaagtgggagaaggactgccaggagagcgacgaggccctgggccccaccatgatgagctggaacgccgtggagaagctgtgcgccaagagcgccaacgccatcgagaccaagggcttcaacaagaaggacctggagctggccctgagccccatccacaacagcagcgccctgcccaccaccggcagaagctgcgtgaacctggccaagaagtgcttcagcggcgaggtgagctgggaggccgtggagctggacgtgaacaacatcaacatggacaccgacaccagccagctgggcttccaccagagcaaccagtgggccgtggacagcggcggcatcagcgaggagcacctgggcaagagaagcctgaagagaaacttcgagctggtggacagcagcccctgcaagaagatcatccagaacaagaagacctgcgtggagtacaagcacaacgagatgaccaactgctacaccaaccagaacaccggcctgaccgtggaggtgcaggacctgaagctgagcgtgcacaagagccagcagaacgactgcgccaacaaggagaacatcgtgaacagcttcaccgacaagcagcagacccccgagaagctgcccatccccatgatcgccaagaacctgatgtgcgagctggacgaggactgcgagaagaacagcaagagagactacctgagcagcagcttcctgtgcagcgacgacgacagagccagcaagaacatcagcatgaacagcgacagcagcttccccggcatcagcatcatggagagccccctggagagccagcccctggacagcgacagaagcatcaaggagagcagcttcgaggagagcaacatcgaggaccccctgatcgtgacccccgactgccaggagaagaccagccccaagggcgtggagaaccccgccgtgcaggagagcaaccagaagatgctgggcccccccctggaggtgctgaagaccctggccagcaagagaaacgccgtggccttcagaagcttcaacagccacatcaacgccagcaacaacagcgagcccagcagaatgaacatgaccagcctggacgccatggacatcagctgcgcctacagcggcagctaccccatggccatcacccccacccagaagagaagaagctgcatgccccaccagcagacccccaaccagatcaagagcggcaccccctacagaacccccaagagcgtgagaagaggcgtggcccccgtggacgacggcagaatcctgggcacccccgactacctggcccccgagctgctgctgggcagagcccacggccccgccgtggactggtgggccctgggcgtgtgcctgttcgagttcctgaccggcatcccccccttcaacgacgagaccccccagcaggtgttccagaacatcctgaagagagacatcccctggcccgagggcgaggagaagctgagcgacaacgcccagagcgccgtggagatcctgctgaccatcgacgacaccaagagagccggcatgaaggagctgaagagacaccccctgttcagcgacgtggactgggagaacctgcagcaccagaccatgcccttcatcccccagcccgacgacgagaccgacaccagctacttcgaggccagaaacaccgcccagcacctgaccgtgagcggcttcagcctgtag

SEQ ID NO: 88946 - DNA, 2637 bp, Artificial Sequence
  Description of Artificial Sequence: Synthetic coding sequence
atggaccccaccgccggcagcaagaaggagcccggcggcggcgccgccaccgaggagggcgtgaacagaatcgccgtgcccaagccccccagcatcgaggagttcagcatcgtgaagcccatcagcagaggcgccttcggcaaggtgtacctgggccagaagggcggcaagctgtacgccgtgaaggtggtgaagaaggccgacatgatcaacaagaacatgacccaccaggtgcaggccgagagagacgccctggccctgagcaagagccccttcatcgtgcacctgtactacagcctgcagagcgccaacaacgtgtacctggtgatggagtacctgatcggcggcgacgtgaagagcctgctgcacatctacggctacttcgacgaggagatggccgtgaagtacatcagcgaggtggccctggccctggactacctgcacagacacggcatcatccacagagacctgaagcccgacaacatgctgatcagcaacgagggccacatcaagctgaccgacttcggcctgagcaaggtgaccctgaacagagacatcaacatgatggacatcctgaccacccccagcatggccaagcccagacaggactacagcagaacccccggccaggtgctgagcctgatcagcagcctgggcttcaacacccccatcgccgagaagaaccaggaccccgccaacatcctgagcgcctgcctgagcgagaccagccagctgagccagggcctggtgtgccccatgagcgtggaccagaaggacaccaccccctacagcagcaagctgctgaagagctgcctggagaccgtggccagcaaccccggcatgcccgtgaagtgcctgaccagcaacctgctgcagagcagaaagagactggccaccagcagcgccagcagccagagccacaccttcatcagcagcgtggagagcgagtgccacagcagccccaagtgggagaaggactgccaggagagcgacgaggccctgggccccaccatgatgagctggaacgccgtggagaagctgtgcgccaagagcgccaacgccatcgagaccaagggcttcaacaagaaggacctggagctggccctgagccccatccacaacagcagcgccctgcccaccaccggcagaagctgcgtgaacctggccaagaagtgcttcagcggcgaggtgagctgggaggccgtggagctggacgtgaacaacatcaacatggacaccgacaccagccagctgggcttccaccagagcaaccagtgggccgtggacagcggcggcatcagcgaggagcacctgggcaagagaagcctgaagagaaacttcgagctggtggacagcagcccctgcaagaagatcatccagaacaagaagacctgcgtggagtacaagcacaacgagatgaccaactgctacaccaaccagaacaccggcctgaccgtggaggtgcaggacctgaagctgagcgtgcacaagagccagcagaacgactgcgccaacaaggagaacatcgtgaacagcttcaccgacaagcagcagacccccgagaagctgcccatccccatgatcgccaagaacctgatgtgcgagctggacgaggactgcgagaagaacagcaagagagactacctgagcagcagcttcctgtgcagcgacgacgacagagccagcaagaacatcagcatgaacagcgacagcagcttccccggcatcagcatcatggagagccccctggagagccagcccctggacagcgacagaagcatcaaggagagcagcttcgaggagagcaacatcgaggaccccctgatcgtgacccccgactgccaggagaagaccagccccaagggcgtggagaaccccgccgtgcaggagagcaaccagaagatgctgggcccccccctggaggtgctgaagaccctggccagcaagagaaacgccgtggccttcagaagcttcaacagccacatcaacgccagcaacaacagcgagcccagcagaatgaacatgaccagcctggacgccatggacatcagctgcgcctacagcggcagctaccccatggccatcacccccacccagaagagaagaagctgcatgccccaccagacccccaaccagatcaagagcggcaccccctacagaacccccaagagcgtgagaagaggcgtggcccccgtggacgacggcagaatcctgggcacccccgactacctggcccccgagctgctgctgggcagagcccacggccccgccgtggactggtgggccctgggcgtgtgcctgttcgagttcctgaccggcatcccccccttcaacgacgagaccccccagcaggtgttccagaacatcctgaagagagacatcccctggcccgagggcgaggagaagctgagcgacaacgcccagagcgccgtggagatcctgctgaccatcgacgacaccaagagagccggcatgaaggagctgaagagacaccccctgttcagcgacgtggactgggagaacctgcagcaccagaccatgcccttcatcccccagcccgacgacgagaccgacaccagctacttcgaggccagaaacaccgcccagcacctgaccgtgagcggcttcagcctgtag

SEQ ID NO: 88947 - DNA, 17817 bp, Artificial Sequence
  Description of Artificial Sequence: Synthetic coding sequence
atgcagaagggcctgctggaccaggacaccggcctggtgctgctggagagccaggtgatcatgagcggcctgatcgcccccgagaccggcgagaacctgagcctggaggagggcatcgccagaaacctgatcaacccccagatgtaccagcagctgagagagctgcaggacgccctggccctgatcagcagactgaccgagagcagaggccccctgagcgtggtggaggccatcgagaagagaatcatcagcgagaccgtgggcctgaagatcctggaggcccacctggccaccggcggcttcagcctgagccccagcgagaactgcatcaacctggaggaggccttccaccagggcctgatcagcgcctggctgcacagcgtgctggagagctacctgagaaccagcaagaacctgatcgaccccaacaccgccgagaagatcggcctgctggacctgatgcagagatgcatcgtgcaccaggagagcggcttcaagctgctgcccgtgaagcagctggccggcggcatggtgagcctgaagagcggcagaaaggtgagcatcttcagagccgtgcaggagggcctgatcgacagacaggtgaccgtgagactgctggaggcccagctgttcgccggcggcatcgtggaccccagaaccggccacagactgaccgtggaggaggccgtgagacacaacctgatcgaccaggacatggcctgcgccatcctgatcagacagctgcagaccggcggcatcatcgacaccgtgaccggccagagactgaccatcgacgaggccgtgagcaacgacctggtggccgccaagatcgccctggtgatcctggagagcctgtggagcttcatgggcctgctgtggcccgagagcggcgagatcctgcccatcaccgacgccctggagcagggcatcgtgagcaccgagctggcccacaagatcctgagcaacagacagcacatcaaggccctgttcctgcccgccaccaccgagatcctgagctggaagaaggccatcgagagcggcatcctggacagagacctggccaacaacctgaagagcatctgcatccccgacgtgatgccccacatgcagctggccgacagcgccgagcagaacatcaaccccggcgccgccgtgctgccctgcagcaagagccaccccaaggccaccgccagccagagcgagaacctgctgttccagctgatgacccacagctacatcaacgtgcagaacggccagagactgctgctgctggacaaggagctgatggagaccctgaccagcagagacgagtaccagaccagcccccccaaggtggtggagatcggccaccagagacagaagacccccgagggcctgcaggagagcgccaacgtgaagatcagcggcaccttcagcagcggctggaccgtgagactgcccgagttccagttcagcagccagaacaaggagtaccccgacagagaggactgcaccaccgagaagggcaagaagaccaccgtggagaccgaggacagcagcgtggagaaccccgagcaggacctgttcgtggagcagaaggagagaaaccccaacatcgacgccctgaaggtgatcaacaaggtgaagctggaggtgcagagacagctgatcggcacccagagagaggaccagaccgccgtgagcgtgagagagaacgccagcagaggccacctgctgaccatcccccccgccgaggccgagggcgtgcccctggtggtggacaaggacgtgttcagcgtggagacccccaagaaggagcaccagcccctgagaaacaccagcttcacctgccagaacgagcaggcccacaccctggagaccgagtacatccacgacgagaccggcggcagccacatcaagccccagagcaagaagctgcaggtgcaggtgaagaagaccctgggcatcaagctggagctgaagagcgagaccgacggcaacgtgcaccccctggacaagaaggagatgctgaagaagaccttcctggccaaggacgaccacaaggagagccaggaggcccagaacatcgccggcggcagcatgatgatgagcgagaagaccgacgaggaggacagcggcagagagatcttcctgagctgcagccaccccctggagctgctggaggaggccaccctgaacgtgctgagcgcccagctgctggacggcggcatcttccacgagcagaccggccagaagctgctgctgaacgaggccatcagcagaggcatcgtgcccagccacaccgccgtgaagctgatggagaagctgaacatgttccagggcttcttcgacagccagacctgcgagagcctgaccaccgaggaggtgatcaacgagggcctgatggacgagaagctgctgcacaacgtgctgatggccgacaaggccatcagcggcgtgctggaccccagaacccagaccctgtgcagcgtgaaggacgccgtgaccgtgggcctgctggacaaggagaccgccaccagaatcctggagagacaggtggtgaccggcggcatcatcgacctgaagagaggcaagaaggtgagcgtgaccctggccagcaccctgggcctggtggacgtggccgaccagcccgagctgatcaacctggagaaggccagcaagggcagagacgccgagaagaccgtgagagagagactgatcagcctgcagatggagaccaccggcctgatcgaccccgacagcaaggcccccctgaccgtggtgcagagcatcgacagaggcctgctggagagagaggaggccgtgagactgctgaccaagcaggtggtggacggcggcatcatccaccacatcagcggcatgagactgagcgtggacaacgccttcagacacggcctgatcggcgaggacctggccgagaagctgaagagagtggagaacctgaacatccaccagatcttcaaccccgagaccaaggagaacatcagcctgcccaaggccatcaagctggacctgatcaccagcgacctgaagagagagatccaggaggtgcaggccttcaccggcaacttcgtggacctgatcagcggccagagactgaccctggccgaggccaagaaggagggcctgctgaccaacgaggccgtgctgagccccggcatgatgcacggcatcgtggaccccgagaactgcagaatcgtgccctacagcgagctggtgaagaagtgcaagatcgacatcgagagcggccagagatacctggaggtgatccccttcagcgacatcaaggacggcgtgagcgacaaggtgctgaccctgagccaggccatccagctgggcaaggtggacttcgccagcaccctgaaggtgctggaggcccaggccaacaccggcggcatcatcgacaccgccaccggcaagagactgaccctggccagcgccctggaggagaagctggtggacgagaacatggtgagaatcatcgccagccaccaggtgctgaacggcggcatcgtggacatcttcagcgaccagagagtgaccctggtggaggccatcgagaagagactgatcagccccgagctggccaacatgatccagatcgacagcagcgagttcagcgaccacagagcccagatcgagaagcaggagggcatcgaggtgtgcgccctgcagaacgagttcctgggcaaggacatgctgatcgcctgcaaccagaccgccgagatgagctgcaacaaggtggaggagagcgagagactgttccaggtggagaaccagagcgcccaggagaaggtgaaggtgagagtgagcgacggcgagcaggccaagaagagcagagagatcagcctgaaggagttcggctgcaaggaccagagaaagcccagaatgagcagcgacgccaaggagttcatcagcatcatcaacccccacaacctgaagggcaagagcctgggccaggtgagcctgacccacccctacagcgagtgcgacttcaagctgaaggaggtggccagaaacaacatgggcaacgacaccaacgaggagcaggagaaggccgtgaccaagatcgagatcatcagccacatgaagcagagcaccagctgcctggacagcgaggagatcagagagaaccagggcgaggtgatcctggaggtgcaggagacctactgcgagaccagcggcaagctgcccagcgagcaggtgctgcagcagcccatgaacgccagagtgaagagcaagagagagaagagagaggtgatcgtggaggagagcatcagaacctgcaagcccgccttcctgagcgaggagaagctgtaccaggagaccgccatcagagacgagcacgacagccacatcaagagccagcccagagagatgaccagcagcgagaagggcaaggaggccgacaccgagatgggcttcagcatcaccttcaagatcgaggagagcagcagccaggtggtgccccagggcatcagcgtgaagcacctggacgccctgaccctgttcagcagcaagcaggccaacgagggcaaggtgaacaacctgagcctgtgcctgaccctgaagcccgaggagaacctgagcagagagatcgcctgcggcgcccagagcgagcccttcccctgcatgacccccagacccgagggcctgcactaccaggagagcgacggcaaggcccaggtgaccggccccagccagatcagcaagaccgacaagagcttccagggcaccaccagacaggagaccaactaccaggacagctgggtgaccagcaagaccaaggagaccaagcaccagatcagcagcagcaacgagtgcaaggagaagagctaccaggaggtgagcttcgaccccgccagaggcctgaagctggaggagatcaccgtgagcagacccgacagcaaggaggtgagatacctggagttcagcgacagaaaggacctgcaccaccagggcagcaagagcgacgacaagctgtgcggcaccctgaagagcgagatcgccacccaggagctgaccggcgagaagttcctggagatggccaaccccaacgtggccggcctggaggccggcagcatcgaggacatcgtgacccagagaggcagcagagtgctgggcagcttcctgcccgagaagctgttcaagggcgtgagccagaaggagaacaccggccagcagaacgccatcatcagccccaccgtgctggagaccagcgaggagaagaccgtgagcctgaccgtgtgcagcgccgtgaagaccgagaagaccccccaggagaagctgagagagagccccggcagcgagcagacccccttcatgaccgcccccgagggcaagggcaacggcggcgtgaaccccgagcccttcagagccacccagaacgtgttcaccagacagctgtgcctggagcacgacgagaagctggtgagctacctgagcctgctgagaaacatcgagatgagaaccaagcagatccagcccctggagctgaacctggccgagctgcaggacctgctgtgccaggccaaggtgctggagagagagctgaaggacctgaccaccctggtgagccaggagctggagtgcgtgaaccagatcatcatcagccagccccaggaggtgcccgcccagctgctgaaggccctggagaaggacgccaagaacctgcagaagagcctgagcagcgtgagcgacacctggaacagcagactgctgcacttccagaacgccgtggagatcgagaagaccaaggtgctgaaccagcacacccagctggagggcagactgcaggacctgagagcctgggtgggcaacaagaacctgatcctgaacagcaagggcagcaacagcgagatcgacgtggacagcctgaacctgtgcctgcagcagtacgaggacctgaagcagcccatggccgagagaaaggcccagctggacgccctggccttcgacatccagttcttcatcagcgagcacgcccaggacctgagcccccagcagaacagacagatgctgagactgctgaacgagctgcagagaagcttccaggacatcctggagcagaccgccgcccaggtggacgccctgcagggccacctgcagcagatggagcaggaggccctggtgaagaccctgcagaagcagcagaacacctgccaccagcagctggaggacctgtgcagctgggtgggccaggccgagagagccctggccggccaccagggcagaaccacccagcaggacctgagcgccctgcagaagaaccagagcgacctgaaggacctgcaggacgacatccagaacagagccaccagcttcgccaccgtggtgaaggacatcgagggcttcatggaggagaaccagaccaagctgagccccagagagctgaccgccctgagagagaagctgcaccaggccaaggagcagtacgaggccctgcaggaggagaccagagtggcccagaaggagctggaggaggccgtgaccagcgccctgcagcaggagaccgagaagagcaaggccgccaaggagctggccgagaacaagaagaagatcgacgccctgctggactgggtgaccagcgtgggcagcagcggcggccagctgctgaccaacctgcccggcatggagcagctgagcggcgccagcctggagaagggcgccctggacaccaccgacggctacatgggcgtgaaccaggcccccgagaagctggacaagcagtgcgagatgatgaaggccagacaccaggagctgctgagccagcagcagaacttcatcctggccacccagagcgcccaggccttcctggaccagcacggccacaacctgacccccgaggagcagcagatgctgcagcagaagctgggcgagctgaaggagcagtacagcaccagcctggcccagagcgaggccgagctgaagcaggtgcagaccctgcaggacgagctgcagaagttcctgcaggaccacaaggagttcgagagctggctggagagaagcgagaaggagctggagaacatgcacaagggcggcagcagccccgagaccctgcccagcctgctgaagagacagggcagcttcagcgaggacgtgatcagccacaagggcgacctgagattcgtgaccatcagcggccagaaggtgctggacatggagaacagcttcaaggagggcaaggagcccagcgagatcggcaacctggtgaaggacaagctgaaggacgccaccgagagatacaccgccctgcacagcaagtgcaccagactgggcagccacctgaacatgctgctgggccagtaccaccagttccagaacagcgccgacagcctgcaggcctggatgcaggcctgcgaggccaacgtggagaagctgctgagcgacaccgtggccagcgaccccggcgtgctgcaggagcagctggccaccaccaagcagctgcaggaggagctggccgagcaccaggtgcccgtggagaagctgcagaaggtggccagagacatcatggagatcgagggcgagcccgcccccgaccacagacacgtgcaggagaccaccgacagcatcctgagccacttccagagcctgagctacagcctggccgagagaagcagcctgctgcagaaggccatcgcccagagccagagcgtgcaggagagcctggagagcctgctgcagagcatcggcgaggtggagcagaacctggagggcaagcaggtgagcagcctgagcagcggcgtgatccaggaggccctggccaccaacatgaagctgaagcaggacatcgccagacagaagagcagcctggaggccaccagagagatggtgaccagattcatggagaccgccgacagcaccaccgccgccgtgctgcagggcaagctggccgaggtgagccagagattcgagcagctgtgcctgcagcagcaggagaaggagagcagcctgaagaagctgctgccccaggccgagatgttcgagcacctgagcggcaagctgcagcagttcatggagaacaagagcagaatgctggccagcggcaaccagcccgaccaggacatcacccacttcttccagcagatccaggagctgaacctggagatggaggaccagcaggagaacctggacaccctggagcacctggtgaccgagctgagcagctgcggcttcgccctggacctgtgccagcaccaggacagagtgcagaacctgagaaaggacttcaccgagctgcagaagaccgtgaaggagagagagaaggacgccagcagctgccaggagcagctggacgagttcagaaagctggtgagaaccttccagaagtggctgaaggagaccgagggcagcatcccccccaccgagaccagcatgagcgccaaggagctggagaagcagatcgagcacctgaagagcctgctggacgactgggccagcaagggcaccctggtggaggagatcaactgcaagggcaccagcctggagaacctgatcatggagatcaccgcccccgacagccagggcaagaccggcagcatcctgcccagcgtgggcagcagcgtgggcagcgtgaacggctaccacacctgcaaggacctgaccgagatccagtgcgacatgagcgacgtgaacctgaagtacgagaagctgggcggcgtgctgcacgagagacaggagagcctgcaggccatcctgaacagaatggaggaggtgcacaaggaggccaacagcgtgctgcagtggctggagagcaaggaggaggtgctgaagagcatggacgccatgagcagccccaccaagaccgagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagcagatgggagagagccaccgaggtgaccgtggccagacagagacagctggaggagagcgccagccacctggcctgcttccaggccgccgagagccagctgagaccctggctgatggagaaggagctgatgatgggcgtgctgggccccctgagcatcgaccccaacatgctgaacgcccagaagcagcaggtgcagttcatgctgaaggagttcgaggccagaagacagcagcacgagcagctgaacgaggccgcccagggcatcctgaccggccccggcgacgtgagcctgagcaccagccaggtgcagaaggagctgcagagcatcaaccagaagtgggtggagctgaccgacaagctgaacagcagaagcagccagatcgaccaggccatcgtgaagagcacccagtaccaggagctgctgcaggacctgagcgagaaggtgagagccgtgggccagagactgagcgtgcagagcgccatcagcacccagcccgaggccgtgaagcagcagctggaggagaccagcgagatcagaagcgacctggagcagctggaccacgaggtgaaggaggcccagaccctgtgcgacgagctgagcgtgctgatcggcgagcagtacctgaaggacgagctgaagaagagactggagaccgtggccctgcccctgcagggcctggaggacctggccgccgacagaatcaacagactgcaggccgccctggccagcacccagcagttccagcagatgttcgacgagctgagaacctggctggacgacaagcagagccagcaggccaagaactgccccatcagcgccaagctggagagactgcagagccagctgcaggagaacgaggagttccagaagagcctgaaccagcacagcggcagctacgaggtgatcgtggccgagggcgagagcctgctgctgagcgtgccccccggcgaggagaagagaaccctgcagaaccagctggtggagctgaagaaccactgggaggagctgagcaagaagaccgccgacagacagagcagactgaaggactgcatgcagaaggcccagaagtaccagtggcacgtggaggacctggtgccctggatcgaggactgcaaggccaagatgagcgagctgagagtgaccctggaccccgtgcagctggagagcagcctgctgagaagcaaggccatgctgaacgaggtggagaagagaagaagcctgctggagatcctgaacagcgccgccgacatcctgatcaacagcagcgaggccgacgaggacggcatcagagacgagaaggccggcatcaaccagaacatggacgccgtgaccgaggagctgcaggccaagaccggcagcctggaggagatgacccagagactgagagagttccaggagagcttcaagaacatcgagaagaaggtggagggcgccaagcaccagctggagatcttcgacgccctgggcagccaggcctgcagcaacaagaacctggagaagctgagagcccagcaggaggtgctgcaggccctggagccccaggtggactacctgagaaacttcacccagggcctggtggaggacgcccccgacggcagcgacgccagccagctgctgcaccaggccgaggtggcccagcaggagttcctggaggtgaagcagagagtgaacagcggctgcgtgatgatggagaacaagctggagggcatcggccagttccactgcagagtgagagagatgttcagccagctggccgacctggacgacgagctggacggcatgggcgccatcggcagagacaccgacagcctgcagagccagatcgaggacgtgagactgttcctgaacaagatccacgtgctgaagctggacatcgaggccagcgaggccgagtgcagacacatgctggaggaggagggcaccctggacctgctgggcctgaagagagagctggaggccctgaacaagcagtgcggcaagctgaccgagagaggcaaggccagacaggagcagctggagctgaccctgggcagagtggaggacttctacagaaagctgaagggcctgaacgacgccaccaccgccgccgaggaggccgaggccctgcagtgggtggtgggcaccgaggtggagatcatcaaccagcagctggccgacttcaagatgttccagaaggagcaggtggaccccctgcagatgaagctgcagcaggtgaacggcctgggccagggcctgatccagagcgccggcaaggactgcgacgtgcagggcctggagcacgacatggaggagatcaacgccagatggaacaccctgaacaagaaggtggcccagagaatcgcccagctgcaggaggccctgctgcactgcggcaagttccaggacgccctggagcccctgctgagctggctggccgacaccgaggagctgatcgccaaccagaagccccccagcgccgagtacaaggtggtgaaggcccagatccaggagcagaagctgctgcagagactgctggacgacagaaaggccaccgtggacatgctgcaggccgagggcggcagaatcgcccagagcgccgagctggccgacagagagaagatcaccggccagctggagagcctggagagcagatggaccgagctgctgagcaaggccgccgccagacagaagcagctggaggacatcctggtgctggccaagcagttccacgagaccgccgagcccatcagcgacttcctgagcgtgaccgagaagaagctggccaacagcgagcccgtgggcacccagaccgccaagatccagcagcagatcatcagacacaaggccctggaggaggacatcgagaaccacgccaccgacgtgcaccaggccgtgaagatcggccagagcctgagcagcctgaccagccccgccgagcagggcgtgctgagcgagaagatcgacagcctgcaggccagatacagcgagatccaggacagatgctgcagaaaggccgccctgctggaccaggccctgagcaacgccagactgttcggcgaggacgaggtggaggtgctgaactggctggccgaggtggaggacaagctgagcagcgtgttcgtgaaggacttcaagcaggacgtgctgcacagacagcacgccgaccacctggccctgaacgaggagatcgtgaacagaaagaagaacgtggaccaggccatcaagaacggccaggccctgctgaagcagaccaccggcgaggaggtgctgctgatccaggagaagctggacggcatcaagaccagatacgccgacatcaccgtgaccagcagcaaggccctgagaaccctggagcaggccagacagctggccaccaagttccagagcacctacgaggagctgaccggctggctgagagaggtggaggaggagctggccaccagcggcggccagagccccaccggcgagcagatcccccagttccagcagagacagaaggagctgaagaaggaggtgatggagcacagactggtgctggacaccgtgaacgaggtgagcagagccctgctggagctggtgccctggagagccagagagggcctggacaagctggtgagcgacgccaacgagcagtacaagctggtgagcgacaccatcggccagagagtggacgagatcgacgccgccatccagagaagccagcagtacgagcaggccgccgacgccgagctggcctgggtggccgagaccaagagaaagctgatggccctgggccccatcagactggagcaggaccagaccaccgcccagctgcaggtgcagaaggccttcagcatcgacatcatcagacacaaggacagcatggacgagctgttcagccacagaagcgagatcttcggcacctgcggcgaggagcagaagaccgtgctgcaggagaagaccgagagcctgatccagcagtacgaggccatcagcctgctgaacagcgagagatacgccagactggagagagcccaggtgctggtgaaccagttctgggagacctacgaggagctgagcccctggatcgaggagaccagagccctgatcgcccagctgcccagccccgccatcgaccacgagcagctgagacagcagcaggaggagatgagacagctgagagagagcatcgccgagcacaagccccacatcgacaagctgctgaagatcggcccccagctgaaggagctgaaccccgaggagggcgagatggtggaggagaagtaccagaaggccgagaacatgtacgcccagatcaaggaggaggtgagacagagagccctggccctggacgaggccgtgagccagagcacccagatcaccgagttccacgacaagatcgagcccatgctggagaccctggagaacctgagcagcagactgagaatgccccccctgatccccgccgaggtggacaagatcagagagtgcatcagcgacaacaagagcgccaccgtggagctggagaagctgcagcccagcttcgaggccctgaagagaagaggcgaggagctgatcggcagaagccagggcgccgacaaggacctggccgccaaggagatccaggacaagctggaccagatggtgttcttctgggaggacatcaaggccagagccgaggagagagagatcaagttcctggacgtgctggagctggccgagaagttctggtacgacatggccgccctgctgaccaccatcaaggacacccaggacatcgtgcacgacctggagagccccggcatcgaccccagcatcatcaagcagcaggtggaggccgccgagaccatcaaggaggagaccgacggcctgcacgaggagctggagttcatcagaatcctgggcgccgacctgatcttcgcctgcggcgagaccgagaagcccgaggtgagaaagagcatcgacgagatgaacaacgcctgggagaacctgaacaagacctggaaggagagactggagaagctggaggacgccatgcaggccgccgtgcagtaccaggacaccctgcaggccatgttcgactggctggacaacaccgtgatcaagctgtgcaccatgccccccgtgggcaccgacctgaacaccgtgaaggaccagctgaacgagatgaaggagttcaaggtggaggtgtaccagcagcagatcgagatggagaagctgaaccaccagggcgagctgatgctgaagaaggccaccgacgagaccgacagagacatcatcagagagcccctgaccgagctgaagcacctgtgggagaacctgggcgagaagatcgcccacagacagcacaagctggagggcgccctgctggccctgggccagttccagcacgccctggaggagctgatgagctggctgacccacaccgaggagctgctggacgcccagagacccatcagcggcgaccccaaggtgatcgaggtggagctggccaagcaccacgtgctgaagaacgacgtgctggcccaccaggccaccgtggagaccgtgaacaaggccggcaacgagctgctggagagcagcgccggcgacgacgccagcagcctgagaagcagactggaggccatgaaccagtgctgggagagcgtgctgcagaagaccgaggagagagagcagcagctgcagagcaccctgcagcaggcccagggcttccacagcgagatcgaggacttcctgctggagctgaccagaatggagagccagctgagcgccagcaagcccaccggcggcctgcccgagaccgccagagagcagctggacacccacatggagctgtacagccagctgaaggccaaggaggagacctacaaccagctgctggacaagggcagactgatgctgctgagcagagacgacagcggcagcggcagcaagaccgagcagagcgtggccctgctggagcagaagtggcacgtggtgagcagcaagatggaggagagaaagagcaagctggaggaggccctgaacctggccaccgagttccagaacagcctgcaggagttcatcaactggctgaccctggccgagcagagcctgaacatcgccagcccccccagcctgatcctgaacaccgtgctgagccagatcgaggagcacaaggtgttcgccaacgaggtgaacgcccacagagaccagatcatcgagctggaccagaccggcaaccagctgaagttcctgagccagaagcaggacgtggtgctgatcaagaacctgctggtgagcgtgcagagcagatgggagaaggtggtgcagagaagcatcgagagaggcagaagcctggacgacgccagaaagagagccaagcagttccacgaggcctggaagaagctgatcgactggctggaggacgccgagagccacctggacagcgagctggagatcagcaacgaccccgacaagatcaagctgcagctgagcaagcacaaggagttccagaagaccctgggcggcaagcagcccgtgtacgacaccaccatcagaaccggcagagccctgaaggagaagaccctgctgcccgaggacagccagaagctggacaacttcctgggcgaggtgagagacaagtgggacaccgtgtgcggcaagagcgtggagagacagcacaagctggaggaggccctgctgttcagcggccagttcatggacgccctgcaggccctggtggactggctgtacaaggtggagccccagctggccgaggaccagcccgtgcacggcgacctggacctggtgatgaacctgatggacgcccacaaggtgttccagaaggagctgggcaagagaaccggcaccgtgcaggtgctgaagagaagcggcagagagctgatcgagaacagcagagacgacaccacctgggtgaagggccagctgcaggagctgagcaccagatgggacaccgtgtgcaagctgagcgtgagcaagcagagcagactggagcaggccctgaagcaggccgaggtgttcagagacaccgtgcacatgctgctggagtggctgagcgaggccgagcagaccctgagattcagaggcgccctgcccgacgacaccgaggccctgcagagcctgatcgacacccacaaggagttcatgaagaaggtggaggagaagagagtggacgtgaacagcgccgtggccatgggcgaggtgatcctggccgtgtgccaccccgactgcatcaccaccatcaagcactggatcaccatcatcagagccagattcgaggaggtgctgacctgggccaagcagcaccagcagagactggagaccgccctgagcgagctggtggccaacgccgagctgctggaggagctgctggcctggatccagtgggccgagaccaccctgatccagagagaccaggagcccatcccccagaacatcgacagagtgaaggccctgatcgccgagcaccagaccttcatggaggagatgaccagaaagcagcccgacgtggacagagtgaccaagacctacaagagaaagaacatcgagcccacccacgcccccttcatcgagaagagcagaagcggcggcagaaagagcctgagccagcccacccccccccccatgcccatcctgagccagagcgaggccaagaaccccagaatcaaccagctgagcgccagatggcagcaggtgtggctgctggccctggagagacagagaaagctgaacgacgccctggacagactggaggagctgaaggagttcgccaacttcgacttcgacgtgtggagaaagaagtacatgagatggatgaaccacaagaagagcagagtgatggacttcttcagaagaatcgacaaggaccaggacggcaagatcaccagacaggagttcatcgacggcatcctggccagcaagttccccaccaccaagctggagatgaccgccgtggccgacatcttcgacagagacggcgacggctacatcgactactacgagttcgtggccgccctgcaccccaacaaggacgcctacagacccaccaccgacgccgacaagatcgaggacgaggtgaccagacaggtggcccagtgcaagtgcgccaagagattccaggtggagcagatcggcgagaacaagtacagattcttcctgggcaaccagttcggcgacagccagcagctgagactggtgagaatcctgagaagcaccgtgatggtgagagtgggcggcggctggatggccctggacgagttcctggtgaagaacgacccctgcagagccagaggcagaaccaacatcgagctgagagagaagttcatcctgcccgagggcgccagccagggcatgacccccttcagaagcagaggcagaagaagcaagcccagcagcagagccgccagccccaccagaagcagcagcagcgccagccagagcaaccacagctgcaccagcatgcccagcagccccgccacccccgccagcggcaccaaggtgatccccagcagcggcagcaagctgaagagacccacccccaccttccacagcagcagaaccagcctggccggcgacaccagcaacagcagcagccccgccagcaccggcgccaagaccaacagagccgaccccaagaagagcgccagcagacccggcagcagagccggcagcagagccggcagcagagccagcagcagaagaggcagcgacgccagcgacttcgacctgctggagacccagagcgcctgcagcgacaccagcgagagcagcgccgccggcggccagggcaacagcagaagaggcctgaacaagcccagcaagatccccaccatgagcaagaagaccaccaccgccagccccagaacccccggccccaagagatag

SEQ ID NO: 88948 - DNA, 16293 bp, Artificial Sequence
  Description of Artificial Sequence: Synthetic coding sequence
atgagcagcagcgacgaggagaccctgagcgagagaagctgcagaagcgagagaagctgcagaagcgagagaagctacagaagcgagagaagcggcagcctgagcccctgcccccccggcgacaccctgccctggaacctgcccctgcacgagcagaagaagagaaagagccaggacagcgtgctggaccccgccgagagagccgtggtgagagtggccgacgagagagacagagtgcagaagaagaccttcaccaagtgggtgaacaagcacctgatgaaggtgagaaagcacatcaacgacctgtacgaggacctgagagacggccacaacctgatcagcctgctggaggtgctgagcggcatcaagctgcccagagagaagggcagaatgagattccacagactgcagaacgtgcagatcgccctggacttcctgaagcagagacaggtgaagctggtgaacatcagaaacgacgacatcaccgacggcaaccccaagctgaccctgggcctgatctggaccatcatcctgcacttccagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagacccgacctggtggacatggagagagtgcagatccagagcaacagagagaacctggagcaggccttcgaggtggccgagagactgggcgtgaccagactgctggacgccgaggacgtggacgtgcccagccccgacgagaagagcgtgatcacctacgtgagcagcatctacgacgccttccccaaggtgcccgagggcggcgagggcatcagcgccaccgaggtggacagcagatggcaggagtaccagagcagagtggacagcctgatcccctggatcaagcagcacaccatcctgatgagcgacaagaccttcccccagaaccccgtggagctgaaggccctgtacaaccagtacatccacttcaaggagaccgagatcctggccaaggagagagagaagggcagaatcgaggagctgtacaagctgctggaggtgtggatcgagttcggcagaatcaagctgccccagggctaccaccccaacgacgtggaggaggagtggggcaagctgatcatcgagatgctggagagagagaagagcctgagacccgccgtggagagactggagctgctgctgcagatcgccaacaagatccagaacggcgccctgaactgcgaggagaagctgaccctggccaagaacaccctgcaggccgacgccgcccacctggagagcggccagcccgtgcagtgcgagagcgacgtgatcatgtacatccaggagtgcgagggcctgatcagacagctgcaggtggacctgcagatcctgagagacgagaactactaccagctggaggagctggccttcagagtgatgagactgcaggacgagctggtgaccctgagactggagtgcaccaacctgtacagaaagggccacttcaccagcctggagctggtgccccccagcaccctgaccaccacccacctgaaggccgagcccctgaccaaggccacccacagcagcagcaccagctggttcagaaagcccatgaccagagccgagctggtggccatcagcagcagcgaggacgagggcaacctgagattcgtgtacgagctgctgagctgggtggaggagatgcagatgaagctggagagagccgagtggggcaacgacctgcccagcgtggagctgcagctggagacccagcagcacatccacaccagcgtggaggagctgggcagcagcgtgaaggaggccagactgtacgagggcaagatgagccagaacttccacaccagctacgccgagaccctgggcaagctggagacccagtactgcaagctgaaggagaccagcagcttcagaatgagacacctgcagagcctgcacaagttcgtgagcagagccaccgccgagctgatctggctgaacgagaaggaggaggaggagctggcctacgactggagcgacaacaacagcaacatcagcgccaagagaaactacttcagcgagctgaccatggagctggaggagaagcaggacgtgttcagaagcctgcaggacaccgccgagctgctgagcctggagaaccaccccgccaagcagaccgtggaggcctacagcgccgccgtgcagagccagctgcagtggatgaagcagctgtgcctgtgcgtggagcagcacgtgaaggagaacaccgcctacttccagttcttcagcgacgccagagagctggagagcttcctgagaaacctgcaggacagcatcaagagaaagtacagctgcgaccacaacaccagcctgagcagactggaggacctgctgcaggacagcatggacgagaaggagcagctgatccagagcaagagcagcgtggccagcctggtgggcagaagcaagaccatcgtgcagctgaagcccagaagccccgaccacgtgctgaagaacaccatcagcgtgaaggccgtgtgcgactacagacagatcgagatcaccatctgcaagaacgacgagtgcgtgctggaggacaacagccagagaaccaagtggaaggtgatcagccccaccggcaacgaggccatggtgcccagcgtgtgcttcctgatccccccccccaacaaggacgccatcgagatggccagcagagtggagcagagctaccagaaggtgatggccctgtggcaccagctgcacgtgaacaccaagagcctgatcagctggaactacctgagaaaggacctggacctggtgcagacctggaacctggagaagctgagaagcagcgcccccggcgagtgccaccagatcatgaagaacctgcaggcccactacgaggacttcctgcaggacagcagagacagcgtgctgttcagcgtggccgacagactgagactggaggaggaggtggaggcctgcaaggccagattccagcacctgatgaagagcatggagaacgaggacaaggaggagaccgtggccaagatgtacatcagcgagctgaagaacatcagactgagactggaggagtacgagcagagagtggtgaagagaatccagagcctggccagcagcagaaccgacagagacgcctggcaggacaacgccctgagaatcgccgagcaggagcacacccaggaggacctgcagcagctgagaagcgacctggacgccgtgagcatgaagtgcgacagcttcctgcaccagagccccagcagcagcagcgtgcccaccctgagaagcgagctgaacctgctggtggagaagatggaccacgtgtacggcctgagcaccgtgtacctgaacaagctgaagaccgtggacgtgatcgtgagaagcatccaggacgccgagctgctggtgaagggctacgagatcaagctgagccaggaggaggtggtgctggccgacctgagcgccctggaggcccactggagcaccctgagacactggctgagcgacgtgaaggacaagaacagcgtgttcagcgtgctggacgaggagatcgccaaggccaaggtggtggccgagcagatgagcagactgacccccgagagaaacctggacctggagagataccaggagaagggcagccagctgcaggagagatggcacagagtgatcgcccagctggagatcagacagagcgagctggagagcatccaggaggtgctgggcgactacagagcctgccacggcaccctgatcaagtggatcgaggagaccaccgcccagcaggagatgatgaagcccggccaggccgaggacagcagagtgctgagcgagcagctgagccagcagaccgccctgttcgccgagatcgagagaaaccagaccaagctggaccagtgccagaagttcagccagcagtacagcaccatcgtgaaggactacgagctgcagctgatgacctacaaggccttcgtggagagccagcagaagagccccggcaagagaagaagaatgctgagcagcagcgacgccatcacccaggagttcatggacctgagaaccagatacaccgccctggtgaccctgaccacccagcacgtgaagtacatcagcgacgccctgagaagactggaggaggaggagaaggtggtggaggaggagaagcaggagcacgtggagaaggtgaaggagctgctgggctgggtgagcaccctggccagaaacacccagggcaaggccaccagcagcgagaccaaggagagcaccgacatcgagaaggccatcctggagcagcaggtgctgagcgaggagctgaccaccaagaaggagcaggtgagcgaggccatcaagaccagccagatcttcctggccaagcacggccacaagctgagcgagaaggagaagaagcagatcagcgagcagctgaacgccctgaacaaggcctaccacgacctgtgcgacggcagcgccaaccagctgcagcagctgcagagccagctggcccaccagaccgagcagaagaccctgcagaagcagcagaacacctgccaccagcagctggaggacctgtgcagctgggtgggccaggccgagagagccctggccggccaccagggcagaaccacccagcaggacctgagcgccctgcagaagaaccagagcgacctgaaggacctgcaggacgacatccagaacagagccaccagcttcgccaccgtggtgaaggacatcgagggcttcatggaggagaaccagaccaagctgagccccagagagctgaccgccctgagagagaagctgcaccaggccaaggagcagtacgaggccctgcaggaggagaccagagtggcccagaaggagctggaggaggccgtgaccagcgccctgcagcaggagaccgagaagagcaaggccgccaaggagctggccgagaacaagaagaagatcgacgccctgctggactgggtgaccagcgtgggcagcagcggcggccagctgctgaccaacctgcccggcatggagcagctgagcggcgccagcctggagaagggcgccctggacaccaccgacggctacatgggcgtgaaccaggcccccgagaagctggacaagcagtgcgagatgatgaaggccagacaccaggagctgctgagccagcagcagaacttcatcctggccacccagagcgcccaggccttcctggaccagcacggccacaacctgacccccgaggagcagcagatgctgcagcagaagctgggcgagctgaaggagcagtacagcaccagcctggcccagagcgaggccgagctgaagcaggtgcagaccctgcaggacgagctgcagaagttcctgcaggaccacaaggagttcgagagctggctggagagaagcgagaaggagctggagaacatgcacaagggcggcagcagccccgagaccctgcccagcctgctgaagagacagggcagcttcagcgaggacgtgatcagccacaagggcgacctgagattcgtgaccatcagcggccagaaggtgctggacatggagaacagcttcaaggagggcaaggagcccagcgagatcggcaacctggtgaaggacaagctgaaggacgccaccgagagatacaccgccctgcacagcaagtgcaccagactgggcagccacctgaacatgctgctgggccagtaccaccagttccagaacagcgccgacagcctgcaggcctggatgcaggcctgcgaggccaacgtggagaagctgctgagcgacaccgtggccagcgaccccggcgtgctgcaggagcagctggccaccaccaagcagctgcaggaggagctggccgagcaccaggtgcccgtggagaagctgcagaaggtggccagagacatcatggagatcgagggcgagcccgcccccgaccacagacacgtgcaggagaccaccgacagcatcctgagccacttccagagcctgagctacagcctggccgagagaagcagcctgctgcagaaggccatcgcccagagccagagcgtgcaggagagcctggagagcctgctgcagagcatcggcgaggtggagcagaacctggagggcaagcaggtgagcagcctgagcagcggcgtgatccaggaggccctggccaccaacatgaagctgaagcaggacatcgccagacagaagagcagcctggaggccaccagagagatggtgaccagattcatggagaccgccgacagcaccaccgccgccgtgctgcagggcaagctggccgaggtgagccagagattcgagcagctgtgcctgcagcagcaggagaaggagagcagcctgaagaagctgctgccccaggccgagatgttcgagcacctgagcggcaagctgcagcagttcatggagaacaagagcagaatgctggccagcggcaaccagcccgaccaggacatcacccacttcttccagcagatccaggagctgaacctggagatggaggaccagcaggagaacctggacaccctggagcacctggtgaccgagctgagcagctgcggcttcgccctggacctgtgccagcaccaggacagagtgcagaacctgagaaaggacttcaccgagctgcagaagaccgtgaaggagagagagaaggacgccagcagctgccaggagcagctggacgagttcagaaagctggtgagaaccttccagaagtggctgaaggagaccgagggcagcatcccccccaccgagaccagcatgagcgccaaggagctggagaagcagatcgagcacctgaagagcctgctggacgactgggccagcaagggcaccctggtggaggagatcaactgcaagggcaccagcctggagaacctgatcatggagatcaccgcccccgacagccagggcaagaccggcagcatcctgcccagcgtgggcagcagcgtgggcagcgtgaacggctaccacacctgcaaggacctgaccgagatccagtgcgacatgagcgacgtgaacctgaagtacgagaagctgggcggcgtgctgcacgagagacaggagagcctgcaggccatcctgaacagaatggaggaggtgcacaaggaggccaacagcgtgctgcagtggctggagagcaaggaggaggtgctgaagagcatggacgccatgagcagccccaccaagaccgagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagcagatgggagagagccaccgaggtgaccgtggccagacagagacagctggaggagagcgccagccacctggcctgcttccaggccgccgagagccagctgagaccctggctgatggagaaggagctgatgatgggcgtgctgggccccctgagcatcgaccccaacatgctgaacgcccagaagcagcaggtgcagttcatgctgaaggagttcgaggccagaagacagcagcacgagcagctgaacgaggccgcccagggcatcctgaccggccccggcgacgtgagcctgagcaccagccaggtgcagaaggagctgcagagcatcaaccagaagtgggtggagctgaccgacaagctgaacagcagaagcagccagatcgaccaggccatcgtgaagagcacccagtaccaggagctgctgcaggacctgagcgagaaggtgagagccgtgggccagagactgagcgtgcagagcgccatcagcacccagcccgaggccgtgaagcagcagctggaggagaccagcgagatcagaagcgacctggagcagctggaccacgaggtgaaggaggcccagaccctgtgcgacgagctgagcgtgctgatcggcgagcagtacctgaaggacgagctgaagaagagactggagaccgtggccctgcccctgcagggcctggaggacctggccgccgacagaatcaacagactgcaggccgccctggccagcacccagcagttccagcagatgttcgacgagctgagaacctggctggacgacaagcagagccagcaggccaagaactgccccatcagcgccaagctggagagactgcagagccagctgcaggagaacgaggagttccagaagagcctgaaccagcacagcggcagctacgaggtgatcgtggccgagggcgagagcctgctgctgagcgtgccccccggcgaggagaagagaaccctgcagaaccagctggtggagctgaagaaccactgggaggagctgagcaagaagaccgccgacagacagagcagactgaaggactgcatgcagaaggcccagaagtaccagtggcacgtggaggacctggtgccctggatcgaggactgcaaggccaagatgagcgagctgagagtgaccctggaccccgtgcagctggagagcagcctgctgagaagcaaggccatgctgaacgaggtggagaagagaagaagcctgctggagatcctgaacagcgccgccgacatcctgatcaacagcagcgaggccgacgaggacggcatcagagacgagaaggccggcatcaaccagaacatggacgccgtgaccgaggagctgcaggccaagaccggcagcctggaggagatgacccagagactgagagagttccaggagagcttcaagaacatcgagaagaaggtggagggcgccaagcaccagctggagatcttcgacgccctgggcagccaggcctgcagcaacaagaacctggagaagctgagagcccagcaggaggtgctgcaggccctggagccccaggtggactacctgagaaacttcacccagggcctggtggaggacgcccccgacggcagcgacgccagccagctgctgcaccaggccgaggtggcccagcaggagttcctggaggtgaagcagagagtgaacagcggctgcgtgatgatggagaacaagctggagggcatcggccagttccactgcagagtgagagagatgttcagccagctggccgacctggacgacgagctggacggcatgggcgccatcggcagagacaccgacagcctgcagagccagatcgaggacgtgagactgttcctgaacaagatccacgtgctgaagctggacatcgaggccagcgaggccgagtgcagacacatgctggaggaggagggcaccctggacctgctgggcctgaagagagagctggaggccctgaacaagcagtgcggcaagctgaccgagagaggcaaggccagacaggagcagctggagctgaccctgggcagagtggaggacttctacagaaagctgaagggcctgaacgacgccaccaccgccgccgaggaggccgaggccctgcagtgggtggtgggcaccgaggtggagatcatcaaccagcagctggccgacttcaagatgttccagaaggagcaggtggaccccctgcagatgaagctgcagcaggtgaacggcctgggccagggcctgatccagagcgccggcaaggactgcgacgtgcagggcctggagcacgacatggaggagatcaacgccagatggaacaccctgaacaagaaggtggcccagagaatcgcccagctgcaggaggccctgctgcactgcggcaagttccaggacgccctggagcccctgctgagctggctggccgacaccgaggagctgatcgccaaccagaagccccccagcgccgagtacaaggtggtgaaggcccagatccaggagcagaagctgctgcagagactgctggacgacagaaaggccaccgtggacatgctgcaggccgagggcggcagaatcgcccagagcgccgagctggccgacagagagaagatcaccggccagctggagagcctggagagcagatggaccgagctgctgagcaaggccgccgccagacagaagcagctggaggacatcctggtgctggccaagcagttccacgagaccgccgagcccatcagcgacttcctgagcgtgaccgagaagaagctggccaacagcgagcccgtgggcacccagaccgccaagatccagcagcagatcatcagacacaaggccctggaggaggacatcgagaaccacgccaccgacgtgcaccaggccgtgaagatcggccagagcctgagcagcctgaccagccccgccgagcagggcgtgctgagcgagaagatcgacagcctgcaggccagatacagcgagatccaggacagatgctgcagaaaggccgccctgctggaccaggccctgagcaacgccagactgttcggcgaggacgaggtggaggtgctgaactggctggccgaggtggaggacaagctgagcagcgtgttcgtgaaggacttcaagcaggacgtgctgcacagacagcacgccgaccacctggccctgaacgaggagatcgtgaacagaaagaagaacgtggaccaggccatcaagaacggccaggccctgctgaagcagaccaccggcgaggaggtgctgctgatccaggagaagctggacggcatcaagaccagatacgccgacatcaccgtgaccagcagcaaggccctgagaaccctggagcaggccagacagctggccaccaagttccagagcacctacgaggagctgaccggctggctgagagaggtggaggaggagctggccaccagcggcggccagagccccaccggcgagcagatcccccagttccagcagagacagaaggagctgaagaaggaggtgatggagcacagactggtgctggacaccgtgaacgaggtgagcagagccctgctggagctggtgccctggagagccagagagggcctggacaagctggtgagcgacgccaacgagcagtacaagctggtgagcgacaccatcggccagagagtggacgagatcgacgccgccatccagagaagccagcagtacgagcaggccgccgacgccgagctggcctgggtggccgagaccaagagaaagctgatggccctgggccccatcagactggagcaggaccagaccaccgcccagctgcaggtgcagaaggccttcagcatcgacatcatcagacacaaggacagcatggacgagctgttcagccacagaagcgagatcttcggcacctgcggcgaggagcagaagaccgtgctgcaggagaagaccgagagcctgatccagcagtacgaggccatcagcctgctgaacagcgagagatacgccagactggagagagcccaggtgctggtgaaccagttctgggagacctacgaggagctgagcccctggatcgaggagaccagagccctgatcgcccagctgcccagccccgccatcgaccacgagcagctgagacagcagcaggaggagatgagacagctgagagagagcatcgccgagcacaagccccacatcgacaagctgctgaagatcggcccccagctgaaggagctgaaccccgaggagggcgagatggtggaggagaagtaccagaaggccgagaacatgtacgcccagatcaaggaggaggtgagacagagagccctggccctggacgaggccgtgagccagagcacccaggtgagccagttccacgacaagatcgagcccatgctggagaccctggagaacctgagcagcagactgagaatgccccccctgatccccgccgaggtggacaagatcagagagtgcatcagcgacaacaagagcgccaccgtggagctggagaagctgcagcccagcttcgaggccctgaagagaagaggcgaggagctgatcggcagaagccagggcgccgacaaggacctggccgccaaggagatccaggacaagctggaccagatggtgttcttctgggaggacatcaaggccagagccgaggagagagagatcaagttcctggacgtgctggagctggccgagaagttctggtacgacatggccgccctgctgaccaccatcaaggacacccaggacatcgtgcacgacctggagagccccggcatcgaccccagcatcatcaagcagcaggtggaggccgccgagaccatcaaggaggagaccgacggcctgcacgaggagctggagttcatcagaatcctgggcgccgacctgatcttcgcctgcggcgagaccgagaagcccgaggtgagaaagagcatcgacgagatgaacaacgcctgggagaacctgaacaagacctggaaggagagactggagaagctggaggacgccatgcaggccgccgtgcagtaccaggacaccctgcaggccatgttcgactggctggacaacaccgtgatcaagctgtgcaccatgccccccgtgggcaccgacctgaacaccgtgaaggaccagctgaacgagatgaaggagttcaaggtggaggtgtaccagcagcagatcgagatggagaagctgaaccaccagggcgagctgatgctgaagaaggccaccgacgagaccgacagagacatcatcagagagcccctgaccgagctgaagcacctgtgggagaacctgggcgagaagatcgcccacagacagcacaagctggagggcgccctgctggccctgggccagttccagcacgccctggaggagctgatgagctggctgacccacaccgaggagctgctggacgcccagagacccatcagcggcgaccccaaggtgatcgaggtggagctggccaagcaccacgtgctgaagaacgacgtgctggcccaccaggccaccgtggagaccgtgaacaaggccggcaacgagctgctggagagcagcgccggcgacgacgccagcagcctgagaagcagactggaggccatgaaccagtgctgggagagcgtgctgcagaagaccgaggagagagagcagcagctgcagagcaccctgcagcaggcccagggcttccacagcgagatcgaggacttcctgctggagctgaccagaatggagagccagctgagcgccagcaagcccaccggcggcctgcccgagaccgccagagagcagctggacacccacatggagctgtacagccagctgaaggccaaggaggagacctacaaccagctgctggacaagggcagactgatgctgctgagcagagacgacagcggcagcggcagcaagaccgagcagagcgtggccctgctggagcagaagtggcacgtggtgagcagcaagatggaggagagaaagagcaagctggaggaggccctgaacctggccaccgagttccagaacagcctgcaggagttcatcaactggctgaccctggccgagcagagcctgaacatcgccagcccccccagcctgatcctgaacaccgtgctgagccagatcgaggagcacaaggtgttcgccaacgaggtgaacgcccacagagaccagatcatcgagctggaccagaccggcaaccagctgaagttcctgagccagaagcaggacgtggtgctgatcaagaacctgctggtgagcgtgcagagcagatgggagaaggtggtgcagagaagcatcgagagaggcagaagcctggacgacgccagaaagagagccaagcagttccacgaggcctggaagaagctgatcgactggctggaggacgccgagagccacctggacagcgagctggagatcagcaacgaccccgacaagatcaagctgcagctgagcaagcacaaggagttccagaagaccctgggcggcaagcagcccgtgtacgacaccaccatcagaaccggcagagccctgaaggagaagaccctgctgcccgaggacagccagaagctggacaacttcctgggcgaggtgagagacaagtgggacaccgtgtgcggcaagagcgtggagagacagcacaagctggaggaggccctgctgttcagcggccagttcatggacgccctgcaggccctggtggactggctgtacaaggtggagccccagctggccgaggaccagcccgtgcacggcgacctggacctggtgatgaacctgatggacgcccacaaggtgttccagaaggagctgggcaagagaaccggcaccgtgcaggtgctgaagagaagcggcagagagctgatcgagaacagcagagacgacaccacctgggtgaagggccagctgcaggagctgagcaccagatgggacaccgtgtgcaagctgagcgtgagcaagcagagcagactggagcaggccctgaagcaggccgaggtgttcagagacaccgtgcacatgctgctggagtggctgagcgaggccgagcagaccctgagattcagaggcgccctgcccgacgacaccgaggccctgcagagcctgatcgacacccacaaggagttcatgaagaaggtggaggagaagagagtggacgtgaacagcgccgtggccatgggcgaggtgatcctggccgtgtgccaccccgactgcatcaccaccatcaagcactggatcaccatcatcagagccagattcgaggaggtgctgacctgggccaagcagcaccagcagagactggagaccgccctgagcgagctggtggccaacgccgagctgctggaggagctgctggcctggatccagtgggccgagaccaccctgatccagagagaccaggagcccatcccccagaacatcgacagagtgaaggccctgatcgccgagcaccagaccttcatggaggagatgaccagaaagcagcccgacgtggacagagtgaccaagacctacaagagaaagaacatcgagcccacccacgcccccttcatcgagaagagcagaagcggcggcagaaagagcctgagccagcccacccccccccccatgcccatcctgagccagagcgaggccaagaaccccagaatcaaccagctgagcgccagatggcagcaggtgtggctgctggccctggagagacagagaaagctgaacgacgccctggacagactggaggagctgaaggagttcgccaacttcgacttcgacgtgtggagaaagaagtacatgagatggatgaaccacaagaagagcagagtgatggacttcttcagaagaatcgacaaggaccaggacggcaagatcaccagacaggagttcatcgacggcatcctggccagcaagttccccaccaccaagctggagatgaccgccgtggccgacatcttcgacagagacggcgacggctacatcgactactacgagttcgtggccgccctgcaccccaacaaggacgcctacagacccaccaccgacgccgacaagatcgaggacgaggtgaccagacaggtggcccagtgcaagtgcgccaagagattccaggtggagcagatcggcgagaacaagtacagattcggcgacagccagcagctgagactggtgagaatcctgagaagcaccgtgatggtgagagtgggcggcggctggatggccctggacgagttcctggtgaagaacgacccctgcagagccagaggcagaaccaacatcgagctgagagagaagttcatcctgcccgagggcgccagccagggcatgacccccttcagaagcagaggcagaagaagcaagcccagcagcagagccgccagccccaccagaagcagcagcagcgccagccagagcaaccacagctgcaccagcatgcccagcagccccgccacccccgccagcggcaccaaggtgatccccagcagcggcagcaagctgaagagacccacccccaccttccacagcagcagaaccagcctggccggcgacaccagcaacagcagcagccccgccagcaccggcgccaagaccaacagagccgaccccaagaagagcgccagcagacccggcagcagagccggcagcagagccggcagcagagccagcagcagaagaggcagcgacgccagcgacttcgacctgctggagacccagagcgcctgcagcgacaccagcgagagcagcgccgccggcggccagggcaacagcagaagaggcctgaacaagcccagcaagatccccaccatgagcaagaagaccaccaccgccagccccagaacccccggccccaagagatag

SEQ ID NO: 88949 - DNA, 16293 bp, Artificial Sequence
  Description of Artificial Sequence: Synthetic coding sequence
atgagcagcagcgacgaggagaccctgagcgagagaagctgcagaagcgagagaagctgcagaagcgagagaagctacagaagcgagagaagcggcagcctgagcccctgcccccccggcgacaccctgccctggaacctgcccctgcacgagcagaagaagagaaagagccaggacagcgtgctggaccccgccgagagagccgtggtgagagtggccgacgagagagacagagtgcagaagaagaccttcaccaagtgggtgaacaagcacctgatgaaggtgagaaagcacatcaacgacctgtacgaggacctgagagacggccacaacctgatcagcctgctggaggtgctgagcggcatcaagctgcccagagagaagggcagaatgagattccacagactgcagaacgtgcagatcgccctggacttcctgaagcagagacaggtgaagctggtgaacatcagaaacgacgacatcaccgacggcaaccccaagctgaccctgggcctgatctggaccatcatcctgcacttccagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagacccgacctggtggacatggagagagtgcagatccagagcaacagagagaacctggagcaggccttcgaggtggccgagagactgggcgtgaccagactgctggacgccgaggacgtggacgtgcccagccccgacgagaagagcgtgatcacctacgtgagcagcatctacgacgccttccccaaggtgcccgagggcggcgagggcatcagcgccaccgaggtggacagcagatggcaggagtaccagagcagagtggacagcctgatcccctggatcaagcagcacaccatcctgatgagcgacaagaccttcccccagaaccccgtggagctgaaggccctgtacaaccagtacatccacttcaaggagaccgagatcctggccaaggagagagagaagggcagaatcgaggagctgtacaagctgctggaggtgtggatcgagttcggcagaatcaagctgccccagggctaccaccccaacgacgtggaggaggagtggggcaagctgatcatcgagatgctggagagagagaagagcctgagacccgccgtggagagactggagctgctgctgcagatcgccaacaagatccagaacggcgccctgaactgcgaggagaagctgaccctggccaagaacaccctgcaggccgacgccgcccacctggagagcggccagcccgtgcagtgcgagagcgacgtgatcatgtacatccaggagtgcgagggcctgatcagacagctgcaggtggacctgcagatcctgagagacgagaactactaccagctggaggagctggccttcagagtgatgagactgcaggacgagctggtgaccctgagactggagtgcaccaacctgtacagaaagggccacttcaccagcctggagctggtgccccccagcaccctgaccaccacccacctgaaggccgagcccctgaccaaggccacccacagcagcagcaccagctggttcagaaagcccatgaccagagccgagctggtggccatcagcagcagcgaggacgagggcaacctgagattcgtgtacgagctgctgagctgggtggaggagatgcagatgaagctggagagagccgagtggggcaacgacctgcccagcgtggagctgcagctggagacccagcagcacatccacaccagcgtggaggagctgggcagcagcgtgaaggaggccagactgtacgagggcaagatgagccagaacttccacaccagctacgccgagaccctgggcaagctggagacccagtactgcaagctgaaggagaccagcagcttcagaatgagacacctgcagagcctgcacaagttcgtgagcagagccaccgccgagctgatctggctgaacgagaaggaggaggaggagctggcctacgactggagcgacaacaacagcaacatcagcgccaagagaaactacttcagcgagctgaccatggagctggaggagaagcaggacgtgttcagaagcctgcaggacaccgccgagctgctgagcctggagaaccaccccgccaagcagaccgtggaggcctacagcgccgccgtgcagagccagctgcagtggatgaagcagctgtgcctgtgcgtggagcagcacgtgaaggagaacaccgcctacttccagttcttcagcgacgccagagagctggagagcttcctgagaaacctgcaggacagcatcaagagaaagtacagctgcgaccacaacaccagcctgagcagactggaggacctgctgcaggacagcatggacgagaaggagcagctgatccagagcaagagcagcgtggccagcctggtgggcagaagcaagaccatcgtgcagctgaagcccagaagccccgaccacgtgctgaagaacaccatcagcgtgaaggccgtgtgcgactacagacagatcgagatcaccatctgcaagaacgacgagtgcgtgctggaggacaacagccagagaaccaagtggaaggtgatcagccccaccggcaacgaggccatggtgcccagcgtgtgcttcctgatccccccccccaacaaggacgccatcgagatggccagcagagtggagcagagctaccagaaggtgatggccctgtggcaccagctgcacgtgaacaccaagagcctgatcagctggaactacctgagaaaggacctggacctggtgcagacctggaacctggagaagctgagaagcagcgcccccggcgagtgccaccagatcatgaagaacctgcaggcccactacgaggacttcctgcaggacagcagagacagcgtgctgttcagcgtggccgacagactgagactggaggaggaggtggaggcctgcaaggccagattccagcacctgatgaagagcatggagaacgaggacaaggaggagaccgtggccaagatgtacatcagcgagctgaagaacatcagactgagactggaggagtacgagcagagagtggtgaagagaatccagagcctggccagcagcagaaccgacagagacgcctggcaggacaacgccctgagaatcgccgagcaggagcacacccaggaggacctgcagcagctgagaagcgacctggacgccgtgagcatgaagtgcgacagcttcctgcaccagagccccagcagcagcagcgtgcccaccctgagaagcgagctgaacctgctggtggagaagatggaccacgtgtacggcctgagcaccgtgtacctgaacaagctgaagaccgtggacgtgatcgtgagaagcatccaggacgccgagctgctggtgaagggctacgagatcaagctgagccaggaggaggtggtgctggccgacctgagcgccctggaggcccactggagcaccctgagacactggctgagcgacgtgaaggacaagaacagcgtgttcagcgtgctggacgaggagatcgccaaggccaaggtggtggccgagcagatgagcagactgacccccgagagaaacctggacctggagagataccaggagaagggcagccagctgcaggagagatggcacagagtgatcgcccagctggagatcagacagagcgagctggagagcatccaggaggtgctgggcgactacagagcctgccacggcaccctgatcaagtggatcgaggagaccaccgcccagcaggagatgatgaagcccggccaggccgaggacagcagagtgctgagcgagcagctgagccagcagaccgccctgttcgccgagatcgagagaaaccagaccaagctggaccagtgccagaagttcagccagcagtacagcaccatcgtgaaggactacgagctgcagctgatgacctacaaggccttcgtggagagccagcagaagagccccggcaagagaagaagaatgctgagcagcagcgacgccatcacccaggagttcatggacctgagaaccagatacaccgccctggtgaccctgaccacccagcacgtgaagtacatcagcgacgccctgagaagactggaggaggaggagaaggtggtggaggaggagaagcaggagcacgtggagaaggtgaaggagctgctgggctgggtgagcaccctggccagaaacacccagggcaaggccaccagcagcgagaccaaggagagcaccgacatcgagaaggccatcctggagcagcaggtgctgagcgaggagctgaccaccaagaaggagcaggtgagcgaggccatcaagaccagccagatcttcctggccaagcacggccacaagctgagcgagaaggagaagaagcagatcagcgagcagctgaacgccctgaacaaggcctaccacgacctgtgcgacggcagcgccaaccagctgcagcagctgcagagccagctggcccaccagaccgagcagaagaccctgcagaagcagcagaacacctgccaccagcagctggaggacctgtgcagctgggtgggccaggccgagagagccctggccggccaccagggcagaaccacccagcaggacctgagcgccctgcagaagaaccagagcgacctgaaggacctgcaggacgacatccagaacagagccaccagcttcgccaccgtggtgaaggacatcgagggcttcatggaggagaaccagaccaagctgagccccagagagctgaccgccctgagagagaagctgcaccaggccaaggagcagtacgaggccctgcaggaggagaccagagtggcccagaaggagctggaggaggccgtgaccagcgccctgcagcaggagaccgagaagagcaaggccgccaaggagctggccgagaacaagaagaagatcgacgccctgctggactgggtgaccagcgtgggcagcagcggcggccagctgctgaccaacctgcccggcatggagcagctgagcggcgccagcctggagaagggcgccctggacaccaccgacggctacatgggcgtgaaccaggcccccgagaagctggacaagcagtgcgagatgatgaaggccagacaccaggagctgctgagccagcagcagaacttcatcctggccacccagagcgcccaggccttcctggaccagcacggccacaacctgacccccgaggagcagcagatgctgcagcagaagctgggcgagctgaaggagcagtacagcaccagcctggcccagagcgaggccgagctgaagcaggtgcagaccctgcaggacgagctgcagaagttcctgcaggaccacaaggagttcgagagctggctggagagaagcgagaaggagctggagaacatgcacaagggcggcagcagccccgagaccctgcccagcctgctgaagagacagggcagcttcagcgaggacgtgatcagccacaagggcgacctgagattcgtgaccatcagcggccagaaggtgctggacatggagaacagcttcaaggagggcaaggagcccagcgagatcggcaacctggtgaaggacaagctgaaggacgccaccgagagatacaccgccctgcacagcaagtgcaccagactgggcagccacctgaacatgctgctgggccagtaccaccagttccagaacagcgccgacagcctgcaggcctggatgcaggcctgcgaggccaacgtggagaagctgctgagcgacaccgtggccagcgaccccggcgtgctgcaggagcagctggccaccaccaagcagctgcaggaggagctggccgagcaccaggtgcccgtggagaagctgcagaaggtggccagagacatcatggagatcgagggcgagcccgcccccgaccacagacacgtgcaggagaccaccgacagcatcctgagccacttccagagcctgagctacagcctggccgagagaagcagcctgctgcagaaggccatcgcccagagccagagcgtgcaggagagcctggagagcctgctgcagagcatcggcgaggtggagcagaacctggagggcaagcaggtgagcagcctgagcagcggcgtgatccaggaggccctggccaccaacatgaagctgaagcaggacatcgccagacagaagagcagcctggaggccaccagagagatggtgaccagattcatggagaccgccgacagcaccaccgccgccgtgctgcagggcaagctggccgaggtgagccagagattcgagcagctgtgcctgcagcagcaggagaaggagagcagcctgaagaagctgctgccccaggccgagatgttcgagcacctgagcggcaagctgcagcagttcatggagaacaagagcagaatgctggccagcggcaaccagcccgaccaggacatcacccacttcttccagcagatccaggagctgaacctggagatggaggaccagcaggagaacctggacaccctggagcacctggtgaccgagctgagcagctgcggcttcgccctggacctgtgccagcaccaggacagagtgcagaacctgagaaaggacttcaccgagctgcagaagaccgtgaaggagagagagaaggacgccagcagctgccaggagcagctggacgagttcagaaagctggtgagaaccttccagaagtggctgaaggagaccgagggcagcatcccccccaccgagaccagcatgagcgccaaggagctggagaagcagatcgagcacctgaagagcctgctggacgactgggccagcaagggcaccctggtggaggagatcaactgcaagggcaccagcctggagaacctgatcatggagatcaccgcccccgacagccagggcaagaccggcagcatcctgcccagcgtgggcagcagcgtgggcagcgtgaacggctaccacacctgcaaggacctgaccgagatccagtgcgacatgagcgacgtgaacctgaagtacgagaagctgggcggcgtgctgcacgagagacaggagagcctgcaggccatcctgaacagaatggaggaggtgcacaaggaggccaacagcgtgctgcagtggctggagagcaaggaggaggtgctgaagagcatggacgccatgagcagccccaccaagaccgagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagcagatgggagagagccaccgaggtgaccgtggccagacagagacagctggaggagagcgccagccacctggcctgcttccaggccgccgagagccagctgagaccctggctgatggagaaggagctgatgatgggcgtgctgggccccctgagcatcgaccccaacatgctgaacgcccagaagcagcaggtgcagttcatgctgaaggagttcgaggccagaagacagcagcacgagcagctgaacgaggccgcccagggcatcctgaccggccccggcgacgtgagcctgagcaccagccaggtgcagaaggagctgcagagcatcaaccagaagtgggtggagctgaccgacaagctgaacagcagaagcagccagatcgaccaggccatcgtgaagagcacccagtaccaggagctgctgcaggacctgagcgagaaggtgagagccgtgggccagagactgagcgtgcagagcgccatcagcacccagcccgaggccgtgaagcagcagctggaggagaccagcgagatcagaagcgacctggagcagctggaccacgaggtgaaggaggcccagaccctgtgcgacgagctgagcgtgctgatcggcgagcagtacctgaaggacgagctgaagaagagactggagaccgtggccctgcccctgcagggcctggaggacctggccgccgacagaatcaacagactgcaggccgccctggccagcacccagcagttccagcagatgttcgacgagctgagaacctggctggacgacaagcagagccagcaggccaagaactgccccatcagcgccaagctggagagactgcagagccagctgcaggagaacgaggagttccagaagagcctgaaccagcacagcggcagctacgaggtgatcgtggccgagggcgagagcctgctgctgagcgtgccccccggcgaggagaagagaaccctgcagaaccagctggtggagctgaagaaccactgggaggagctgagcaagaagaccgccgacagacagagcagactgaaggactgcatgcagaaggcccagaagtaccagtggcacgtggaggacctggtgccctggatcgaggactgcaaggccaagatgagcgagctgagagtgaccctggaccccgtgcagctggagagcagcctgctgagaagcaaggccatgctgaacgaggtggagaagagaagaagcctgctggagatcctgaacagcgccgccgacatcctgatcaacagcagcgaggccgacgaggacggcatcagagacgagaaggccggcatcaaccagaacatggacgccgtgaccgaggagctgcaggccaagaccggcagcctggaggagatgacccagagactgagagagttccaggagagcttcaagaacatcgagaagaaggtggagggcgccaagcaccagctggagatcttcgacgccctgggcagccaggcctgcagcaacaagaacctggagaagctgagagcccagcaggaggtgctgcaggccctggagccccaggtggactacctgagaaacttcacccagggcctggtggaggacgcccccgacggcagcgacgccagccagctgctgcaccaggccgaggtggcccagcaggagttcctggaggtgaagcagagagtgaacagcggctgcgtgatgatggagaacaagctggagggcatcggccagttccactgcagagtgagagagatgttcagccagctggccgacctggacgacgagctggacggcatgggcgccatcggcagagacaccgacagcctgcagagccagatcgaggacgtgagactgttcctgaacaagatccacgtgctgaagctggacatcgaggccagcgaggccgagtgcagacacatgctggaggaggagggcaccctggacctgctgggcctgaagagagagctggaggccctgaacaagcagtgcggcaagctgaccgagagaggcaaggccagacaggagcagctggagctgaccctgggcagagtggaggacttctacagaaagctgaagggcctgaacgacgccaccaccgccgccgaggaggccgaggccctgcagtgggtggtgggcaccgaggtggagatcatcaaccagcagctggccgacttcaagatgttccagaaggagcaggtggaccccctgcagatgaagctgcagcaggtgaacggcctgggccagggcctgatccagagcgccggcaaggactgcgacgtgcagggcctggagcacgacatggaggagatcaacgccagatggaacaccctgaacaagaaggtggcccagagaatcgcccagctgcaggaggccctgctgcactgcggcaagttccaggacgccctggagcccctgctgagctggctggccgacaccgaggagctgatcgccaaccagaagccccccagcgccgagtacaaggtggtgaaggcccagatccaggagcagaagctgctgcagagactgctggacgacagaaaggccaccgtggacatgctgcaggccgagggcggcagaatcgcccagagcgccgagctggccgacagagagaagatcaccggccagctggagagcctggagagcagatggaccgagctgctgagcaaggccgccgccagacagaagcagctggaggacatcctggtgctggccaagcagttccacgagaccgccgagcccatcagcgacttcctgagcgtgaccgagaagaagctggccaacagcgagcccgtgggcacccagaccgccaagatccagcagcagatcatcagacacaaggccctggaggaggacatcgagaaccacgccaccgacgtgcaccaggccgtgaagatcggccagagcctgagcagcctgaccagccccgccgagcagggcgtgctgagcgagaagatcgacagcctgcaggccagatacagcgagatccaggacagatgctgcagaaaggccgccctgctggaccaggccctgagcaacgccagactgttcggcgaggacgaggtggaggtgctgaactggctggccgaggtggaggacaagctgagcagcgtgttcgtgaaggacttcaagcaggacgtgctgcacagacagcacgccgaccacctggccctgaacgaggagatcgtgaacagaaagaagaacgtggaccaggccatcaagaacggccaggccctgctgaagcagaccaccggcgaggaggtgctgctgatccaggagaagctggacggcatcaagaccagatacgccgacatcaccgtgaccagcagcaaggccctgagaaccctggagcaggccagacagctggccaccaagttccagagcacctacgaggagctgaccggctggctgagagaggtggaggaggagctggccaccagcggcggccagagccccaccggcgagcagatcccccagttccagcagagacagaaggagctgaagaaggaggtgatggagcacagactggtgctggacaccgtgaacgaggtgagcagagccctgctggagctggtgccctggagagccagagagggcctggacaagctggtgagcgacgccaacgagcagtacaagctggtgagcgacaccatcggccagagagtggacgagatcgacgccgccatccagagaagccagcagtacgagcaggccgccgacgccgagctggcctgggtggccgagaccaagagaaagctgatggccctgggccccatcagactggagcaggaccagaccaccgcccagctgcaggtgcagaaggccttcagcatcgacatcatcagacacaaggacagcatggacgagctgttcagccacagaagcgagatcttcggcacctgcggcgaggagcagaagaccgtgctgcaggagaagaccgagagcctgatccagcagtacgaggccatcagcctgctgaacagcgagagatacgccagactggagagagcccaggtgctggtgaaccagttctgggagacctacgaggagctgagcccctggatcgaggagaccagagccctgatcgcccagctgcccagccccgccatcgaccacgagcagctgagacagcagcaggaggagatgagacagctgagagagagcatcgccgagcacaagccccacatcgacaagctgctgaagatcggcccccagctgaaggagctgaaccccgaggagggcgagatggtggaggagaagtaccagaaggccgagaacatgtacgcccagatcaaggaggaggtgagacagagagccctggccctggacgaggccgtgagccagagcacccagatcaccgagttccacgacaagatcgagcccatgctggagaccctggagaacctgagcagcagactgagaatgccccccctgatccccgccgaggtggacaagatcagagagtgcatcagcgacaacaagagcgccaccgtggagctggagaagctgcagcccagcttcgaggccctgaagagaagaggcgaggagctgatcggcagaagccagggcgccgacaaggacctggccgccaaggagatccaggacaagctggaccagatggtgttcttctgggaggacatcaaggccagagccgaggagagagagatcaagttcctggacgtgctggagctggccgagaagttctggtacgacatggccgccctgctgaccaccatcaaggacacccaggacatcgtgcacgacctggagagccccggcatcgaccccagcatcatcaagcagcaggtggaggccgccgagaccatcaaggaggagaccgacggcctgcacgaggagctggagttcatcagaatcctgggcgccgacctgatcttcgcctgcggcgagaccgagaagcccgaggtgagaaagagcatcgacgagatgaacaacgcctgggagaacctgaacaagacctggaaggagagactggagaagctggaggacgccatgcaggccgccgtgcagtaccaggacaccctgcaggccatgttcgactggctggacaacaccgtgatcaagctgtgcaccatgccccccgtgggcaccgacctgaacaccgtgaaggaccagctgaacgagatgaaggagttcaaggtggaggtgtaccagcagcagatcgagatggagaagctgaaccaccagggcgagctgatgctgaagaaggccaccgacgagaccgacagagacatcatcagagagcccctgaccgagctgaagcacctgtgggagaacctgggcgagaagatcgcccacagacagcacaagctggagggcgccctgctggccctgggccagttccagcacgccctggaggagctgatgagctggctgacccacaccgaggagctgctggacgcccagagacccatcagcggcgaccccaaggtgatcgaggtggagctggccaagcaccacgtgctgaagaacgacgtgctggcccaccaggccaccgtggagaccgtgaacaaggccggcaacgagctgctggagagcagcgccggcgacgacgccagcagcctgagaagcagactggaggccatgaaccagtgctgggagagcgtgctgcagaagaccgaggagagagagcagcagctgcagagcaccctgcagcaggcccagggcttccacagcgagatcgaggacttcctgctggagctgaccagaatggagagccagctgagcgccagcaagcccaccggcggcctgcccgagaccgccagagagcagctggacacccacatggagctgtacagccagctgaaggccaaggaggagacctacaaccagctgctggacaagggcagactgatgctgctgagcagagacgacagcggcagcggcagcaagaccgagcagagcgtggccctgctggagcagaagtggcacgtggtgagcagcaagatggaggagagaaagagcaagctggaggaggccctgaacctggccaccgagttccagaacagcctgcaggagttcatcaactggctgaccctggccgagcagagcctgaacatcgccagcccccccagcctgatcctgaacaccgtgctgagccagatcgaggagcacaaggtgttcgccaacgaggtgaacgcccacagagaccagatcatcgagctggaccagaccggcaaccagctgaagttcctgagccagaagcaggacgtggtgctgatcaagaacctgctggtgagcgtgcagagcagatgggagaaggtggtgcagagaagcatcgagagaggcagaagcctggacgacgccagaaagagagccaagcagttccacgaggcctggaagaagctgatcgactggctggaggacgccgagagccacctggacagcgagctggagatcagcaacgaccccgacaagatcaagctgcagctgagcaagcacaaggagttccagaagaccctgggcggcaagcagcccgtgtacgacaccaccatcagaaccggcagagccctgaaggagaagaccctgctgcccgaggacagccagaagctggacaacttcctgggcgaggtgagagacaagtgggacaccgtgtgcggcaagagcgtggagagacagcacaagctggaggaggccctgctgttcagcggccagttcatggacgccctgcaggccctggtggactggctgtacaaggtggagccccagctggccgaggaccagcccgtgcacggcgacctggacctggtgatgaacctgatggacgcccacaaggtgttccagaaggagctgggcaagagaaccggcaccgtgcaggtgctgaagagaagcggcagagagctgatcgagaacagcagagacgacaccacctgggtgaagggccagctgcaggagctgagcaccagatgggacaccgtgtgcaagctgagcgtgagcaagcagagcagactggagcaggccctgaagcaggccgaggtgttcagagacaccgtgcacatgctgctggagtggctgagcgaggccgagcagaccctgagattcagaggcgccctgcccgacgacaccgaggccctgcagagcctgatcgacacccacaaggagttcatgaagaaggtggaggagaagagagtggacgtgaacagcgccgtggccatgggcgaggtgatcctggccgtgtgccaccccgactgcatcaccaccatcaagcactggatcaccatcatcagagccagattcgaggaggtgctgacctgggccaagcagcaccagcagagactggagaccgccctgagcgagctggtggccaacgccgagctgctggaggagctgctggcctggatccagtgggccgagaccaccctgatccagagagaccaggagcccatcccccagaacatcgacagagtgaaggccctgatcgccgagcaccagaccttcatggaggagatgaccagaaagcagcccgacgtggacagagtgaccaagacctacaagagaaagaacatcgagcccacccacgcccccttcatcgagaagagcagaagcggcggcagaaagagcctgagccagcccacccccccccccatgcccatcctgagccagagcgaggccaagaaccccagaatcaaccagctgagcgccagatggcagcaggtgtggctgctggccctggagagacagagaaagctgaacgacgccctggacagactggaggagctgaaggagttcgccaacttcgacttcgacgtgtggagaaagaagtacatgagatggatgaaccacaagaagagcagagtgatggacttcttcagaagaatcgacaaggaccaggacggcaagatcaccagacaggagttcatcgacggcatcctggccagcaagttccccaccaccaagctggagatgaccgccgtggccgacatcttcgacagagacggcgacggctacatcgactactacgagttcgtggccgccctgcaccccaacaaggacgcctacagacccaccaccgacgccgacaagatcgaggacgaggtgaccagacaggtggcccagtgcaagtgcgccaagagattccaggtggagcagatcggcgagaacaagtacagattcggcgacagccagcagctgagactggtgagaatcctgagaagcaccgtgatggtgagagtgggcggcggctggatggccctggacgagttcctggtgaagaacgacccctgcagagccagaggcagaaccaacatcgagctgagagagaagttcatcctgcccgagggcgccagccagggcatgacccccttcagaagcagaggcagaagaagcaagcccagcagcagagccgccagccccaccagaagcagcagcagcgccagccagagcaaccacagctgcaccagcatgcccagcagccccgccacccccgccagcggcaccaaggtgatccccagcagcggcagcaagctgaagagacccacccccaccttccacagcagcagaaccagcctggccggcgacaccagcaacagcagcagccccgccagcaccggcgccaagaccaacagagccgaccccaagaagagcgccagcagacccggcagcagagccggcagcagagccggcagcagagccagcagcagaagaggcagcgacgccagcgacttcgacctgctggagacccagagcgcctgcagcgacaccagcgagagcagcgccgccggcggccagggcaacagcagaagaggcctgaacaagcccagcaagatccccaccatgagcaagaagaccaccaccgccagccccagaacccccggccccaagagatag

SEQ ID NO: 88950 - DNA, 3189 bp, Artificial Sequence
  Description of Artificial Sequence: Synthetic coding sequence
atgggcaacagcctgggctgcttcaaggagcccaaggagagcatcgccatccccgagaaggcccccatcagccccaagaagagagtgagattcaagagaagatggagaggcaagaagatccccacccccgaggccagccaccaggaggagaccagcgagggcaccggcgtgatcgaggagaccgagaccctgaccaagctgaccgagagcctgcagaaggaggacggcgtgggcggcgtggagcacaccccccccgacatcctgctgcccggcgacagcgcccccaacagcagagtggtggacagaggcatgatcgtgcaggtgaaggagagattccagggcgaggtgcagaccgcccacctgctgctggagaacgagagcagcgtggccggcggcgtgtgggacagcctggaggagggcatgaccgtgatcgcccacctgctggacaaccccgccgagagaaactgcgagaagagcgtgagccagctggtggagttccccagaaccgccagctgcagcagcagagccgtgctgctgcccctgcagggcgagaccgccgtggagaagggcaacatccagagaggcttcagaagctgcgccctgcccagaaccgactaccccaccgacaagggcaaccaggagcagttcagcgagggctggagcgtggaggagggcaccaagagcgtgagcggcgccccccagaccgccagctggatcatcgagtgcagcgtgagcagcctgctgctggaccagcccggcggccagagaagaaccgagcccagccacgtgggccaggtgcccccccaggacagcagactgcccaccagccagagcgacctgagcatcagcggcgtgaccgtgagcatcctgcccagcagcagcggctacggcagcgacggcccccacatccacggcatccagcccaaggacaccgagcccgagaagagcagcaccagcttcagcgaggaggacggcaccctgagcctggaggccagccacacccccagctggggcctggaggagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagacccgacctggtggacatggagagagtgcagatccagagcaacagagagaacctggagcaggccttcgaggtggccgagagactgggcgtgaccagactgctggacgccgaggacgtggacgtgcccagccccgacgagaagagcgtgatcacctacgtgagcagcatctacgacgccttccccaaggtgcccgagggcggcgagggcatcagcgccaccgaggtggacagcagatggcaggagtaccagagcagagtggacagcctgatcccctggatcaagcagcacaccatcctgatgagcgacaagaccttcccccagaaccccgtggagctgaaggccctgtacaaccagtacatccacttcaaggagaccgagatcctggccaaggagagagagaagggcagaatcgaggagctgtacaagctgctggaggtgtggatcgagttcggcagaatcaagctgccccagggctaccaccccaacgacgtggaggaggagtggggcaagctgatcatcgagatgctggagagagagaagagcctgagacccgccgtggagagactggagctgctgctgcagatcgccaacaagatccagaacggcgccctgaactgcgaggagaagctgaccctggccaagaacaccctgcaggccgacgccgcccacctggagagcggccagcccgtgcagtgcgagagcgacgtgatcatgtacatccaggagtgcgagggcctgatcagacagctgcaggtggacctgcagatcctgagagacgagaactactaccagctggaggagctggccttcagagtgatgagactgcaggacgagctggtgaccctgagactggagtgcaccaacctgtacagaaagggccacttcaccagcctggagctggtgccccccagcaccctgaccaccacccacctgaaggccgagcccctgaccaaggccacccacagcagcagcaccagctggttcagaaagcccatgaccagagccgagctggtggccatcagcagcagcgaggacgagggcaacctgagattcgtgtacgagctgctgagctgggtggaggagatgcagatgaagctggagagagccgagtggggcaacgacctgcccagcgtggagctgcagctggagacccagcagcacatccacaccagcgtggaggagctgggcagcagcgtgaaggaggccagactgtacgagggcaagatgagccagaacttccacaccagctacgccgagaccctgggcaagctggagacccagtactgcaagctgaaggagaccagcagcttcagaatgagacacctgcagagcctgcacaagttcgtgagcagagccaccgccgagctgatctggctgaacgagaaggaggaggaggagctggcctacgactggagcgacaacaacagcaacatcagcgccaagagaaactacttcagcgagctgaccatggagctggaggagaagcaggacgtgttcagaagcctgcaggacaccgccgagctgctgagcctggagaaccaccccgccaagcagaccgtggaggcctacagcgccgccgtgcagagccagctgcagtggatgaagcagctgtgcctgtgcgtggagcagcacgtgaaggagaacaccgcctacttccagttcttcagcgacgccagagagctggagagcttcctgagaaacctgcaggacagcatcaagagaaagtacagctgcgaccacaacaccagcctgagcagactggaggacctgctgcaggacagcatgttccaggacgagaaggagcagctgatccagagcaagagcagcgtggccagcctggtgggcagaagcaagaccatcgtgcagctgaagcccagaagccccgaccacgtgctgaagaacaccatcagcgtgaaggccgtgtgcgactacagacagatcgagggcagaaccatcctgagcgagggctacggccccctggccagcgccgcctgctag

SEQ ID NO: 88951 - DNA, 22167 bp, Artificial Sequence
  Description of Artificial Sequence: Synthetic coding sequence
atgagcagcagcgacgaggagaccctgagcgagagaagctgcagaagcgagagaagctgcagaagcgagagaagctacagaagcgagagaagcggcagcctgagcccctgcccccccggcgacaccctgccctggaacctgcccctgcacgagcagaagaagagaaagagccaggacagcgtgctggaccccgccgagagagccgtggtgagagtggccgacgagagagacagagtgcagaagaagaccttcaccaagtgggtgaacaagcacctgatgaaggtgagaaagcacatcaacgacctgtacgaggacctgagagacggccacaacctgatcagcctgctggaggtgctgagcggcatcaagctgcccagagagaagggcagaatgagattccacagactgcagaacgtgcagatcgccctggacttcctgaagcagagacaggtgaagctggtgaacatcagaaacgacgacatcaccgacggcaaccccaagctgaccctgggcctgatctggaccatcatcctgcacttccagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagacccgacctggtggacatggagagagtgcagatccagagcaacagagagaacctggagcaggccttcgaggtggccgagagactgggcgtgaccagactgctggacgccgaggacgtggacgtgcccagccccgacgagaagagcgtgatcacctacgtgagcagcatctacgacgccttccccaaggtgcccgagggcggcgagggcatcagcgccaccgaggtggacagcagatggcaggagtaccagagcagagtggacagcctgatcccctggatcaagcagcacaccatcctgatgagcgacaagaccttcccccagaaccccgtggagctgaaggccctgtacaaccagtacatccacttcaaggagaccgagatcctggccaaggagagagagaagggcagaatcgaggagctgtacaagctgctggaggtgtggatcgagttcggcagaatcaagctgccccagggctaccaccccaacgacgtggaggaggagtggggcaagctgatcatcgagatgctggagagagagaagagcctgagacccgccgtggagagactggagctgctgctgcagatcgccaacaagatccagaacggcgccctgaactgcgaggagaagctgaccctggccaagaacaccctgcaggccgacgccgcccacctggagagcggccagcccgtgcagtgcgagagcgacgtgatcatgtacatccaggagtgcgagggcctgatcagacagctgcaggtggacctgcagatcctgagagacgagaactactaccagctggaggagctggccttcagagtgatgagactgcaggacgagctggtgaccctgagactggagtgcaccaacctgtacagaaagggccacttcaccagcctggagctggtgccccccagcaccctgaccaccacccacctgaaggccgagcccctgaccaaggccacccacagcagcagcaccagctggttcagaaagcccatgaccagagccgagctggtggccatcagcagcagcgaggacgagggcaacctgagattcgtgtacgagctgctgagctgggtggaggagatgcagatgaagctggagagagccgagtggggcaacgacctgcccagcgtggagctgcagctggagacccagcagcacatccacaccagcgtggaggagctgggcagcagcgtgaaggaggccagactgtacgagggcaagatgagccagaacttccacaccagctacgccgagaccctgggcaagctggagacccagtactgcaagctgaaggagaccagcagcttcagaatgagacacctgcagagcctgcacaagttcgtgagcagagccaccgccgagctgatctggctgaacgagaaggaggaggaggagctggcctacgactggagcgacaacaacagcaacatcagcgccaagagaaactacttcagcgagctgaccatggagctggaggagaagcaggacgtgttcagaagcctgcaggacaccgccgagctgctgagcctggagaaccaccccgccaagcagaccgtggaggcctacagcgccgccgtgcagagccagctgcagtggatgaagcagctgtgcctgtgcgtggagcagcacgtgaaggagaacaccgcctacttccagttcttcagcgacgccagagagctggagagcttcctgagaaacctgcaggacagcatcaagagaaagtacagctgcgaccacaacaccagcctgagcagactggaggacctgctgcaggacagcatggacgagaaggagcagctgatccagagcaagagcagcgtggccagcctggtgggcagaagcaagaccatcgtgcagctgaagcccagaagccccgaccacgtgctgaagaacaccatcagcgtgaaggccgtgtgcgactacagacagatcgagatcaccatctgcaagaacgacgagtgcgtgctggaggacaacagccagagaaccaagtggaaggtgatcagccccaccggcaacgaggccatggtgcccagcgtgtgcttcctgatccccccccccaacaaggacgccatcgagatggccagcagagtggagcagagctaccagaaggtgatggccctgtggcaccagctgcacgtgaacaccaagagcctgatcagctggaactacctgagaaaggacctggacctggtgcagacctggaacctggagaagctgagaagcagcgcccccggcgagtgccaccagatcatgaagaacctgcaggcccactacgaggacttcctgcaggacagcagagacagcgtgctgttcagcgtggccgacagactgagactggaggaggaggtggaggcctgcaaggccagattccagcacctgatgaagagcatggagaacgaggacaaggaggagaccgtggccaagatgtacatcagcgagctgaagaacatcagactgagactggaggagtacgagcagagagtggtgaagagaatccagagcctggccagcagcagaaccgacagagacgcctggcaggacaacgccctgagaatcgccgagcaggagcacacccaggaggacctgcagcagctgagaagcgacctggacgccgtgagcatgaagtgcgacagcttcctgcaccagagccccagcagcagcagcgtgcccaccctgagaagcgagctgaacctgctggtggagaagatggaccacgtgtacggcctgagcaccgtgtacctgaacaagctgaagaccgtggacgtgatcgtgagaagcatccaggacgccgagctgctggtgaagggctacgagatcaagctgagccaggaggaggtggtgctggccgacctgagcgccctggaggcccactggagcaccctgagacactggctgagcgacgtgaaggacaagaacagcgtgttcagcgtgctggacgaggagatcgccaaggccaaggtggtggccgagcagatgagcagactgacccccgagagaaacctggacctggagagataccaggagaagggcagccagctgcaggagagatggcacagagtgatcgcccagctggagatcagacagagcgagctggagagcatccaggaggtgctgggcgactacagagcctgccacggcaccctgatcaagtggatcgaggagaccaccgcccagcaggagatgatgaagcccggccaggccgaggacagcagagtgctgagcgagcagctgagccagcagaccgccctgttcgccgagatcgagagaaaccagaccaagctggaccagtgccagaagttcagccagcagtacagcaccatcgtgaaggactacgagctgcagctgatgacctacaaggccttcgtggagagccagcagaagagccccggcaagagaagaagaatgctgagcagcagcgacgccatcacccaggagttcatggacctgagaaccagatacaccgccctggtgaccctgaccacccagcacgtgaagtacatcagcgacgccctgagaagactggaggaggaggagaaggtggtggaggaggagaagcaggagcacgtggagaaggtgaaggagctgctgggctgggtgagcaccctggccagaaacacccagggcaaggccaccagcagcgagaccaaggagagcaccgacatcgagaaggccatcctggagcagcaggtgctgagcgaggagctgaccaccaagaaggagcaggtgagcgaggccatcaagaccagccagatcttcctggccaagcacggccacaagctgagcgagaaggagaagaagcagatcagcgagcagctgaacgccctgaacaaggcctaccacgacctgtgcgacggcagcgccaaccagctgcagcagctgcagagccagctggcccaccagaccgagcagaaggagtgcagagccgtggccggcgtgatcgacctgggcaccgtggagatcttccccatcttcaaggccatgcagaagggcctgctggaccaggacaccggcctggtgctgctggagagccaggtgatcatgagcggcctgatcgcccccgagaccggcgagaacctgagcctggaggagggcatcgccagaaacctgatcaacccccagatgtaccagcagctgagagagctgcaggacgccctggccctgatcagcagactgaccgagagcagaggccccctgagcgtggtggaggccatcgagaagagaatcatcagcgagaccgtgggcctgaagatcctggaggcccacctggccaccggcggcttcagcctgagccccagcgagaactgcatcaacctggaggaggccttccaccagggcctgatcagcgcctggctgcacagcgtgctggagagctacctgagaaccagcaagaacctgatcgaccccaacaccgccgagaagatcggcctgctggacctgatgcagagatgcatcgtgcaccaggagagcggcttcaagctgctgcccgtgaagcagctggccggcggcatggtgagcctgaagagcggcagaaaggtgagcatcttcagagccgtgcaggagggcctgatcgacagacaggtgaccgtgagactgctggaggcccagctgttcgccggcggcatcgtggaccccagaaccggccacagactgaccgtggaggaggccgtgagacacaacctgatcgaccaggacatggcctgcgccatcctgatcagacagctgcagaccggcggcatcatcgacaccgtgaccggccagagactgaccatcgacgaggccgtgagcaacgacctggtggccgccaagatcgccctggtgatcctggagagcctgtggagcttcatgggcctgctgtggcccgagagcggcgagatcctgcccatcaccgacgccctggagcagggcatcgtgagcaccgagctggcccacaagatcctgagcaacagacagcacatcaaggccctgttcctgcccgccaccaccgagatcctgagctggaagaaggccatcgagagcggcatcctggacagagacctggccaacaacctgaagagcatctgcatccccgacgtgatgccccacatgcagctggccgacagcgccgagcagaacatcaaccccggcgccgccgtgctgccctgcagcaagagccaccccaaggccaccgccagccagagcgagaacctgctgttccagctgatgacccacagctacatcaacgtgcagaacggccagagactgctgctgctggacaaggagctgatggagaccctgaccagcagagacgagtaccagaccagcccccccaaggtggtggagatcggccaccagagacagaagacccccgagggcctgcaggagagcgccaacgtgaagatcagcggcaccttcagcagcggctggaccgtgagactgcccgagttccagttcagcagccagaacaaggagtaccccgacagagaggactgcaccaccgagaagggcaagaagaccaccgtggagaccgaggacagcagcgtggagaaccccgagcaggacctgttcgtggagcagaaggagagaaaccccaacatcgacgccctgaaggtgatcaacaaggtgaagctggaggtgcagagacagctgatcggcacccagagagaggaccagaccgccgtgagcgtgagagagaacgccagcagaggccacctgctgaccatcccccccgccgaggccgagggcgtgcccctggtggtggacaaggacgtgttcagcgtggagacccccaagaaggagcaccagcccctgagaaacaccagcttcacctgccagaacgagcaggcccacaccctggagaccgagtacatccacgacgagaccggcggcagccacatcaagccccagagcaagaagctgcaggtgcaggtgaagaagaccctgggcatcaagctggagctgaagagcgagaccgacggcaacgtgcaccccctggacaagaaggagatgctgaagaagaccttcctggccaaggacgaccacaaggagagccaggaggcccagaacatcgccggcggcagcatgatgatgagcgagaagaccgacgaggaggacagcggcagagagatcttcctgagctgcagccaccccctggagctgctggaggaggccaccctgaacgtgctgagcgcccagctgctggacggcggcatcttccacgagcagaccggccagaagctgctgctgaacgaggccatcagcagaggcatcgtgcccagccacaccgccgtgaagctgatggagaagctgaacatgttccagggcttcttcgacagccagacctgcgagagcctgaccaccgaggaggtgatcaacgagggcctgatggacgagaagctgctgcacaacgtgctgatggccgacaaggccatcagcggcgtgctggaccccagaacccagaccctgtgcagcgtgaaggacgccgtgaccgtgggcctgctggacaaggagaccgccaccagaatcctggagagacaggtggtgaccggcggcatcatcgacctgaagagaggcaagaaggtgagcgtgaccctggccagcaccctgggcctggtggacgtggccgaccagcccgagctgatcaacctggagaaggccagcaagggcagagacgccgagaagaccgtgagagagagactgatcagcctgcagatggagaccaccggcctgatcgaccccgacagcaaggcccccctgaccgtggtgcagagcatcgacagaggcctgctggagagagaggaggccgtgagactgctgaccaagcaggtggtggacggcggcatcatccaccacatcagcggcatgagactgagcgtggacaacgccttcagacacggcctgatcggcgaggacctggccgagaagctgaagagagtggagaacctgaacatccaccagatcttcaaccccgagaccaaggagaacatcagcctgcccaaggccatcaagctggacctgatcaccagcgacctgaagagagagatccaggaggtgcaggccttcaccggcaacttcgtggacctgatcagcggccagagactgaccctggccgaggccaagaaggagggcctgctgaccaacgaggccgtgctgagccccggcatgatgcacggcatcgtggaccccgagaactgcagaatcgtgccctacagcgagctggtgaagaagtgcaagatcgacatcgagagcggccagagatacctggaggtgatccccttcagcgacatcaaggacggcgtgagcgacaaggtgctgaccctgagccaggccatccagctgggcaaggtggacttcgccagcaccctgaaggtgctggaggcccaggccaacaccggcggcatcatcgacaccgccaccggcaagagactgaccctggccagcgccctggaggagaagctggtggacgagaacatggtgagaatcatcgccagccaccaggtgctgaacggcggcatcgtggacatcttcagcgaccagagagtgaccctggtggaggccatcgagaagagactgatcagccccgagctggccaacatgatccagatcgacagcagcgagttcagcgaccacagagcccagatcgagaagcaggagggcatcgaggtgtgcgccctgcagaacgagttcctgggcaaggacatgctgatcgcctgcaaccagaccgccgagatgagctgcaacaaggtggaggagagcgagagactgttccaggtggagaaccagagcgcccaggagaaggtgaaggtgagagtgagcgacggcgagcaggccaagaagagcagagagatcagcctgaaggagttcggctgcaaggaccagagaaagcccagaatgagcagcgacgccaaggagttcatcagcatcatcaacccccacaacctgaagggcaagagcctgggccaggtgagcctgacccacccctacagcgagtgcgacttcaagctgaaggaggtggccagaaacaacatgggcaacgacaccaacgaggagcaggagaaggccgtgaccaagatcgagatcatcagccacatgaagcagagcaccagctgcctggacagcgaggagatcagagagaaccagggcgaggtgatcctggaggtgcaggagacctactgcgagaccagcggcaagctgcccagcgagcaggtgctgcagcagcccatgaacgccagagtgaagagcaagagagagaagagagaggtgatcgtggaggagagcatcagaacctgcaagcccgccttcctgagcgaggagaagctgtaccaggagaccgccatcagagacgagcacgacagccacatcaagagccagcccagagagatgaccagcagcgagaagggcaaggaggccgacaccgagatgggcttcagcatcaccttcaagatcgaggagagcagcagccaggtggtgccccagggcatcagcgtgaagcacctggacgccctgaccctgttcagcagcaagcaggccaacgagggcaaggtgaacaacctgagcctgtgcctgaccctgaagcccgaggagaacctgagcagagagatcgcctgcggcgcccagagcgagcccttcccctgcatgacccccagacccgagggcctgcactaccaggagagcgacggcaaggcccaggtgaccggccccagccagatcagcaagaccgacaagagcttccagggcaccaccagacaggagaccaactaccaggacagctgggtgaccagcaagaccaaggagaccaagcaccagatcagcagcagcaacgagtgcaaggagaagagctaccaggaggtgagcttcgaccccgccagaggcctgaagctggaggagatcaccgtgagcagacccgacagcaaggaggtgagatacctggagttcagcgacagaaaggacctgcaccaccagggcagcaagagcgacgacaagctgtgcggcaccctgaagagcgagatcgccacccaggagctgaccggcgagaagttcctggagatggccaaccccaacgtggccggcctggaggccggcagcatcgaggacatcgtgacccagagaggcagcagagtgctgggcagcttcctgcccgagaagctgttcaagggcgtgagccagaaggagaacaccggccagcagaacgccatcatcagccccaccgtgctggagaccagcgaggagaagaccgtgagcctgaccgtgtgcagcgccgtgaagaccgagaagaccccccaggagaagctgagagagagccccggcagcgagcagacccccttcatgaccgcccccgagggcaagggcaacggcggcgtgaaccccgagcccttcagagccacccagaacgtgttcaccagacagctgtgcctggagcacgacgagaagctggtgagctacctgagcctgctgagaaacatcgagatgagaaccaagcagatccagcccctggagctgaacctggccgagctgcaggacctgctgtgccaggccaaggtgctggagagagagctgaaggacctgaccaccctggtgagccaggagctggagtgcgtgaaccagatcatcatcagccagccccaggaggtgcccgcccagctgctgaaggccctggagaaggacgccaagaacctgcagaagagcctgagcagcgtgagcgacacctggaacagcagactgctgcacttccagaacgccgtggagatcgagaagaccaaggtgctgaaccagcacacccagctggagggcagactgcaggacctgagagcctgggtgggcaacaagaacctgatcctgaacagcaagggcagcaacagcgagatcgacgtggacagcctgaacctgtgcctgcagcagtacgaggacctgaagcagcccatggccgagagaaaggcccagctggacgccctggccttcgacatccagttcttcatcagcgagcacgcccaggacctgagcccccagcagaacagacagatgctgagactgctgaacgagctgcagagaagcttccaggacatcctggagcagaccgccgcccaggtggacgccctgcagggccacctgcagcagatggagcaggaggccctggtgaagaccctgcagaagcagcagaacacctgccaccagcagctggaggacctgtgcagctgggtgggccaggccgagagagccctggccggccaccagggcagaaccacccagcaggacctgagcgccctgcagaagaaccagagcgacctgaaggacctgcaggacgacatccagaacagagccaccagcttcgccaccgtggtgaaggacatcgagggcttcatggaggagaaccagaccaagctgagccccagagagctgaccgccctgagagagaagctgcaccaggccaaggagcagtacgaggccctgcaggaggagaccagagtggcccagaaggagctggaggaggccgtgaccagcgccctgcagcaggagaccgagaagagcaaggccgccaaggagctggccgagaacaagaagaagatcgacgccctgctggactgggtgaccagcgtgggcagcagcggcggccagctgctgaccaacctgcccggcatggagcagctgagcggcgccagcctggagaagggcgccctggacaccaccgacggctacatgggcgtgaaccaggcccccgagaagctggacaagcagtgcgagatgatgaaggccagacaccaggagctgctgagccagcagcagaacttcatcctggccacccagagcgcccaggccttcctggaccagcacggccacaacctgacccccgaggagcagcagatgctgcagcagaagctgggcgagctgaaggagcagtacagcaccagcctggcccagagcgaggccgagctgaagcaggtgcagaccctgcaggacgagctgcagaagttcctgcaggaccacaaggagttcgagagctggctggagagaagcgagaaggagctggagaacatgcacaagggcggcagcagccccgagaccctgcccagcctgctgaagagacagggcagcttcagcgaggacgtgatcagccacaagggcgacctgagattcgtgaccatcagcggccagaaggtgctggacatggagaacagcttcaaggagggcaaggagcccagcgagatcggcaacctggtgaaggacaagctgaaggacgccaccgagagatacaccgccctgcacagcaagtgcaccagactgggcagccacctgaacatgctgctgggccagtaccaccagttccagaacagcgccgacagcctgcaggcctggatgcaggcctgcgaggccaacgtggagaagctgctgagcgacaccgtggccagcgaccccggcgtgctgcaggagcagctggccaccaccaagcagctgcaggaggagctggccgagcaccaggtgcccgtggagaagctgcagaaggtggccagagacatcatggagatcgagggcgagcccgcccccgaccacagacacgtgcaggagaccaccgacagcatcctgagccacttccagagcctgagctacagcctggccgagagaagcagcctgctgcagaaggccatcgcccagagccagagcgtgcaggagagcctggagagcctgctgcagagcatcggcgaggtggagcagaacctggagggcaagcaggtgagcagcctgagcagcggcgtgatccaggaggccctggccaccaacatgaagctgaagcaggacatcgccagacagaagagcagcctggaggccaccagagagatggtgaccagattcatggagaccgccgacagcaccaccgccgccgtgctgcagggcaagctggccgaggtgagccagagattcgagcagctgtgcctgcagcagcaggagaaggagagcagcctgaagaagctgctgccccaggccgagatgttcgagcacctgagcggcaagctgcagcagttcatggagaacaagagcagaatgctggccagcggcaaccagcccgaccaggacatcacccacttcttccagcagatccaggagctgaacctggagatggaggaccagcaggagaacctggacaccctggagcacctggtgaccgagctgagcagctgcggcttcgccctggacctgtgccagcaccaggacagagtgcagaacctgagaaaggacttcaccgagctgcagaagaccgtgaaggagagagagaaggacgccagcagctgccaggagcagctggacgagttcagaaagctggtgagaaccttccagaagtggctgaaggagaccgagggcagcatcccccccaccgagaccagcatgagcgccaaggagctggagaagcagatcgagcacctgaagagcctgctggacgactgggccagcaagggcaccctggtggaggagatcaactgcaagggcaccagcctggagaacctgatcatggagatcaccgcccccgacagccagggcaagaccggcagcatcctgcccagcgtgggcagcagcgtgggcagcgtgaacggctaccacacctgcaaggacctgaccgagatccagtgcgacatgagcgacgtgaacctgaagtacgagaagctgggcggcgtgctgcacgagagacaggagagcctgcaggccatcctgaacagaatggaggaggtgcacaaggaggccaacagcgtgctgcagtggctggagagcaaggaggaggtgctgaagagcatggacgccatgagcagccccaccaagaccgagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagcagatgggagagagccaccgaggtgaccgtggccagacagagacagctggaggagagcgccagccacctggcctgcttccaggccgccgagagccagctgagaccctggctgatggagaaggagctgatgatgggcgtgctgggccccctgagcatcgaccccaacatgctgaacgcccagaagcagcaggtgcagttcatgctgaaggagttcgaggccagaagacagcagcacgagcagctgaacgaggccgcccagggcatcctgaccggccccggcgacgtgagcctgagcaccagccaggtgcagaaggagctgcagagcatcaaccagaagtgggtggagctgaccgacaagctgaacagcagaagcagccagatcgaccaggccatcgtgaagagcacccagtaccaggagctgctgcaggacctgagcgagaaggtgagagccgtgggccagagactgagcgtgcagagcgccatcagcacccagcccgaggccgtgaagcagcagctggaggagaccagcgagatcagaagcgacctggagcagctggaccacgaggtgaaggaggcccagaccctgtgcgacgagctgagcgtgctgatcggcgagcagtacctgaaggacgagctgaagaagagactggagaccgtggccctgcccctgcagggcctggaggacctggccgccgacagaatcaacagactgcaggccgccctggccagcacccagcagttccagcagatgttcgacgagctgagaacctggctggacgacaagcagagccagcaggccaagaactgccccatcagcgccaagctggagagactgcagagccagctgcaggagaacgaggagttccagaagagcctgaaccagcacagcggcagctacgaggtgatcgtggccgagggcgagagcctgctgctgagcgtgccccccggcgaggagaagagaaccctgcagaaccagctggtggagctgaagaaccactgggaggagctgagcaagaagaccgccgacagacagagcagactgaaggactgcatgcagaaggcccagaagtaccagtggcacgtggaggacctggtgccctggatcgaggactgcaaggccaagatgagcgagctgagagtgaccctggaccccgtgcagctggagagcagcctgctgagaagcaaggccatgctgaacgaggtggagaagagaagaagcctgctggagatcctgaacagcgccgccgacatcctgatcaacagcagcgaggccgacgaggacggcatcagagacgagaaggccggcatcaaccagaacatggacgccgtgaccgaggagctgcaggccaagaccggcagcctggaggagatgacccagagactgagagagttccaggagagcttcaagaacatcgagaagaaggtggagggcgccaagcaccagctggagatcttcgacgccctgggcagccaggcctgcagcaacaagaacctggagaagctgagagcccagcaggaggtgctgcaggccctggagccccaggtggactacctgagaaacttcacccagggcctggtggaggacgcccccgacggcagcgacgccagccagctgctgcaccaggccgaggtggcccagcaggagttcctggaggtgaagcagagagtgaacagcggctgcgtgatgatggagaacaagctggagggcatcggccagttccactgcagagtgagagagatgttcagccagctggccgacctggacgacgagctggacggcatgggcgccatcggcagagacaccgacagcctgcagagccagatcgaggacgtgagactgttcctgaacaagatccacgtgctgaagctggacatcgaggccagcgaggccgagtgcagacacatgctggaggaggagggcaccctggacctgctgggcctgaagagagagctggaggccctgaacaagcagtgcggcaagctgaccgagagaggcaaggccagacaggagcagctggagctgaccctgggcagagtggaggacttctacagaaagctgaagggcctgaacgacgccaccaccgccgccgaggaggccgaggccctgcagtgggtggtgggcaccgaggtggagatcatcaaccagcagctggccgacttcaagatgttccagaaggagcaggtggaccccctgcagatgaagctgcagcaggtgaacggcctgggccagggcctgatccagagcgccggcaaggactgcgacgtgcagggcctggagcacgacatggaggagatcaacgccagatggaacaccctgaacaagaaggtggcccagagaatcgcccagctgcaggaggccctgctgcactgcggcaagttccaggacgccctggagcccctgctgagctggctggccgacaccgaggagctgatcgccaaccagaagccccccagcgccgagtacaaggtggtgaaggcccagatccaggagcagaagctgctgcagagactgctggacgacagaaaggccaccgtggacatgctgcaggccgagggcggcagaatcgcccagagcgccgagctggccgacagagagaagatcaccggccagctggagagcctggagagcagatggaccgagctgctgagcaaggccgccgccagacagaagcagctggaggacatcctggtgctggccaagcagttccacgagaccgccgagcccatcagcgacttcctgagcgtgaccgagaagaagctggccaacagcgagcccgtgggcacccagaccgccaagatccagcagcagatcatcagacacaaggccctgaacgaggagatcgtgaacagaaagaagaacgtggaccaggccatcaagaacggccaggccctgctgaagcagaccaccggcgaggaggtgctgctgatccaggagaagctggacggcatcaagaccagatacgccgacatcaccgtgaccagcagcaaggccctgagaaccctggagcaggccagacagctggccaccaagttccagagcacctacgaggagctgaccggctggctgagagaggtggaggaggagctggccaccagcggcggccagagccccaccggcgagcagatcccccagttccagcagagacagaaggagctgaagaaggaggtgatggagcacagactggtgctggacaccgtgaacgaggtgagcagagccctgctggagctggtgccctggagagccagagagggcctggacaagctggtgagcgacgccaacgagcagtacaagctggtgagcgacaccatcggccagagagtggacgagatcgacgccgccatccagagaagccagcagtacgagcaggccgccgacgccgagctggcctgggtggccgagaccaagagaaagctgatggccctgggccccatcagactggagcaggaccagaccaccgcccagctgcaggtgcagaaggccttcagcatcgacatcatcagacacaaggacagcatggacgagctgttcagccacagaagcgagatcttcggcacctgcggcgaggagcagaagaccgtgctgcaggagaagaccgagagcctgatccagcagtacgaggccatcagcctgctgaacagcgagagatacgccagactggagagagcccaggtgctggtgaaccagttctgggagacctacgaggagctgagcccctggatcgaggagaccagagccctgatcgcccagctgcccagccccgccatcgaccacgagcagctgagacagcagcaggaggagatgagacagctgagagagagcatcgccgagcacaagccccacatcgacaagctgctgaagatcggcccccagctgaaggagctgaaccccgaggagggcgagatggtggaggagaagtaccagaaggccgagaacatgtacgcccagatcaaggaggaggtgagacagagagccctggccctggacgaggccgtgagccagagcacccagatcaccgagttccacgacaagatcgagcccatgctggagaccctggagaacctgagcagcagactgagaatgccccccctgatccccgccgaggtggacaagatcagagagtgcatcagcgacaacaagagcgccaccgtggagctggagaagctgcagcccagcttcgaggccctgaagagaagaggcgaggagctgatcggcagaagccagggcgccgacaaggacctggccgccaaggagatccaggacaagctggaccagatggtgttcttctgggaggacatcaaggccagagccgaggagagagagatcaagttcctggacgtgctggagctggccgagaagttctggtacgacatggccgccctgctgaccaccatcaaggacacccaggacatcgtgcacgacctggagagccccggcatcgaccccagcatcatcaagcagcaggtggaggccgccgagaccatcaaggaggagaccgacggcctgcacgaggagctggagttcatcagaatcctgggcgccgacctgatcttcgcctgcggcgagaccgagaagcccgaggtgagaaagagcatcgacgagatgaacaacgcctgggagaacctgaacaagacctggaaggagagactggagaagctggaggacgccatgcaggccgccgtgcagtaccaggacaccctgcaggccatgttcgactggctggacaacaccgtgatcaagctgtgcaccatgccccccgtgggcaccgacctgaacaccgtgaaggaccagctgaacgagatgaaggagttcaaggtggaggtgtaccagcagcagatcgagatggagaagctgaaccaccagggcgagctgatgctgaagaaggccaccgacgagaccgacagagacatcatcagagagcccctgaccgagctgaagcacctgtgggagaacctgggcgagaagatcgcccacagacagcacaagctggagggcgccctgctggccctgggccagttccagcacgccctggaggagctgatgagctggctgacccacaccgaggagctgctggacgcccagagacccatcagcggcgaccccaaggtgatcgaggtggagctggccaagcaccacgtgctgaagaacgacgtgctggcccaccaggccaccgtggagaccgtgaacaaggccggcaacgagctgctggagagcagcgccggcgacgacgccagcagcctgagaagcagactggaggccatgaaccagtgctgggagagcgtgctgcagaagaccgaggagagagagcagcagctgcagagcaccctgcagcaggcccagggcttccacagcgagatcgaggacttcctgctggagctgaccagaatggagagccagctgagcgccagcaagcccaccggcggcctgcccgagaccgccagagagcagctggacacccacatggagctgtacagccagctgaaggccaaggaggagacctacaaccagctgctggacaagggcagactgatgctgctgagcagagacgacagcggcagcggcagcaagaccgagcagagcgtggccctgctggagcagaagtggcacgtggtgagcagcaagatggaggagagaaagagcaagctggaggaggccctgaacctggccaccgagttccagaacagcctgcaggagttcatcaactggctgaccctggccgagcagagcctgaacatcgccagcccccccagcctgatcctgaacaccgtgctgagccagatcgaggagcacaaggtgttcgccaacgaggtgaacgcccacagagaccagatcatcgagctggaccagaccggcaaccagctgaagttcctgagccagaagcaggacgtggtgctgatcaagaacctgctggtgagcgtgcagagcagatgggagaaggtggtgcagagaagcatcgagagaggcagaagcctggacgacgccagaaagagagccaagcagttccacgaggcctggaagaagctgatcgactggctggaggacgccgagagccacctggacagcgagctggagatcagcaacgaccccgacaagatcaagctgcagctgagcaagcacaaggagttccagaagaccctgggcggcaagcagcccgtgtacgacaccaccatcagaaccggcagagccctgaaggagaagaccctgctgcccgaggacagccagaagctggacaacttcctgggcgaggtgagagacaagtgggacaccgtgtgcggcaagagcgtggagagacagcacaagctggaggaggccctgctgttcagcggccagttcatggacgccctgcaggccctggtggactggctgtacaaggtggagccccagctggccgaggaccagcccgtgcacggcgacctggacctggtgatgaacctgatggacgcccacaaggtgttccagaaggagctgggcaagagaaccggcaccgtgcaggtgctgaagagaagcggcagagagctgatcgagaacagcagagacgacaccacctgggtgaagggccagctgcaggagctgagcaccagatgggacaccgtgtgcaagctgagcgtgagcaagcagagcagactggagcaggccctgaagcaggccgaggtgttcagagacaccgtgcacatgctgctggagtggctgagcgaggccgagcagaccctgagattcagaggcgccctgcccgacgacaccgaggccctgcagagcctgatcgacacccacaaggagttcatgaagaaggtggaggagaagagagtggacgtgaacagcgccgtggccatgggcgaggtgatcctggccgtgtgccaccccgactgcatcaccaccatcaagcactggatcaccatcatcagagccagattcgaggaggtgctgacctgggccaagcagcaccagcagagactggagaccgccctgagcgagctggtggccaacgccgagctgctggaggagctgctggcctggatccagtgggccgagaccaccctgatccagagagaccaggagcccatcccccagaacatcgacagagtgaaggccctgatcgccgagcaccagaccttcatggaggagatgaccagaaagcagcccgacgtggacagagtgaccaagacctacaagagaaagaacatcgagcccacccacgcccccttcatcgagaagagcagaagcggcggcagaaagagcctgagccagcccacccccccccccatgcccatcctgagccagagcgaggccaagaaccccagaatcaaccagctgagcgccagatggcagcaggtgtggctgctggccctggagagacagagaaagctgaacgacgccctggacagactggaggagctgaaggagttcgccaacttcgacttcgacgtgtggagaaagaagtacatgagatggatgaaccacaagaagagcagagtgatggacttcttcagaagaatcgacaaggaccaggacggcaagatcaccagacaggagttcatcgacggcatcctggccagcaagttccccaccaccaagctggagatgaccgccgtggccgacatcttcgacagagacggcgacggctacatcgactactacgagttcgtggccgccctgcaccccaacaaggacgcctacagacccaccaccgacgccgacaagatcgaggacgaggtgaccagacaggtggcccagtgcaagtgcgccaagagattccaggtggagcagatcggcgagaacaagtacagattcggcgacagccagcagctgagactggtgagaatcctgagaagcaccgtgatggtgagagtgggcggcggctggatggccctggacgagttcctggtgaagaacgacccctgcagagccagaggcagaaccaacatcgagctgagagagaagttcatcctgcccgagggcgccagccagggcatgacccccttcagaagcagaggcagaagaagcaagcccagcagcagagccgccagccccaccagaagcagcagcagcgccagccagagcaaccacagctgcaccagcatgcccagcagccccgccacccccgccagcggcaccaaggtgatccccagcagcggcagcaagctgaagagacccacccccaccttccacagcagcagaaccagcctggccggcgacaccagcaacagcagcagccccgccagcaccggcgccaagaccaacagagccgaccccaagaagagcgccagcagacccggcagcagagccggcagcagagccggcagcagagccagcagcagaagaggcagcgacgccagcgacttcgacctgctggagacccagagcgcctgcagcgacaccagcgagagcagcgccgccggcggccagggcaacagcagaagaggcctgaacaagcccagcaagatccccaccatgagcaagaagaccaccaccgccagccccagaacccccggccccaagagatag

SEQ ID NO: 88952 - DNA, 1155 bp, Artificial Sequence
  Description of Artificial Sequence: Synthetic coding sequence
atcaccagcccctgggcccccagacccagctgcagcagcccctgggccatgagcagcagcgacgaggagaccctgagcgagagaagctgcagaagcgagagaagctgcagaagcgagagaagctacagaagcgagagaagcggcagcctgagcccctgcccccccggcgacaccctgccctggaacctgcccctgcacgagcagaagaagagaaagagccaggacagcgtgctggaccccgccgagagagccgtggtgagagtggccgacgagagagacagagtgcagaagaagaccttcaccaagtgggtgaacaagcacctgatgaaggtgagaaagcacatcaacgacctgtacgaggacctgagagacggccacaacctgatcagcctgctggaggtgctgagcggcatcaagctgcccagagagaagggcagaatgagattccacagactgcagaacgtgcagatcgccctggacttcctgaagcagagacaggtgaagctggtgaacatcagaaacgacgacatcaccgacggcaaccccaagctgaccctgggcctgatctggaccatcatcctgcacttccagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagacccgacctggtggacatggagagagtgcagatccagagcaacagagagaacctggagcaggccttcgaggtggccgagagactgggcgtgaccagactgctggacgccgaggacgtggacgtgcccagccccgacgagaagagcgtgatcacctacgtgagcagcatctacgacgccttccccaaggtgcccgagggcggcgagggcatcagcgccaccgaggtggacagcagatggcaggagtaccagagcagagtggacagcctgatcccctggatcaagcagcacaccatcctgatgagcgacaagaccttcccccagaaccccgtggagctgaaggccctgtacaaccagtacatccacttcaaggagaccgagatcctggccaaggagtag

SEQ ID NO: 88953 - DNA, 603 bp, Artificial Sequence
  Description of Artificial Sequence: Synthetic coding sequence
atgcccctgctggacagcagctacctgccccccaccatcttcatcctgacccacgtgctgggcgtggccggcgtgctgtactggaagagacacgccagaggcagagccgacgagagagacagagtgcagaagaagaccttcaccaagtgggtgaacaagcacctgatgaaggtgagaaagcacatcaacgacctgtacgaggacctgagagacggccacaacctgatcagcctgctggaggtgctgagcggcatcaagctgcccagagagaagggcagaatgagattccacagactgcagaacgtgcagatcgccctggacttcctgaagcagagacaggtgaagctggtgaacatcagaaacgacgacatcaccgacggcaaccccaagctgaccctgggcctgatctggaccatcatcctgcacttccagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagatag

SEQ ID NO: 88954 - DNA, 15903 bp, Artificial Sequence
  Description of Artificial Sequence: Synthetic coding sequence
atgagcagcagcgacgaggagaccctgagcgagagaagctgcagaagcgagagaagctgcagaagcgagagaagctacagaagcgagagaagcggcagcctgagcccctgcccccccggcgacaccctgccctggaacctgcccctgcacgagcagaagaagagaaagagccaggacagcgtgctggaccccgccgagagagccgtggtgagagtggccgacgagagagacagagtgcagaagaagaccttcaccaagtgggtgaacaagcacctgatgaaggtgagaaagcacatcaacgacctgtacgaggacctgagagacggccacaacctgatcagcctgctggaggtgctgagcggcatcaagctgcccagagagaagggcagaatgagattccacagactgcagaacgtgcagatcgccctggacttcctgaagcagagacaggtgaagctggtgaacatcagaaacgacgacatcaccgacggcaaccccaagctgaccctgggcctgatctggaccatcatcctgcacttccagatcagcgacatctacatcagcggcgagagcggcgacatgagcgccaaggagaagctgctgctgtggacccagaaggtgaccgccggctacaccggcatcaagtgcaccaacttcagcagctgctggagcgacggcaagatgttcaacgccctgatccacagatacagacccgacctggtggacatggagagagtgcagatccagagcaacagagagaacctggagcaggccttcgaggtggccgagagactgggcgtgaccagactgctggacgccgaggacgtggacgtgcccagccccgacgagaagagcgtgatcacctacgtgagcagcatctacgacgccttccccaaggtgcccgagggcggcgagggcatcagcgccaccgaggtggacagcagatggcaggagtaccagagcagagtggacagcctgatcccctggatcaagcagcacaccatcctgatgagcgacaagaccttcccccagaaccccgtggagctgaaggccctgtacaaccagtacatccacttcaaggagaccgagatcctggccaaggagagagagaagggcagaatcgaggagctgtacaagctgctggaggtgtggatcgagttcggcagaatcaagctgccccagggctaccaccccaacgacgtggaggaggagtggggcaagctgatcatcgagatgctggagagagagaagagcctgagacccgccgtggagagactggagctgctgctgcagatcgccaacaagatccagaacggcgccctgaactgcgaggagaagctgaccctggccaagaacaccctgcaggccgacgccgcccacctggagagcggccagcccgtgcagtgcgagagcgacgtgatcatgtacatccaggagtgcgagggcctgatcagacagctgcaggtggacctgcagatcctgagagacgagaactactaccagctggaggagctggccttcagagtgatgagactgcaggacgagctggtgaccctgagactggagtgcaccaacctgtacagaaagggccacttcaccagcctggagctggtgccccccagcaccctgaccaccacccacctgaaggccgagcccctgaccaaggccacccacagcagcagcaccagctggttcagaaagcccatgaccagagccgagctggtggccatcagcagcagcgaggacgagggcaacctgagattcgtgtacgagctgctgagctgggtggaggagatgcagatgaagctggagagagccgagtggggcaacgacctgcccagcgtggagctgcagctggagacccagcagcacatccacaccagcgtggaggagctgggcagcagcgtgaaggaggccagactgtacgagggcaagatgagccagaacttccacaccagctacgccgagaccctgggcaagctggagacccagtactgcaagctgaaggagaccagcagcttcagaatgagacacctgcagagcctgcacaagttcgtgagcagagccaccgccgagctgatctggctgaacgagaaggaggaggaggagctggcctacgactggagcgacaacaacagcaacatcagcgccaagagaaactacttcagcgagctgaccatggagctggaggagaagcaggacgtgttcagaagcctgcaggacaccgccgagctgctgagcctggagaaccaccccgccaagcagaccgtggaggcctacagcgccgccgtgcagagccagctgcagtggatgaagcagctgtgcctgtgcgtggagcagcacgtgaaggagaacaccgcctacttccagttcttcagcgacgccagagagctggagagcttcctgagaaacctgcaggacagcatcaagagaaagtacagctgcgaccacaacaccagcctgagcagactggaggacctgctgcaggacagcatggacgagaaggagcagctgatccagagcaagagcagcgtggccagcctggtgggcagaagcaagaccatcgtgcagctgaagcccagaagccccgaccacgtgctgaagaacaccatcagcgtgaaggccgtgtgcgactacagacagatcgagatcaccatctgcaagaacgacgagtgcgtgctggaggacaacagccagagaaccaagtggaaggtgatcagccccaccggcaacgaggccatggtgcccagcgtgtgcttcctgatccccccccccaacaaggacgccatcgagatggccagcagagtggagcagagctaccagaaggtgatggccctgtggcaccagctgcacgtgaacaccaagagcctgatcagctggaactacctgagaaaggacctggacctggtgcagacctggaacctggagaagctgagaagcagcgcccccggcgagtgccaccagatcatgaagaacctgcaggcccactacgaggacttcctgcaggacagcagagacagcgtgctgttcagcgtggccgacagactgagactggaggaggaggtggaggcctgcaaggccagattccagcacctgatgaagagcatggagaacgaggacaaggaggagaccgtggccaagatgtacatcagcgagctgaagaacatcagactgagactggaggagtacgagcagagagtggtgaagagaatccagagcctggccagcagcagaaccgacagagacgcctggcaggacaacgccctgagaatcgccgagcaggagcacacccaggaggacctgcagcagctgagaagcgacctggacgccgtgagcatgaagtgcgacagcttcctgcaccagagccccagcagcagcagcgtgcccaccctgagaagcgagctgaacctgctggtggagaagatggaccacgtgtacggcctgagcaccgtgtacctgaacaagctgaagaccgtggacgtgatcgtgagaagcatccaggacgccgagctgctggtgaagggctacgagatcaagctgagccaggaggaggtggtgctggccgacctgagcgccctggaggcccactggagcaccctgagacactggctgagcgacgtgaaggacaagaacagcgtgttcagcgtgctggacgaggagatcgccaaggccaaggtggtggccgagcagatgagcagactgacccccgagagaaacctggacctggagagataccaggagaagggcagccagctgcaggagagatggcacagagtgatcgcccagctggagatcagacagagcgagctggagagcatccaggaggtgctgggcgactacagagcctgccacggcaccctgatcaagtggatcgaggagaccaccgcccagcaggagatgatgaagcccggccaggccgaggacagcagagtgctgagcgagcagctgagccagcagaccgccctgttcgccgagatcgagagaaaccagaccaagctggaccagtgccagaagttcagccagcagtacagcaccatcgtgaaggactacgagctgcagctgatgacctacaaggccttcgtggagagccagcagaagagccccggcaagagaagaagaatgctgagcagcagcgacgccatcacccaggagttcatggacctgagaaccagatacaccgccctggtgaccctgaccacccagcacgtgaagtacatcagcgacgccctgagaagactggaggaggaggagaaggtggtggaggaggagaagcaggagcacgtggagaaggtgaaggagctgctgggctgggtgagcaccctggccagaaacacccagggcaaggccaccagcagcgagaccaaggagagcaccgacatcgagaaggccatcctggagcagcaggtgctgagcgaggagctgaccaccaagaaggagcaggtgagcgaggccatcaagaccagccagatcttcctggccaagcacggccacaagctgagcgagaaggagaagaagcagatcagcgagcagctgaacgccctgaacaaggcctaccacgacctgtgcgacggcagcgccaaccagctgcagcagctgcagagccagctggcccaccagaccgagcagaagaccctgcagaagcagcagaacacctgccaccagcagctggaggacctgtgcagctgggtgggccaggccgagagagccctggccggccaccagggcagaaccacccagcaggacctgagcgccctgcagaagaaccagagcgacctgaaggacctgcaggacgacatccagaacagagccaccagcttcgccaccgtggtgaaggacatcgagggcttcatggaggagaaccagaccaagctgagccccagagagctgaccgccctgagagagaagctgcaccaggccaaggagcagtacgaggccctgcaggaggagaccagagtggcccagaaggagctggaggaggccgtgaccagcgccctgcagcaggagaccgagaagagcaaggccgccaaggagctggccgagaacaagaagaagatcgacgccctgctggactgggtgaccagcgtgggcagcagcggcggccagctgctgaccaacctgcccggcatggagcagctgagcggcgccagcctggagaagggcgccctggacaccaccgacggctacatgggcgtgaaccaggcccccgagaagctggacaagcagtgcgagatgatgaaggccagacaccaggagctgctgagccagcagcagaacttcatcctggccacccagagcgcccaggccttcctggaccagcacggccacaacctgacccccgaggagcagcagatgctgcagcagaagctgggcgagctgaaggagcagtacagcaccagcctggcccagagcgaggccgagctgaagcaggtgcagaccctgcaggacgagctgcagaagttcctgcaggaccacaaggagttcgagagctggctggagagaagcgagaaggagctggagaacatgcacaagggcggcagcagccccgagaccctgcccagcctgctgaagagacagggcagcttcagcgaggacgtgatcagccacaagggcgacctgagattcgtgaccatcagcggccagaaggtgctggacatggagaacagcttcaaggagggcaaggagcccagcgagatcggcaacctggtgaaggacaagctgaaggacgccaccgagagatacaccgccctgcacagcaagtgcaccagactgggcagccacctgaacatgctgctgggccagtaccaccagttccagaacagcgccgacagcctgcaggcctggatgcaggcctgcgaggccaacgtggagaagctgctgagcgacaccgtggccagcgaccccggcgtgctgcaggagcagctggccaccaccaagcagctgcaggaggagctggccgagcaccaggtgcccgtggagaagctgcagaaggtggccagagacatcatggagatcgagggcgagcccgcccccgaccacagacacgtgcaggagaccaccgacagcatcctgagccacttccagagcctgagctacagcctggccgagagaagcagcctgctgcagaaggccatcgcccagagccagagcgtgcaggagagcctggagagcctgctgcagagcatcggcgaggtggagcagaacctggagggcaagcaggtgagcagcctgagcagcggcgtgatccaggaggccctggccaccaacatgaagctgaagcaggacatcgccagacagaagagcagcctggaggccaccagagagatggtgaccagattcatggagaccgccgacagcaccaccgccgccgtgctgcagggcaagctggccgaggtgagccagagattcgagcagctgtgcctgcagcagcaggagaaggagagcagcctgaagaagctgctgccccaggccgagatgttcgagcacctgagcggcaagctgcagcagttcatggagaacaagagcagaatgctggccagcggcaaccagcccgaccaggacatcacccacttcttccagcagatccaggagctgaacctggagatggaggaccagcaggagaacctggacaccctggagcacctggtgaccgagctgagcagctgcggcttcgccctggacctgtgccagcaccaggacagagtgcagaacctgagaaaggacttcaccgagctgcagaagaccgtgaaggagagagagaaggacgccagcagctgccaggagcagctggacgagttcagaaagctggtgagaaccttccagaagtggctgaaggagaccgagggcagcatcccccccaccgagaccagcatgagcgccaaggagctggagaagcagatcgagcacctgaagagcctgctggacgactgggccagcaagggcaccctggtggaggagatcaactgcaagggcaccagcctggagaacctgatcatggagatcaccgcccccgacagccagggcaagaccgacctgaccgagatccagtgcgacatgagcgacgtgaacctgaagtacgagaagctgggcggcgtgctgcacgagagacaggagagcctgcaggccatcctgaacagaatggaggaggtgcacaaggaggccaacagcgtgctgcagtggctggagagcaaggaggaggtgctgaagagcatggacgccatgagcagccccaccaagaccgagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagcagatgggagagagccaccgaggtgaccgtggccagacagagacagctggaggagagcgccagccacctggcctgcttccaggccgccgagagccagctgagaccctggctgatggagaaggagctgatgatgggcgtgctgggccccctgagcatcgaccccaacatgctgaacgcccagaagcagcaggtgcagttcatgctgaaggagttcgaggccagaagacagcagcacgagcagctgaacgaggccgcccagggcatcctgaccggccccggcgacgtgagcctgagcaccagccaggtgcagaaggagctgcagagcatcaaccagaagtgggtggagctgaccgacaagctgaacagcagaagcagccagatcgaccaggccatcgtgaagagcacccagtaccaggagctgctgcaggacctgagcgagaaggtgagagccgtgggccagagactgagcgtgcagagcgccatcagcacccagcccgaggccgtgaagcagcagctggaggagaccagcgagatcagaagcgacctggagcagctggaccacgaggtgaaggaggcccagaccctgtgcgacgagctgagcgtgctgatcggcgagcagtacctgaaggacgagctgaagaagagactggagaccgtggccctgcccctgcagggcctggaggacctggccgccgacagaatcaacagactgcaggccgccctggccagcacccagcagttccagcagatgttcgacgagctgagaacctggctggacgacaagcagagccagcaggccaagaactgccccatcagcgccaagctggagagactgcagagccagctgcaggagaacgaggagttccagaagagcctgaaccagcacagcggcagctacgaggtgatcgtggccgagggcgagagcctgctgctgagcgtgccccccggcgaggagaagagaaccctgcagaaccagctggtggagctgaagaaccactgggaggagctgagcaagaagaccgccgacagacagagcagactgaaggactgcatgcagaaggcccagaagtaccagtggcacgtggaggacctggtgccctggatcgaggactgcaaggccaagatgagcgagctgagagtgaccctggaccccgtgcagctggagagcagcctgctgagaagcaaggccatgctgaacgaggtggagaagagaagaagcctgctggagatcctgaacagcgccgccgacatcctgatcaacagcagcgaggccgacgaggacggcatcagagacgagaaggccggcatcaaccagaacatggacgccgtgaccgaggagctgcaggccaagaccggcagcctggaggagatgacccagagactgagagagttccaggagagcttcaagaacatcgagaagaaggtggagggcgccaagcaccagctggagatcttcgacgccctgggcagccaggcctgcagcaacaagaacctggagaagctgagagcccagcaggaggtgctgcaggccctggagccccaggtggactacctgagaaacttcacccagggcctggtggaggacgcccccgacggcagcgacgccagccagctgctgcaccaggccgaggtggcccagcaggagttcctggaggtgaagcagagagtgaacagcggctgcgtgatgatggagaacaagctggagggcatcggccagttccactgcagagtgagagagatgttcagccagctggccgacctggacgacgagctggacggcatgggcgccatcggcagagacaccgacagcctgcagagccagatcgaggacgtgagactgttcctgaacaagatccacgtgctgaagctggacatcgaggccagcgaggccgagtgcagacacatgctggaggaggagggcaccctggacctgctgggcctgaagagagagctggaggccctgaacaagcagtgcggcaagctgaccgagagaggcaaggccagacaggagcagctggagctgaccctgggcagagtggaggacttctacagaaagctgaagggcctgaacgacgccaccaccgccgccgaggaggccgaggccctgcagtgggtggtgggcaccgaggtggagatcatcaaccagcagctggccgacttcaagatgttccagaaggagcaggtggaccccctgcagatgaagctgcagcaggtgaacggcctgggccagggcctgatccagagcgccggcaaggactgcgacgtgcagggcctggagcacgacatggaggagatcaacgccagatggaacaccctgaacaagaaggtggcccagagaatcgcccagctgcaggaggccctgctgcactgcggcaagttccaggacgccctggagcccctgctgagctggctggccgacaccgaggagctgatcgccaaccagaagccccccagcgccgagtacaaggtggtgaaggcccagatccaggagcagaagctgctgcagagactgctggacgacagaaaggccaccgtggacatgctgcaggccgagggcggcagaatcgcccagagcgccgagctggccgacagagagaagatcaccggccagctggagagcctggagagcagatggaccgagctgctgagcaaggccgccgccagacagaagcagctggaggacatcctggtgctggccaagcagttccacgagaccgccgagcccatcagcgacttcctgagcgtgaccgagaagaagctggccaacagcgagcccgtgggcacccagaccgccaagatccagcagcagatcatcagacacaaggccctgaacgaggagatcgtgaacagaaagaagaacgtggaccaggccatcaagaacggccaggccctgctgaagcagaccaccggcgaggaggtgctgctgatccaggagaagctggacggcatcaagaccagatacgccgacatcaccgtgaccagcagcaaggccctgagaaccctggagcaggccagacagctggccaccaagttccagagcacctacgaggagctgaccggctggctgagagaggtggaggaggagctggccaccagcggcggccagagccccaccggcgagcagatcccccagttccagcagagacagaaggagctgaagaaggaggtgatggagcacagactggtgctggacaccgtgaacgaggtgagcagagccctgctggagctggtgccctggagagccagagagggcctggacaagctggtgagcgacgccaacgagcagtacaagctggtgagcgacaccatcggccagagagtggacgagatcgacgccgccatccagagaagccagcagtacgagcaggccgccgacgccgagctggcctgggtggccgagaccaagagaaagctgatggccctgggccccatcagactggagcaggaccagaccaccgcccagctgcaggtgcagaaggccttcagcatcgacatcatcagacacaaggacagcatggacgagctgttcagccacagaagcgagatcttcggcacctgcggcgaggagcagaagaccgtgctgcaggagaagaccgagagcctgatccagcagtacgaggccatcagcctgctgaacagcgagagatacgccagactggagagagcccaggtgctggtgaaccagttctgggagacctacgaggagctgagcccctggatcgaggagaccagagccctgatcgcccagctgcccagccccgccatcgaccacgagcagctgagacagcagcaggaggagatgagacagctgagagagagcatcgccgagcacaagccccacatcgacaagctgctgaagatcggcccccagctgaaggagctgaaccccgaggagggcgagatggtggaggagaagtaccagaaggccgagaacatgtacgcccagatcaaggaggaggtgagacagagagccctggccctggacgaggccgtgagccagagcacccaggtgagccagttccacgacaagatcgagcccatgctggagaccctggagaacctgagcagcagactgagaatgccccccctgatccccgccgaggtggacaagatcagagagtgcatcagcgacaacaagagcgccaccgtggagctggagaagctgcagcccagcttcgaggccctgaagagaagaggcgaggagctgatcggcagaagccagggcgccgacaaggacctggccgccaaggagatccaggacaagctggaccagatggtgttcttctgggaggacatcaaggccagagccgaggagagagagatcaagttcctggacgtgctggagctggccgagaagttctggtacgacatggccgccctgctgaccaccatcaaggacacccaggacatcgtgcacgacctggagagccccggcatcgaccccagcatcatcaagcagcaggtggaggccgccgagaccatcaaggaggagaccgacggcctgcacgaggagctggagttcatcagaatcctgggcgccgacctgatcttcgcctgcggcgagaccgagaagcccgaggtgagaaagagcatcgacgagatgaacaacgcctgggagaacctgaacaagacctggaaggagagactggagaagctggaggacgccatgcaggccgccgtgcagtaccaggacaccctgcaggccatgttcgactggctggacaacaccgtgatcaagctgtgcaccatgccccccgtgggcaccgacctgaacaccgtgaaggaccagctgaacgagatgaaggagttcaaggtggaggtgtaccagcagcagatcgagatggagaagctgaaccaccagggcgagctgatgctgaagaaggccaccgacgagaccgacagagacatcatcagagagcccctgaccgagctgaagcacctgtgggagaacctgggcgagaagatcgcccacagacagcacaagctggagggcgccctgctggccctgggccagttccagcacgccctggaggagctgatgagctggctgacccacaccgaggagctgctggacgcccagagacccatcagcggcgaccccaaggtgatcgaggtggagctggccaagcaccacgtgctgaagaacgacgtgctggcccaccaggccaccgtggagaccgtgaacaaggccggcaacgagctgctggagagcagcgccggcgacgacgccagcagcctgagaagcagactggaggccatgaaccagtgctgggagagcgtgctgcagaagaccgaggagagagagcagcagctgcagagcaccctgcagcaggcccagggcttccacagcgagatcgaggacttcctgctggagctgaccagaatggagagccagctgagcgccagcaagcccaccggcggcctgcccgagaccgccagagagcagctggacacccacatggagctgtacagccagctgaaggccaaggaggagacctacaaccagctgctggacaagggcagactgatgctgctgagcagagacgacagcggcagcggcagcaagaccgagcagagcgtggccctgctggagcagaagtggcacgtggtgagcagcaagatggaggagagaaagagcaagctggaggaggccctgaacctggccaccgagttccagaacagcctgcaggagttcatcaactggctgaccctggccgagcagagcctgaacatcgccagcccccccagcctgatcctgaacaccgtgctgagccagatcgaggagcacaaggtgttcgccaacgaggtgaacgcccacagagaccagatcatcgagctggaccagaccggcaaccagctgaagttcctgagccagaagcaggacgtggtgctgatcaagaacctgctggtgagcgtgcagagcagatgggagaaggtggtgcagagaagcatcgagagaggcagaagcctggacgacgccagaaagagagccaagcagttccacgaggcctggaagaagctgatcgactggctggaggacgccgagagccacctggacagcgagctggagatcagcaacgaccccgacaagatcaagctgcagctgagcaagcacaaggagttccagaagaccctgggcggcaagcagcccgtgtacgacaccaccatcagaaccggcagagccctgaaggagaagaccctgctgcccgaggacagccagaagctggacaacttcctgggcgaggtgagagacaagtgggacaccgtgtgcggcaagagcgtggagagacagcacaagctggaggaggccctgctgttcagcggccagttcatggacgccctgcaggccctggtggactggctgtacaaggtggagccccagctggccgaggaccagcccgtgcacggcgacctggacctggtgatgaacctgatggacgcccacaaggtgttccagaaggagctgggcaagagaaccggcaccgtgcaggtgctgaagagaagcggcagagagctgatcgagaacagcagagacgacaccacctgggtgaagggccagctgcaggagctgagcaccagatgggacaccgtgtgcaagctgagcgtgagcaagcagagcagactggagcaggccctgaagcaggccgaggtgttcagagacaccgtgcacatgctgctggagtggctgagcgaggccgagcagaccctgagattcagaggcgccctgcccgacgacaccgaggccctgcagagcctgatcgacacccacaaggagttcatgaagaaggtggaggagaagagagtggacgtgaacagcgccgtggccatgggcgaggtgatcctggccgtgtgccaccccgactgcatcaccaccatcaagcactggatcaccatcatcagagccagattcgaggaggtgctgacctgggccaagcagcaccagcagagactggagaccgccctgagcgagctggtggccaacgccgagctgctggaggagctgctggcctggatccagtgggccgagaccaccctgatccagagagaccaggagcccatcccccagaacatcgacagagtgaaggccctgatcgccgagcaccagaccttcatggaggagatgaccagaaagcagcccgacgtggacagagtgaccaagacctacaagagaaagaacatcgagcccacccacgcccccttcatcgagaagagcagaagcggcggcagaaagagcctgagccagcccacccccccccccatgcccatcctgagccagagcgaggccaagaaccccagaatcaaccagctgagcgccagatggcagcaggtgtggctgctggccctggagagacagagaaagctgaacgacgccctggacagactggaggagctgaaggagttcgccaacttcgacttcgacgtgtggagaaagaagtacatgagatggatgaaccacaagaagagcagagtgatggacttcttcagaagaatcgacaaggaccaggacggcaagatcaccagacaggagttcatcgacggcatcctggccagcaagttccccaccaccaagctggagatgaccgccgtggccgacatcttcgacagagacggcgacggctacatcgactactacgagttcgtggccgccctgcaccccaacaaggacgcctacagacccaccaccgacgccgacaagatcgaggacgaggtgaccagacaggtggcccagtgcaagtgcgccaagagattccaggtggagcagatcggcgagaacaagtacagattcggcgacagccagcagctgagactggtgagaatcctgagaagcaccgtgatggtgagagtgggcggcggctggatggccctggacgagttcctggtgaagaacgacccctgcagagccagaggcagaaccaacatcgagctgagagagaagttcatcctgcccgagggcgccagccagggcatgacccccttcagaagcagaggcagaagaagcaagcccagcagcagagccgccagccccaccagaagcagcagcagcgccagccagagcaaccacagctgcaccagcatgcccagcagccccgccacccccgccagcggcaccaaggtgatccccagcagcggcagcaagctgaagagacccacccccaccttccacagcagcagaaccagcctggccggcgacaccagcaacagcagcagccccgccagcaccggcgccaagaccaacagagccgaccccaagaagagcgccagcagacccggcagcagagccggcagcagagccggcagcagagccagcagcagaagaggcagcgacgccagcgacttcgacctgctggagacccagagcgcctgcagcgacaccagcgagagcagcgccgccggcggccagggcaacagcagaagaggcctgaacaagcccagcaagatccccaccatgagcaagaagaccaccaccgccagccccagaacccccggccccaagagatag

SEQ ID NO: 88955 - DNA, 1035 bp, Artificial Sequence
  Description of Artificial Sequence: Synthetic coding sequence
atgaccgccgtggccgacatcttcgacagagacggcgacggctacatcgactactacgagttcgtggccgccctgcaccccaacaaggacgcctacagacccaccaccgacgccgacaagatcgaggacgaggtgaccagacaggtggcccagtgcaagtgcgccaagagattccaggtggagcagatcggcgagaacaagtacagattcggcgacagccagcagctgagactggtgagaatcctgagaagcaccgtgatggtgagagtgggcggcggctggatggccctggacgagttcctggtgaagaacgacccctgcagagccagaggcagaaccaacatcgagctgagagagaagttcatcctgcccgagggcgccagccagggcatgacccccttcagaagcagaggcagaagaagcaagcccagcagcagagccgccagccccaccagaagcagcagcagcgccagccagagcaaccacagctgcaccagcatgcccagcagccccgccacccccgccagcggcaccaagaccagcctgcagttcagcagatgctacgacaagccctggctggtgaacagcaaggccggcacccccatcagagacagccacagccccgacctgcagctgcccacccccgaggtgatccccagcagcggcagcaagctgaagagacccacccccaccttccacagcagcagaaccagcctggccggcgacaccagcaacagcagcagccccgccagcaccggcgccaagaccaacagagccgaccccaagaagagcgccagcagacccggcagcagagccggcagcagagccggcagcagagccagcagcagaagaggcagcgacgccagcgacttcgacctgctggagacccagagcgcctgcagcgacaccagcgagagcagcgccgccggcggccagggcaacagcagaagaggcctgaacaagcccagcaagatccccaccatgagcaagaagaccaccaccgccagccccagaacccccggccccaagagatag

SEQ ID NO: 88956 - DNA, 16293 bp, Artificial Sequence; identical to SEQ ID NO: 88949
  Description of Artificial Sequence: Synthetic coding sequence

SEQ ID NO: 88957 - DNA, 8412 bp, Artificial Sequence
  Description of Artificial Sequence: Synthetic coding sequence
atggacggcgtggccgagttcagcgagtacgtgagcgagaccgtggacgtgcccagccccttcgacctgctggagccccccaccagcggcggcttcctgaagctgagcaagccctgctgctacatcttccccggcggcagaggcgacagcgccctgttcgccgtgaacggcttcaacatcctggtggacggcggcagcgacagaaagagctgcttctggaagctggtgagacacctggacagaatcgacagcgtgctgctgacccacatcggcgccgacaacctgcccggcatcaacggcctgctgcagagaaaggtggccgagctggaggaggagcagagccagggcagcagcagctacagcgactgggtgaagaacctgatcagccccgagctgggcgtggtgttcttcaacgtgcccgagaagctgagactgcccgacgccagcagaaaggccaagagaagcatcgaggaggcctgcctgaccctgcagcacctgaacagactgggcatccaggccgagcccctgtacagagtggtgagcaacaccatcgagcccctgaccctgttccacaagatgggcgtgggcagactggacatgtacgtgctgaaccccgtgaaggacagcaaggagatgcagttcctgatgcagaagtgggccggcaacagcaaggccaagaccggcatcgtgctgcccaacggcaaggaggccgagatcagcgtgccctacctgaccagcatcaccgccctggtggtgtggctgcccgccaaccccaccgagaagatcgtgagagtgctgttccccggcaacgccccccagaacaagatcctggagggcctggagaagctgagacacctggacttcctgagataccccgtggccacccagaaggacctggccagcggcgccgtgcccaccaacctgaagcccagcaagatcaagcagagagccgacagcaaggagagcctgaaggccaccaccaagaccgccgtgagcaagctggccaagagagaggaggtggtggaggagggcgccaaggaggccagaagcgagctggccaaggagctggccaagaccgagaagaaggccaaggagagcagcgagaagccccccgagaagcccgccaagcccgagagagtgaagaccgagagcagcgaggccctgaaggccgagaagagaaagctgatcaaggacaaggtgggcaagaagcacctgaaggagaagatcagcaagctggaggagaagaaggacaaggagaagaaggagatcaagaaggagagaaaggagctgaagaaggacgagggcagaaaggaggagaagaaggacgccaagaaggaggagaagagaaaggacaccaagcccgagctgaagaagatcagcaagcccgacctgaagcccttcacccccgaggtgagaaagaccctgtacaaggccaaggtgcccggcagagtgaagatcgacagaagcagagccatcagaggcgagaaggagctgagcagcgagccccagaccccccccgcccagaagggcaccgtgcccctgcccaccatcagcggccacagagagctggtgctgagcagccccgaggacctgacccaggacttcgaggagatgaagagagaggagagagccctgctggccgagcagagagacaccggcctgggcgacaagcccttccccctggacaccgccgaggagggcccccccagcaccgccatccagggcaccccccccagcgtgcccggcctgggccaggaggagcacgtgatgaaggagaaggagctggtgcccgaggtgcccgaggagcagggcagcaaggacagaggcctggacagcggcgccgagaccgaggaggagaaggacacctgggaggagaagaagcagagagaggccgagagactgcccgacagaaccgaggccagagaggagagcgagcccgaggtgaaggaggacgtgatcgagaaggccgagctggaggagatggaggaggtgcaccccagcgacgaggaggaggaggacgccaccaaggccgagggcttctaccagaagcacatgcaggagcccctgaaggtgacccccagaagcagagaggccttcggcggcagagagctgggcctgcagggcaaggcccccgagaaggagaccagcctgttcctgagcagcctgaccacccccgccggcgccaccgagcacgtgagctacatccaggacgagaccatccccggctacagcgagaccgagcagaccatcagcgacgaggagatccacgacgagcccgaggagagacccgccccccccagattccacaccagcacctacgacctgcccggccccgagggcgccggccccttcgaggccagccagcccgccgacagcgccgtgcccgccaccagcggcaaggtgtacggcacccccgagaccgagctgacctaccccaccaacatcgtggccgcccccctggccgaggaggagcacgtgagcagcgccaccagcatcaccgagtgcgacaagctgagcagcttcgccaccagcgtggccgaggaccagagcgtggccagcctgaccgccccccagaccgaggagaccggcaagagcagcctgctgctggacaccgtgaccagcatccccagcagcagaaccgaggccacccagggcctggactacgtgcccagcgccggcaccatcagccccaccagcagcctggaggaggacaagggcttcaagagccccccctgcgaggacttcagcgtgaccggcgagagcgagaagagaggcgagatcatcggcaagggcctgagcggcgagagagccgtggaggaggaggaggaggagaccgccaacgtggagatgagcgagaagctgtgcagccagtacggcacccccgtgttcagcgcccccggccacgccctgcaccccggcgagcccgccctgggcgaggccgaggagagatgcctgagccccgacgacagcaccgtgaagatggccagccccccccccagcggcccccccagcgccacccacacccccttccaccagagccccgtggaggagaagagcgagccccaggacttccaggaggccgacagctggggcgacaccaagagaacccccggcgtgggcaaggaggacgccgccgaggagaccgtgaagcccggccccgaggagggcaccctggagaaggaggagaaggtgcccccccccagaagcccccaggcccaggaggcccccgtgaacatcgacgagggcctgaccggctgcaccatccagctgctgcccgcccaggacaaggccatcgtgttcgagatcatggaggccggcgagcccaccggccccatcctgggcgccgaggccctgcccggcggcctgagaaccctgccccaggagcccggcaagccccagaaggacgaggtgctgagataccccgacagaagcctgagccccgaggacgccgagagcctgagcgtgctgagcgtgcccagccccgacaccgccaaccaggagcccacccccaagagcccctgcggcctgaccgagcagtacctgcacaaggacagatggcccgaggtgagccccgaggacacccagagcctgagcctgagcgaggagagccccagcaaggagaccagcctggacgtgagcagcaagcagctgagccccgagagcctgggcaccctgcagttcggcgagctgaacctgggcaaggaggagatgggccacctgatgcaggccgaggacaccagccaccacaccgcccccatgagcgtgcccgagccccacgccgccaccgccagcccccccaccgacggcaccaccagatacagcgcccagaccgacatcaccgacgacagcctggacagaaagagccccgccagcagcttcagccacagcacccccagcggcaacggcaagtacctgcccggcgccatcaccagccccgacgagcacatcctgacccccgacagcagcttcagcaagagccccgagagcctgcccggccccgccctggaggacatcgccatcaagtgggaggacaaggtgcccggcctgaaggacagaaccagcgagcagaagaaggagcccgagcccaaggacgaggtgctgcagcagaaggacaagaccctggagcacaaggaggtggtggagcccaaggacaccgccatctaccagaaggacgaggccctgcacgtgaagaacgaggccgtgaagcagcaggacaaggccctggagcagaagggcagagacctggagcagaaggacaccgccctggagcagaaggacaaggccctggagcccaaggacaaggacctggaggagaaggacaaggccctggagcagaaggacaagatccccgaggagaaggacaaggccctggagcagaaggacaccgccctggagcagaaggacaaggccctggagcccaaggacaaggacctggagcagaaggacagagtgctggagcagaaggagaagatccccgaggagaaggacaaggccctggaccagaaggtgagaagcgtggagcacaaggcccccgaggacaccgtggccgagatgaaggacagagacctggagcagaccgacaaggcccccgagcagaagcaccaggcccaggagcagaaggacaaggtgagcgagaagaaggaccaggccctggagcagaagtactgggccctgggccagaaggacgaggccctggagcagaacatccaggccctggaggagaaccaccagacccaggagcaggagagcctggtgcaggaggacaagaccagaaagcccaagatgctggaggagaagagccccgagaaggtgaaggccatggaggagaagctggaggccctgctggagaagaccaaggccctgggcctggaggagagcctggtgcaggagggcagagccagagagcaggaggagaagtactggagaggccaggacgtggtgcaggagtggcaggagaccagccccaccagagaggagcccgccggcgagcagaaggagctggcccccgcctgggaggacaccagccccgagcaggacaacagatactggagaggcagagaggacgtggccctggagcaggacacctactggagagagctgagctgcgagagaaaggtgtggttcccccacgagctggacggccagggcgccagaccccactacaccgaggagagagagagcaccttcctggacgagggccccgacgacgagcaggaggtgcccctgagagagcacgccaccagaagcccctgggccagcgacttcaaggacttccaggagagcagcccccagaagggcctggaggtggagagatggctggccgagagccccgtgggcctgccccccgaggaggaggacaagctgaccagaagccccttcgagatcatcagcccccccgccagcccccccgagatggtgggccagagagtgcccagcgcccccggccaggagagccccatccccgaccccaagctgatgccccacatgaagaacgagcccaccacccccagctggctggccgacatccccccctgggtgcccaaggacagacccctgccccccgcccccctgagccccgcccccggcccccccacccccgcccccgagagccacacccccgcccccttcagctggggcaccgccgagtacgacagcgtggtggccgccgtgcaggagggcgccgccgagctggagggcggcccctacagccccctgggcaaggactacagaaaggccgagggcgagagagaggaggagggcagagccgaggcccccgacaagagcagccacagcagcaaggtgcccgaggccagcaagagccacgccaccaccgagcccgagcagaccgagcccgagcagagagagcccaccccctaccccgacgagagaagcttccagtacgccgacatctacgagcagatgatgctgaccggcctgggccccgcctgccccaccagagagccccccctgggcgccgccggcgactggcccccctgcctgagcaccaaggaggccgccgccggcagaaacaccagcgccgagaaggagctgagcagccccatcagccccaagagcctgcagagcgacacccccaccttcagctacgccgccctggccggccccaccgtgccccccagacccgagcccggccccagcatggagcccagcctgaccccccccgccgtgccccccagagcccccatcctgagcaagggccccagcccccccctgaacggcaacatcctgagctgcagccccgacagaagaagccccagccccaaggagagcggcagaagccactgggacgacagcaccagcgacagcgagctggagaagggcgccagagagcagcccgagaaggaggcccagagccccagccccccccaccccatccccatgggcagccccaccctgtggcccgagaccgaggcccacgtgagcccccccctggacagccacctgggccccgccagacccagcctggacttccccgccagcgccttcggcttcagcagcctgcagcccgcccccccccagctgcccagccccgccgagcccagaagcgccccctgcggcagcctggccttcagcggcgacagagccctggccctggcccccggcccccccaccagaaccagacacgacgagtacctggaggtgaccaaggcccccagcctggacagcagcctgccccagctgcccagccccagcagccccggcgcccccctgctgagcaacctgcccagacccgccagccccgccctgagcgagggcagcagcagcgaggccaccacccccgtgatcagcagcgtggccgagagattcagccccagcctggaggccgccgagcaggagagcggcgagctggaccccggcatggagcccgccgcccacagcctgtgggacctgacccccctgagccccgccccccccgccagcctggacctggccctggcccccgcccccagcctgcccggcgacatgggcgacggcatcctgccctgccacctggagtgcagcgaggccgccaccgagaagcccagccccttccaggtgcccagcgaggactgcgccgccaacggccccaccgagaccagccccaacccccccggccccgcccccgccaaggccgagaacgaggaggccgccgcctgccccgcctgggagagaggcgcctggcccgagggcgccgagagaagcagcagacccgacaccctgctgagccccgagcagcccgtgtgccccgccggcggcagcggcggcccccccagcagcgccagccccgaggtggaggccggcccccagggctgcgccaccgagcccagaccccacagaggcgagctgagccccagcttcctgaacccccccctgccccccagcatcgacgacagagacctgagcaccgaggaggtgagactggtgggcagaggcggcagaagaagagtgggcggccccggcaccaccggcggcccctgccccgtgaccgacgagaccccccccaccagcgccagcgacagcggcagcagccagagcgacagcgacgtgccccccgagaccgaggagtgccccagcatcaccgccgaggccgccctggacagcgacgaggacggcgacttcctgcccgtggacaaggccggcggcgtgagcggcacccaccaccccagacccggccacgaccccccccccctgccccagcccgaccccagacccagcccccccagacccgacgtgtgcatggccgaccccgagggcctgagcagcgagagcggcagagtggagagactgagagagaaggagaaggtgcagggcagagtgggcagaagagcccccggcaaggccaagcccgccagccccgccagaagactggacctgagaggcaagagaagccccacccccggcaagggccccgccgacagagccagcagagccccccccagacccagaagcaccaccagccaggtgacccccgccgaggagaaggacggccacagccccatgagcaagggcctggtgaacggcctgaaggccggccccatggccctgagcagcaagggcagcagcggcgcccccgtgtacgtggacctggcctacatccccaaccactgcagcggcaagaccgccgacctggacttcttcagaagagtgagagccagctactacgtggtgagcggcaacgaccccgccaacggcgagcccagcagagccgtgctggacgccctgctggagggcaaggcccagtggggcgagaacctgcaggtgaccctgatccccacccacgacaccgaggtgaccagagagtggtaccagcagacccacgagcagcagcagcagctgaacgtgctggtgctggccagcagcagcaccgtggtgatgcaggacgagagcttccccgcctgcaagatcgagttctag

SEQ ID NO: 88958 - DNA, 9126 bp, Artificial Sequence
  Description of Artificial Sequence: Synthetic coding sequence
atggagaccgaggccgagcccgccagaccccacggcgtggccatggagaccacccccggcctgggcctgagaagccccggcgcccccctggcccagaaccccgccgagctgctgtgcgaggccggcgccgccgtggccgccgccagatgggacctgcagaagcacagcctgctgatcgtgatcggcgacatcggcaccgagagccagctgagagccgtgagagcccacctggagcagggcatcctgagctggaacatcgacctgagcagcttcgacctgaaccagcagctgagactgttcatcaccagacacctggcccacttcagcagcgaggtgaagggccagagaaccctgtgccaccagagcgagatcctggagaccatcatcctggtgaaccccagcgccgacagcatcagcagcgaggtgcaccacctgctgagcagcagcagcgcctacaagctgctgatcctgagcggccagagcctggagcccggcggcgacctgatcctgcagagcggcacctacagctacgagaacttcgcccaggtgctgcacaaccccgagatcagccagctgctgagcaacagagaccccggcatccaggccttcctgaccgtgagctgcctgggcgagggcgactggagccacctgggcctgagcagcagccaggagaccctgcacctgagactgaaccccgagcccaccctgcccaccatggacggcgtggccgagttcagcgagtacgtgagcgagaccgtggacgtgcccagccccttcgacctgctggagccccccaccagcggcggcttcctgaagctgagcaagccctgctgctacatcttccccggcggcagaggcgacagcgccctgttcgccgtgaacggcttcaacatcctggtggacggcggcagcgacagaaagagctgcttctggaagctggtgagacacctggacagaatcgacagcgtgctgctgacccacatcggcgccgacaacctgcccggcatcaacggcctgctgcagagaaaggtggccgagctggaggaggagcagagccagggcagcagcagctacagcgactgggtgaagaacctgatcagccccgagctgggcgtggtgttcttcaacgtgcccgagaagctgagactgcccgacgccagcagaaaggccaagagaagcatcgaggaggcctgcctgaccctgcagcacctgaacagactgggcatccaggccgagcccctgtacagagtggtgagcaacaccatcgagcccctgaccctgttccacaagatgggcgtgggcagactggacatgtacgtgctgaaccccgtgaaggacagcaaggagatgcagttcctgatgcagaagtgggccggcaacagcaaggccaagaccggcatcgtgctgcccaacggcaaggaggccgagatcagcgtgccctacctgaccagcatcaccgccctggtggtgtggctgcccgccaaccccaccgagaagatcgtgagagtgctgttccccggcaacgccccccagaacaagatcctggagggcctggagaagctgagacacctggacttcctgagataccccgtggccacccagaaggacctggccagcggcgccgtgcccaccaacctgaagcccagcaagatcaagcagagagccgacagcaaggagagcctgaaggccaccaccaagaccgccgtgagcaagctggccaagagagaggaggtggtggaggagggcgccaaggaggccagaagcgagctggccaaggagctggccaagaccgagaagaaggccaaggagagcagcgagaagccccccgagaagcccgccaagcccgagagagtgaagaccgagagcagcgaggccctgaaggccgagaagagaaagctgatcaaggacaaggtgggcaagaagcacctgaaggagaagatcagcaagctggaggagaagaaggacaaggagaagaaggagatcaagaaggagagaaaggagctgaagaaggacgagggcagaaaggaggagaagaaggacgccaagaaggaggagaagagaaaggacaccaagcccgagctgaagaagatcagcaagcccgacctgaagcccttcacccccgaggtgagaaagaccctgtacaaggccaaggtgcccggcagagtgaagatcgacagaagcagagccatcagaggcgagaaggagctgagcagcgagccccagaccccccccgcccagaagggcaccgtgcccctgcccaccatcagcggccacagagagctggtgctgagcagccccgaggacctgacccaggacttcgaggagatgaagagagaggagagagccctgctggccgagcagagagacaccggcctgggcgacaagcccttccccctggacaccgccgaggagggcccccccagcaccgccatccagggcaccccccccagcgtgcccggcctgggccaggaggagcacgtgatgaaggagaaggagctggtgcccgaggtgcccgaggagcagggcagcaaggacagaggcctggacagcggcgccgagaccgaggaggagaaggacacctgggaggagaagaagcagagagaggccgagagactgcccgacagaaccgaggccagagaggagagcgagcccgaggtgaaggaggacgtgatcgagaaggccgagctggaggagatggaggaggtgcaccccagcgacgaggaggaggaggacgccaccaaggccgagggcttctaccagaagcacatgcaggagcccctgaaggtgacccccagaagcagagaggccttcggcggcagagagctgggcctgcagggcaaggcccccgagaaggagaccagcctgttcctgagcagcctgaccacccccgccggcgccaccgagcacgtgagctacatccaggacgagaccatccccggctacagcgagaccgagcagaccatcagcgacgaggagatccacgacgagcccgaggagagacccgccccccccagattccacaccagcacctacgacctgcccggccccgagggcgccggccccttcgaggccagccagcccgccgacagcgccgtgcccgccaccagcggcaaggtgtacggcacccccgagaccgagctgacctaccccaccaacatcgtggccgcccccctggccgaggaggagcacgtgagcagcgccaccagcatcaccgagtgcgacaagctgagcagcttcgccaccagcgtggccgaggaccagagcgtggccagcctgaccgccccccagaccgaggagaccggcaagagcagcctgctgctggacaccgtgaccagcatccccagcagcagaaccgaggccacccagggcctggactacgtgcccagcgccggcaccatcagccccaccagcagcctggaggaggacaagggcttcaagagccccccctgcgaggacttcagcgtgaccggcgagagcgagaagagaggcgagatcatcggcaagggcctgagcggcgagagagccgtggaggaggaggaggaggagaccgccaacgtggagatgagcgagaagctgtgcagccagtacggcacccccgtgttcagcgcccccggccacgccctgcaccccggcgagcccgccctgggcgaggccgaggagagatgcctgagccccgacgacagcaccgtgaagatggccagccccccccccagcggcccccccagcgccacccacacccccttccaccagagccccgtggaggagaagagcgagccccaggacttccaggaggccgacagctggggcgacaccaagagaacccccggcgtgggcaaggaggacgccgccgaggagaccgtgaagcccggccccgaggagggcaccctggagaaggaggagaaggtgcccccccccagaagcccccaggcccaggaggcccccgtgaacatcgacgagggcctgaccggctgcaccatccagctgctgcccgcccaggacaaggccatcgtgttcgagatcatggaggccggcgagcccaccggccccatcctgggcgccgaggccctgcccggcggcctgagaaccctgccccaggagcccggcaagccccagaaggacgaggtgctgagataccccgacagaagcctgagccccgaggacgccgagagcctgagcgtgctgagcgtgcccagccccgacaccgccaaccaggagcccacccccaagagcccctgcggcctgaccgagcagtacctgcacaaggacagatggcccgaggtgagccccgaggacacccagagcctgagcctgagcgaggagagccccagcaaggagaccagcctggacgtgagcagcaagcagctgagccccgagagcctgggcaccctgcagttcggcgagctgaacctgggcaaggaggagatgggccacctgatgcaggccgaggacaccagccaccacaccgcccccatgagcgtgcccgagccccacgccgccaccgccagcccccccaccgacggcaccaccagatacagcgcccagaccgacatcaccgacgacagcctggacagaaagagccccgccagcagcttcagccacagcacccccagcggcaacggcaagtacctgcccggcgccatcaccagccccgacgagcacatcctgacccccgacagcagcttcagcaagagccccgagagcctgcccggccccgccctggaggacatcgccatcaagtgggaggacaaggtgcccggcctgaaggacagaaccagcgagcagaagaaggagcccgagcccaaggacgaggtgctgcagcagaaggacaagaccctggagcacaaggaggtggtggagcccaaggacaccgccatctaccagaaggacgaggccctgcacgtgaagaacgaggccgtgaagcagcaggacaaggccctggagcagaagggcagagacctggagcagaaggacaccgccctggagcagaaggacaaggccctggagcccaaggacaaggacctggaggagaaggacaaggccctggagcagaaggacaagatccccgaggagaaggacaaggccctggagcagaaggacaccgccctggagcagaaggacaaggccctggagcccaaggacaaggacctggagcagaaggacagagtgctggagcagaaggagaagatccccgaggagaaggacaaggccctggaccagaaggtgagaagcgtggagcacaaggcccccgaggacaccgtggccgagatgaaggacagagacctggagcagaccgacaaggcccccgagcagaagcaccaggcccaggagcagaaggacaaggtgagcgagaagaaggaccaggccctggagcagaagtactgggccctgggccagaaggacgaggccctggagcagaacatccaggccctggaggagaaccaccagacccaggagcaggagagcctggtgcaggaggacaagaccagaaagcccaagatgctggaggagaagagccccgagaaggtgaaggccatggaggagaagctggaggccctgctggagaagaccaaggccctgggcctggaggagagcctggtgcaggagggcagagccagagagcaggaggagaagtactggagaggccaggacgtggtgcaggagtggcaggagaccagccccaccagagaggagcccgccggcgagcagaaggagctggcccccgcctgggaggacaccagccccgagcaggacaacagatactggagaggcagagaggacgtggccctggagcaggacacctactggagagagctgagctgcgagagaaaggtgtggttcccccacgagctggacggccagggcgccagaccccactacaccgaggagagagagagcaccttcctggacgagggccccgacgacgagcaggaggtgcccctgagagagcacgccaccagaagcccctgggccagcgacttcaaggacttccaggagagcagcccccagaagggcctggaggtggagagatggctggccgagagccccgtgggcctgccccccgaggaggaggacaagctgaccagaagccccttcgagatcatcagcccccccgccagcccccccgagatggtgggccagagagtgcccagcgcccccggccaggagagccccatccccgaccccaagctgatgccccacatgaagaacgagcccaccacccccagctggctggccgacatccccccctgggtgcccaaggacagacccctgccccccgcccccctgagccccgcccccggcccccccacccccgcccccgagagccacacccccgcccccttcagctggggcaccgccgagtacgacagcgtggtggccgccgtgcaggagggcgccgccgagctggagggcggcccctacagccccctgggcaaggactacagaaaggccgagggcgagagagaggaggagggcagagccgaggcccccgacaagagcagccacagcagcaaggtgcccgaggccagcaagagccacgccaccaccgagcccgagcagaccgagcccgagcagagagagcccaccccctaccccgacgagagaagcttccagtacgccgacatctacgagcagatgatgctgaccggcctgggccccgcctgccccaccagagagccccccctgggcgccgccggcgactggcccccctgcctgagcaccaaggaggccgccgccggcagaaacaccagcgccgagaaggagctgagcagccccatcagccccaagagcctgcagagcgacacccccaccttcagctacgccgccctggccggccccaccgtgccccccagacccgagcccggccccagcatggagcccagcctgaccccccccgccgtgccccccagagcccccatcctgagcaagggccccagcccccccctgaacggcaacatcctgagctgcagccccgacagaagaagccccagccccaaggagagcggcagaagccactgggacgacagcaccagcgacagcgagctggagaagggcgccagagagcagcccgagaaggaggcccagagccccagccccccccaccccatccccatgggcagccccaccctgtggcccgagaccgaggcccacgtgagcccccccctggacagccacctgggccccgccagacccagcctggacttccccgccagcgccttcggcttcagcagcctgcagcccgcccccccccagctgcccagccccgccgagcccagaagcgccccctgcggcagcctggccttcagcggcgacagagccctggccctggcccccggcccccccaccagaaccagacacgacgagtacctggaggtgaccaaggcccccagcctggacagcagcctgccccagctgcccagccccagcagccccggcgcccccctgctgagcaacctgcccagacccgccagccccgccctgagcgagggcagcagcagcgaggccaccacccccgtgatcagcagcgtggccgagagattcagccccagcctggaggccgccgagcaggagagcggcgagctggaccccggcatggagcccgccgcccacagcctgtgggacctgacccccctgagccccgccccccccgccagcctggacctggccctggcccccgcccccagcctgcccggcgacatgggcgacggcatcctgccctgccacctggagtgcagcgaggccgccaccgagaagcccagccccttccaggtgcccagcgaggactgcgccgccaacggccccaccgagaccagccccaacccccccggccccgcccccgccaaggccgagaacgaggaggccgccgcctgccccgcctgggagagaggcgcctggcccgagggcgccgagagaagcagcagacccgacaccctgctgagccccgagcagcccgtgtgccccgccggcggcagcggcggcccccccagcagcgccagccccgaggtggaggccggcccccagggctgcgccaccgagcccagaccccacagaggcgagctgagccccagcttcctgaacccccccctgccccccagcatcgacgacagagacctgagcaccgaggaggtgagactggtgggcagaggcggcagaagaagagtgggcggccccggcaccaccggcggcccctgccccgtgaccgacgagaccccccccaccagcgccagcgacagcggcagcagccagagcgacagcgacgtgccccccgagaccgaggagtgccccagcatcaccgccgaggccgccctggacagcgacgaggacggcgacttcctgcccgtggacaaggccggcggcgtgagcggcacccaccaccccagacccggccacgaccccccccccctgccccagcccgaccccagacccagcccccccagacccgacgtgtgcatggccgaccccgagggcctgagcagcgagagcggcagagtggagagactgagagagaaggagaaggtgcagggcagagtgggcagaagagcccccggcaaggccaagcccgccagccccgccagaagactggacctgagaggcaagagaagccccacccccggcaagggccccgccgacagagccagcagagccccccccagacccagaagcaccaccagccaggtgacccccgccgaggagaaggacggccacagccccatgagcaagggcctggtgaacggcctgaaggccggccccatggccctgagcagcaagggcagcagcggcgcccccgtgtacgtggacctggcctacatccccaaccactgcagcggcaagaccgccgacctggacttcttcagaagagtgagagccagctactacgtggtgagcggcaacgaccccgccaacggcgagcccagcagagccgtgctggacgccctgctggagggcaaggcccagtggggcgagaacctgcaggtgaccctgatccccacccacgacaccgaggtgaccagagagtggtaccagcagacccacgagcagcagcagcagctgaacgtgctggtgctggccagcagcagcaccgtggtgatgcaggacgagagcttccccgcctgcaagatcgagttctag

SEQ ID NO: 88959 - DNA, 8418 bp, Artificial Sequence
  Description of Artificial Sequence: Synthetic coding sequence
atggacggcgtggccgagttcagcgagtacgtgagcgagaccgtggacgtgcccagccccttcgacctgctggagccccccaccagcggcggcttcctgaagctgagcaagccctgctgctacatcttccccggcggcagaggcgacagcgccctgttcgccgtgaacggcttcaacatcctggtggacggcggcagcgacagaaagagctgcttctggaagctggtgagacacctggacagaatcgacagcgtgctgctgacccacatcggcgccgacaacctgcccggcatcaacggcctgctgcagagaaaggtggccgagctggaggaggagcagagccagggcagcagcagctacagcgactgggtgaagaacctgatcagccccgagctgggcgtggtgttcttcaacgtgcccgagaagctgagactgcccgacgccagcagaaaggccaagagaagcatcgaggaggcctgcctgaccctgcagcacctgaacagactgggcatccaggccgagcccctgtacagagtggtgagcaacaccatcgagcccctgaccctgttccacaagatgggcgtgggcagactggacatgtacgtgctgaaccccgtgaaggacagcaaggagatgcagttcctgatgcagaagtgggccggcaacagcaaggccaagaccggcatcgtgctgcccaacggcaaggaggccgagatcagcgtgccctacctgaccagcatcaccgccctggtggtgtggctgcccgccaaccccaccgagaagatcgtgagagtgctgttccccggcaacgccccccagaacaagatcctggagggcctggagaagctgagacacctggacttcctgagataccccgtggccacccagaaggacctggccagcggcgccgtgcccaccaacctgaagcccagcaagatcaagcagagagccgacagcaaggagagcctgaaggccaccaccaagaccgccgtgagcaagctggccaagagagaggaggtggtggaggagggcgccaaggaggccagaagcgagctggccaaggagctggccaagaccgagaagaaggccaaggagagcagcgagaagccccccgagaagcccgccaagcccgagagagtgaagaccgagagcagcgaggccctgaaggccgagaagagaaagctgatcaaggacaaggtgggcaagaagcacctgaaggagaagatcagcaagctggaggagaagaaggacaaggagaagaaggagatcaagaaggagagaaaggagctgaagaaggacgagggcagaaaggaggagaagaaggacgccaagaaggaggagaagagaaaggacaccaagcccgagctgaagaagatcagcaagcccgacctgaagcccttcacccccgaggtgagaaagaccctgtacaaggccaaggtgcccggcagagtgaagatcgacagaagcagagccatcagaggcgagaaggagctgagcagcgagccccagaccccccccgcccagaagggcaccgtgcccctgcccaccatcagcggccacagagagctggtgctgagcagccccgaggacctgacccaggacttcgaggagatgaagagagaggagagagccctgctggccgagcagagagacaccggcctgggcgacaagcccttccccctggacaccgccgaggagggcccccccagcaccgccatccagggcaccccccccagcgtgcccggcctgggccaggaggagcacgtgatgaaggagaaggagctggtgcccgaggtgcccgaggagcagggcagcaaggacagaggcctggacagcggcgccgagaccgaggaggagaaggacacctgggaggagaagaagcagagagaggccgagagactgcccgacagaaccgaggccagagaggagagcgagcccgaggtgaaggaggacgtgatcgagaaggccgagctggaggagatggaggaggtgcaccccagcgacgaggaggaggaggacgccaccaaggccgagggcttctaccagaagcacatgcaggagcccctgaaggtgacccccagaagcagagaggccttcggcggcagagagctgggcctgcagggcaaggcccccgagaaggagaccagcctgttcctgagcagcctgaccacccccgccggcgccaccgagcacgtgagctacatccaggacgagaccatccccggctacagcgagaccgagcagaccatcagcgacgaggagatccacgacgagcccgaggagagacccgccccccccagattccacaccagcacctacgacctgcccggccccgagggcgccggccccttcgaggccagccagcccgccgacagcgccgtgcccgccaccagcggcaaggtgtacggcacccccgagaccgagctgacctaccccaccaacatcgtggccgcccccctggccgaggaggagcacgtgagcagcgccaccagcatcaccgagtgcgacaagctgagcagcttcgccaccagcgtggccgaggaccagagcgtggccagcctgaccgccccccagaccgaggagaccggcaagagcagcctgctgctggacaccgtgaccagcatccccagcagcagaaccgaggccacccagggcctggactacgtgcccagcgccggcaccatcagccccaccagcagcctggaggaggacaagggcttcaagagccccccctgcgaggacttcagcgtgaccggcgagagcgagaagagaggcgagatcatcggcaagggcctgagcggcgagagagccgtggaggaggaggaggaggagaccgccaacgtggagatgagcgagaagctgtgcagccagtacggcacccccgtgttcagcgcccccggccacgccctgcaccccggcgagcccgccctgggcgaggccgaggagagatgcctgagccccgacgacagcaccgtgaagatggccagccccccccccagcggcccccccagcgccacccacacccccttccaccagagccccgtggaggagaagagcgagccccaggacttccaggaggccgacagctggggcgacaccaagagaacccccggcgtgggcaaggaggacgccgccgaggagaccgtgaagcccggccccgaggagggcaccctggagaaggaggagaaggtgcccccccccagaagcccccaggcccaggaggcccccgtgaacatcgacgagggcctgaccggctgcaccatccagctgctgcccgcccaggacaaggccatcgtgttcgagatcatggaggccggcgagcccaccggccccatcctgggcgccgaggccctgcccggcggcctgagaaccctgccccaggagcccggcaagccccagaaggacgaggtgctgagataccccgacagaagcctgagccccgaggacgccgagagcctgagcgtgctgagcgtgcccagccccgacaccgccaaccaggagcccacccccaagagcccctgcggcctgaccgagcagtacctgcacaaggacagatggcccgaggtgagccccgaggacacccagagcctgagcctgagcgaggagagccccagcaaggagaccagcctggacgtgagcagcaagcagctgagccccgagagcctgggcaccctgcagttcggcgagctgaacctgggcaaggaggagatgggccacctgatgcaggccgaggacaccagccaccacaccgcccccatgagcgtgcccgagccccacgccgccaccgccagcccccccaccgacggcaccaccagatacagcgcccagaccgacatcaccgacgacagcctggacagaaagagccccgccagcagcttcagccacagcacccccagcggcaacggcaagtacctgcccggcgccatcaccagccccgacgagcacatcctgacccccgacagcagcttcagcaagagccccgagagcctgcccggccccgccctggaggacatcgccatcaagtgggaggacaaggtgcccggcctgaaggacagaaccagcgagcagaagaaggagcccgagcccaaggacgaggtgctgcagcagaaggacaagaccctggagcacaaggaggtggtggagcccaaggacaccgccatctaccagaaggacgaggccctgcacgtgaagaacgaggccgtgaagcagcaggacaaggccctggagcagaagggcagagacctggagcagaaggacaccgccctggagcagaaggacaaggccctggagcccaaggacaaggacctggaggagaaggacaaggccctggagcagaaggacaagatccccgaggagaaggacaaggccctggagcagaaggacaccgccctggagcagaaggacaaggccctggagcccaaggacaaggacctggagcagaaggacagagtgctggagcagaaggagaagatccccgaggagaaggacaaggccctggaccagaaggtgagaagcgtggagcacaaggcccccgaggacaccgtggccgagatgaaggacagagacctggagcagaccgacaaggcccccgagcagaagcaccaggcccaggagcagaaggacaaggtgagcgagaagaaggaccaggccctggagcagaagtactgggccctgggccagaaggacgaggccctggagcagaacatccaggccctggaggagaaccaccagacccaggagcaggagagcctggtgcaggaggacaagaccagaaagcccaagatgctggaggagaagagccccgagaaggtgaaggccatggaggagaagctggaggccctgctggagaagaccaaggccctgggcctggaggagagcctggtgcaggagggcagagccagagagcaggaggagaagtactggagaggccaggacgtggtgcaggagtggcaggagaccagccccaccagagaggagcccgccggcgagcagaaggagctggcccccgcctgggaggacaccagccccgagcaggacaacagatactggagaggcagagaggacgtggccctggagcaggacacctactggagagagctgagctgcgagagaaaggtgtggttcccccacgagctggacggccagggcgccagaccccactacaccgaggagagagagagcaccttcctggacgagggccccgacgacgagcaggaggtgcccctgagagagcacgccaccagaagcccctgggccagcgacttcaaggacttccaggagagcagcccccagaagggcctggaggtggagagatggctggccgagagccccgtgggcctgccccccgaggaggaggacaagctgaccagaagccccttcgagatcatcagcccccccgccagcccccccgagatggtgggccagagagtgcccagcgcccccggccaggagagccccatccccgaccccaagctgatgccccacatgaagaacgagcccaccacccccagctggctggccgacatccccccctgggtgcccaaggacagacccctgccccccgcccccctgagccccgcccccggcccccccacccccgcccccgagagccacacccccgcccccttcagctggggcaccgccgagtacgacagcgtggtggccgccgtgcaggagggcgccgccgagctggagggcggcccctacagccccctgggcaaggactacagaaaggccgagggcgagagagaggaggagggcagagccgaggcccccgacaagagcagccacagcagcaaggtgcccgaggccagcaagagccacgccaccaccgagcccgagcagaccgagcccgagcagagagagcccaccccctaccccgacgagagaagcttccagtacgccgacatctacgagcagatgatgctgaccggcctgggccccgcctgccccaccagagagccccccctgggcgccgccggcgactggcccccctgcctgagcaccaaggaggccgccgccggcagaaacaccagcgccgagaaggagctgagcagccccatcagccccaagagcctgcagagcgacacccccaccttcagctacgccgccctggccggccccaccgtgccccccagacccgagcccggccccagcatggagcccagcctgaccccccccgccgtgccccccagagcccccatcctgagcaagggccccagcccccccctgaacggcaacatcctgagctgcagccccgacagaagaagccccagccccaaggagagcggcagaagccactgggacgacagcaccagcgacagcgagctggagaagggcgccagagagcagcccgagaaggaggcccagagccccagccccccccaccccatccccatgggcagccccaccctgtggcccgagaccgaggcccacgtgagcccccccctggacagccacctgggccccgccagacccagcctggacttccccgccagcgccttcggcttcagcagcctgcagcccgcccccccccagctgcccagccccgccgagcccagaagcgccccctgcggcagcctggccttcagcggcgacagagccctggccctggcccccggcccccccaccagaaccagacacgacgagtacctggaggtgaccaaggcccccagcctggacagcagcctgccccagctgcccagccccagcagccccggcgcccccctgctgagcaacctgcccagacccgccagccccgccctgagcgagggcagcagcagcgaggccaccacccccgtgatcagcagcgtggccgagagattcagccccagcctggaggccgccgagcaggagagcggcgagctggaccccggcatggagcccgccgcccacagcctgtgggacctgacccccctgagccccgccccccccgccagcctggacctggccctggcccccgcccccagcctgcccggcgacatgggcgacggcatcctgccctgccacctggagtgcagcgaggccgccaccgagaagcccagccccttccaggtgcccagcgaggactgcgccgccaacggccccaccgagaccagccccaacccccccggccccgcccccgccaaggccgagaacgaggaggccgccgcctgccccgcctgggagagaggcgcctggcccgagggcgccgagagaagcagcagacccgacaccctgctgagccccgagcagcccgtgtgccccgccggcggcagcggcggcccccccagcagcgccagccccgaggtggaggccggcccccagggctgcgccaccgagcccagaccccacagaggcgagctgagccccagcttcctgaacccccccctgccccccagcatcgacgacagagacctgagcaccgaggaggtgagactggtgggcagaggcggcagaagaagagtgggcggccccggcaccaccggcggcccctgccccgtgaccgacgagaccccccccaccagcgccagcgacagcggcagcagccagagcgacagcgacgtgccccccgagaccgaggagtgccccagcatcaccgccgaggccgccctggacagcgacgaggacggcgacttcctgcccgtggacaaggccggcggcgtgagcggcacccaccaccccagacccggccacgaccccccccccctgccccagcccgaccccagacccagcccccccagacccgacgtgtgcatggccgaccccgagggcctgagcagcgagagcggcagagtggagagactgagagagaaggagaaggtgcagggcagagtgggcagaagagcccccggcaaggccaagcccgccagccccgccagaagactggacctgagaggcaagagaagccccacccccggcaagggccccgccgacagagccagcagagccccccccagacccagaagcaccaccagccaggtgacccccgccgaggagaaggacggccacagccccatgagcaagggcctggtgaacggcctgaaggccggccccatggccctgagcagcaagggcagcagcggcgcccccgtgtacgtggacctggcctacatccccaaccactgcagcggcaagaccgccgacctggacttcttcagaagagtgagagccagctactacgtggtgagcggcaacgaccccgccaacggcgagcccagcagagccgtgctggacgccctgctggagggcaaggcccagtggggcgagaacctgcaggtgagcgtgaccctgatccccacccacgacaccgaggtgaccagagagtggtaccagcagacccacgagcagcagcagcagctgaacgtgctggtgctggccagcagcagcaccgtggtgatgcaggacgagagcttccccgcctgcaagatcgagttctag

SEQ ID NO: 88960 - DNA, 1884 bp, Artificial Sequence
  Description of Artificial Sequence: Synthetic coding sequence
atggacggcgtggccgagttcagcgagtacgtgagcgagaccgtggacgtgcccagccccttcgacctgctggagccccccaccagcggcggcttcctgaagctgagcaagccctgctgctacatcttccccggcggcagaggcgacagcgccctgttcgccgtgaacggcttcaacatcctggtggacggcggcagcgacagaaagagctgcttctggaagctggtgagacacctggacagaatcgacagcgtgctgctgacccacatcggcgccgacaacctgcccggcatcaacggcctgctgcagagaaaggtggccgagctggaggaggagcagagccagggcagcagcagctacagcgactgggtgaagaacctgatcagccccgagctgggcgtggtgttcttcaacgtgcccgagaagctgagactgcccgacgccagcagaaaggccaagagaagcatcgaggaggcctgcctgaccctgcagcacctgaacagactgggcatccaggccgagcccctgtacagagtggtgagcaacaccatcgagcccctgaccctgttccacaagatgggcgtgggcagactggacatgtacgtgctgaaccccgtgaaggacagcaaggagatgcagttcctgatgcagaagtgggccggcaacagcaaggccaagaccggcatcgtgctgcccaacggcaaggaggccgagatcagcgtgccctacctgaccagcatcaccgccctggtggtgtggctgcccgccaaccccaccgagaagatcgtgagagtgctgttccccggcaacgccccccagaacaagatcctggagggcctggagaagctgagacacctggacttcctgagataccccgtggccacccagaaggacctggccagcggcgccgtgcccaccaacctgaagcccagcaagatcaagcagagagccgacagcaaggagagcctgaaggccaccaccaagaccgccgtgagcaagctggccaagagagaggaggtggtggaggagggcgccaaggaggccagaagcgagctggccaaggagctggccaagaccgagaagaaggccaaggagagcagcgagaagccccccgagaagcccgccaagcccgagagagtgaagaccgagagcagcgaggccctgaaggccgagaagagaaagctgatcaaggacaaggtgggcaagaagcacctgaaggagaagatcagcaagctggaggagaagaaggacaaggagaagaaggagatcaagaaggagagaaaggagctgaagaaggacgagggcagaaaggaggagaagaaggacgccaagaaggaggagaagagaaaggacaccaagcccgagctgaagaagatcagcaagcccgacctgaagcccttcacccccgaggtgagaaagaccctgtacaaggccaaggtgcccggcagagtgaagatcgacagaagcagagccatcagaggcgagaaggagctgagcagcgagccccagaccccccccgcccagaagggcaccgtgcccctgcccaccatcagcggccacagagagctggtgctgagcagccccgaggacctgacccaggacttcgaggagatgaagagagaggagagagccctgctggccgagcagagagacaccggcctgggcgacaagcccttccccctggacaccgccgaggagggcccccccagcaccgccatccagggcaccccccccagcgtgcccggcctgggccaggaggagcacgtgatgaaggagaaggagctggtgcccgaggtgcccgaggagcagggcagcaaggacagaggcctggacagcggcgccgagaccgaggagaagaagaagaagaagaagaagaagaagtag

SEQ ID NO: 88961 - DNA, 1680 bp, Artificial Sequence
  Description of Artificial Sequence: Synthetic coding sequence
atggccgacgagagaaaggacgaggccaaggccccccactggaccagcgcccccctgaccgaggccagcgcccacagccacccccccgagatcaaggaccagggcggcgccggcgagggcctggtgagaagcgccaacggcttcccctacagagaggacgaggagggcgccttcggcgagcacggcagccagggcacctacagcaacaccaaggagaacggcatcaacggcgagctgaccagcgccgacagagagaccgccgaggaggtgagcgccagaatcgtgcaggtggtgaccgccgaggccgtggccgtgctgaagggcgagcaggagaaggaggcccagcacaaggaccagaccgccgccctgcccctggccgccgaggagaccgccaacctgccccccagccccccccccagccccgccagcgagcagaccgtgaccgtggaggaggccgccggcggcgagagcgccctggcccccagcgtgttcaagcaggccaaggacaaggtgagcaacagcaccctgagcaagatccccgccctgcagggcagcaccaagagccccagatacagcagcgcctgccccagcaccaccaagagagccaccttcagcgacagcctgctgatccagcccaccagcgccggcagcaccgacagactgccctacagcaagagcggcaacaaggacggcgtgaccaagagccccgagaagagaagcagcctgcccagacccagcagcatcctgccccccagaagaggcgtgagcggcgacagagacgagaacagcttcagcctgaacagcagcatcagcagcagcgccagaagaaccaccagaagcgagcccatcagaagagccggcaagagcggcaccagcacccccaccacccccggcagcaccgccatcacccccggcaccccccccagctacagcagcagaacccccggcacccccggcacccccagctaccccagaaccccccacacccccggcacccccaagagcgccatcctggtgcccagcgagaagaaggtggccatcatcagaaccccccccaagagccccgccacccccaagcagctgagactgatcaaccagcccctgcccgacctgaagaacgtgaagagcaagatcggcagcaccgacaacatcaagtaccagcccaagggcggccaggtgagaatcctgaacaagaagatcgacttcagcaaggtgcagagcagatgcggcagcaaggacaacatcaagcacagcgccggcggcggcaacgtgcagatcgtgaccaagaagatcgacctgagccacgtgaccagcaagtgcggcagcctgaagaacatcagacacagacccggcggcggcagagtgaagatcgagagcgtgaagctggacttcaaggagaaggcccaggccaaggtgggcagcctggacaacgcccaccacgtgcccggcggcggcaacgtgaagatcgacagccagaagctgaacttcagagagcacgccaaggccagagtggaccacggcgccgagatcatcacccagagccccggcagaagcagcgtggccagccccagaagactgagcaacgtgagcagcagcggcagcatcaacctgctggagagcccccagctggccaccctggccgaggacgtgaccgccgccctggccaagcagggcctgtag

SEQ ID NO: 88962 - DNA, 5484 bp, Artificial Sequence
  Description of Artificial Sequence: Synthetic coding sequence
atggccgacgagagaaaggacgaggccaaggccccccactggaccagcgcccccctgaccgaggccagcgcccacagccacccccccgagatcaaggaccagggcggcgccggcgagggcctggtgagaagcgccaacggcttcccctacagagaggacgaggagggcgccttcggcgagcacggcagccagggcacctacagcaacaccaaggagaacggcatcaacggcgagctgaccagcgccgacagagagaccgccgaggaggtgagcgccagaatcgtgcaggtggtgaccgccgaggccgtggccgtgctgaagggcgagcaggagaaggaggcccagcacaaggaccagaccgccgccctgcccctggccgccgaggagaccgccaacctgccccccagccccccccccagccccgccagcgagcagaccgtgaccgtggaggaggacctgctgaccgccagcaagatggagttccacgaccagcaggagctgacccccagcaccgccgagcccagcgaccagaaggagaaggagagcgagaagcagagcaagcccggcgaggacctgaagcacgccgccctggtgagccagcccgagaccaccaagacctaccccgacaagaaggacatgcagggcaccgaggaggagaaggcccccctggccctgttcggccacaccctggtggccagcctggaggacatgaagcagaagaccgagcccagcctggtggtgcccggcatcgacctgcccaaggagccccccacccccaaggagcagaaggactggttcatcgagatgcccaccgaggccaagaaggacgagtggggcctggtggcccccatcagccccggccccctgacccccatgagagagaaggacgtgttcgacgacatccccaagtgggagggcaagcagttcgacagccccatgcccagccccttccagggcggcagcttcaccctgcccctggacgtgatgaagaacgagatcgtgaccgagaccagccccttcgcccccgccttcctgcagcccgacgacaagaagagcctgcagcagaccagcggccccgccaccgccaaggacagcttcaagatcgaggagccccacgaggccaagcccgacaagatggccgaggccccccccagcgaggccatgaccctgcccaaggacgcccacatccccgtggtggaggagcacgtgatgggcaaggtgctggaggaggagaaggaggccatcaaccaggagaccgtgcagcagagagacaccttcacccccagcggccaggagcccatcctgaccgagaaggagaccgagctgaagctggaggagaagaccaccatcagcgacaaggaggccgtgcccaaggagagcaagccccccaagcccgccgacgaggagatcggcatcatccagaccagcaccgagcacaccttcagcgagcagaaggaccaggagcccaccaccgacatgctgaagcaggacagcttccccgtgagcctggagcaggccgtgaccgacagcgccatgaccagcaagaccctggagaaggccatgaccgagcccagcgccctgatcgagaagagcagcatccaggagctgttcgagatgagagtggacgacaaggacaagatcgagggcgtgggcgccgccaccagcgccgagctggacatgcccttctacgaggacaagagcggcatgagcaagtacttcgagaccagcgccctgaaggaggaggccaccaagagcatcgagcccggcagcgactactacgagctgagcgacaccagagagagcgtgcacgagagcatcgacaccatgagccccatgcacaagaacggcgacaaggagttccagaccggcaaggagagccagcccagcccccccgcccaggaggccggctacagcaccctggcccagagctaccccagcgacctgcccgaggagcccagcagcccccaggagagaatgttcaccatcgaccccaaggtgtacggcgagaagagagacctgcacagcaagaacaaggacgacctgaccctgagcagaagcctgggcctgggcggcagaagcgccatcgagcagagaagcatgagcatcaacctgcccatgagctgcctggacagcatcgccctgggcttcaacttcggcagaggccacgacctgagccccctggccagcgacatcctgaccaacaccagcggcagcatggacgagggcgacgactacctgcccgccaccacccccgccctggagaaggccccctgcttccccgtggagagcaaggaggaggagcagatcgagaaggtgaaggccaccggcgaggagagcacccaggccgagatcagctgcgagagccccttcctggccaaggacttctacaagaacggcaccgtgatggcccccgacctgcccgagatgctggacctggccggcaccagaagcagactggccagcgtgagcgccgacgccgaggtggccagaagaaagagcgtgcccagcgagaccgtggtggaggacagcagaaccggcctgccccccgtgaccgacgagaaccacgtgatcgtgaagaccgacagccagctggaggacctgggctactgcgtgttcaacaagtacaccgtgcccctgcccagccccgtgcaggacagcgagaacctgagcggcgagagcggcaccttctacgagggcaccgacgacaaggtgagaagagacctggccaccgacctgagcctgatcgaggtgaagctggccgccgccggcagagtgaaggacgagttcagcgtggacaaggaggccagcgcccacatcagcggcgacaagagcggcctgagcaaggagttcgaccaggagaagaaggccaacgacagactggacaccgtgctggagaagagcgaggagcacgccgacagcaaggagcacgccaagaagaccgaggaggccggcgacgagatcgagaccttcggcctgggcgtgacctacgagcaggccctggccaaggacctgagcatccccaccgacgccagcagcgagaaggccgagaagggcctgagcagcgtgcccgagatcgccgaggtggagcccagcaagaaggtggagcagggcctggacttcgccgtgcagggccagctggacgtgaagatcagcgacttcggccagatggccagcggcctgaacatcgacgacagaagagccaccgagctgaagctggaggccacccaggacatgacccccagcagcaaggccccccaggaggccgacgccttcatgggcgtggagagcggccacatgaaggagggcaccaaggtgagcgagaccgaggtgaaggagaaggtggccaagcccgacctggtgcaccaggaggccgtggacaaggaggagagctacgagagcagcggcgagcacgagagcctgaccatggagagcctgaaggccgacgagggcaagaaggagaccagccccgagagcagcctgatccaggacgagatcgccgtgaagctgagcgtggagatcccctgcccccccgccgtgagcgaggccgacctggccaccgacgagagagccgacgtgcagatggagttcatccagggccccaaggaggagagcaaggagacccccgacatcagcatcacccccagcgacgtggccgagcccctgcacgagaccatcgtgagcgagcccgccgagatccagagcgaggaggaggagatcgaggcccagggcgagtacgacaagctgctgttcagaagcgacaccctgcagatcaccgacctgggcgtgagcggcgccagagaggagttcgtggagacctgccccagcgagcacaagggcgtgatcgagagcgtggtgaccatcgaggacgacttcatcaccgtggtgcagaccaccaccgacgagggcgagagcggcagccacagcgtgagattcgccgccctggagcagcccgaggtggagagaagacccagcccccacgacgaggaggagttcgaggtggaggaggccgccgaggcccaggccgagcccaaggacggcagccccgaggcccccgccagccccgagagagaggaggtggccctgagcgagtacaagaccgagacctacgacgactacaaggacgagaccaccatcgacgacagcatcatggacgccgacagcctgtgggtggacacccaggacgacgacagaagcatcatgaccgagcagctggagaccatccccaaggaggagaaggccgagaaggaggccagaagaagcagcctggagaagcacagaaaggagaagcccttcaagaccggcagaggcagaatcagcacccccgagagaaaggtggccaagaaggagcccagcaccgtgagcagagacgaggtgagaagaaagaaggccgtgtacaagaaggccgagctggccaagaagaccgaggtgcaggcccacagccccagcagaaagttcatcctgaagcccgccatcaagtacaccagacccacccacctgagctgcgtgaagagaaagaccaccgccgccggcggcgagagcgccctggcccccagcgtgttcaagcaggccaaggacaaggtgagcgacggcgtgaccaagagccccgagaagagaagcagcctgcccagacccagcagcatcctgccccccagaagaggcgtgagcggcgacagagacgagaacagcttcagcctgaacagcagcatcagcagcagcgccagaagaaccaccagaagcgagcccatcagaagagccggcaagagcggcaccagcacccccaccacccccggcagcaccgccatcacccccggcaccccccccagctacagcagcagaacccccggcacccccggcacccccagctaccccagaaccccccacacccccggcacccccaagagcgccatcctggtgcccagcgagaagaaggtggccatcatcagaaccccccccaagagccccgccacccccaagcagctgagactgatcaaccagcccctgcccgacctgaagaacgtgaagagcaagatcggcagcaccgacaacatcaagtaccagcccaagggcggccaggtgcagatcgtgaccaagaagatcgacctgagccacgtgaccagcaagtgcggcagcctgaagaacatcagacacagacccggcggcggcagagtgaagatcgagagcgtgaagctggacttcaaggagaaggcccaggccaaggtgggcagcctggacaacgcccaccacgtgcccggcggcggcaacgtgaagatcgacagccagaagctgaacttcagagagcacgccaaggccagagtggaccacggcgccgagatcatcacccagagccccggcagaagcagcgtggccagccccagaagactgagcaacgtgagcagcagcggcagcatcaacctgctggagagcccccagctggccaccctggccgaggacgtgaccgccgccctggccaagcagggcctgtag

SEQ ID NO: 88963 - DNA, 1416 bp, Artificial Sequence
  Description of Artificial Sequence: Synthetic coding sequence
atggccgacgagagaaaggacgaggccaaggccccccactggaccagcgcccccctgaccgaggccagcgcccacagccacccccccgagatcaaggaccagggcggcgccggcgagggcctggtgagaagcgccaacggcttcccctacagagaggacgaggagggcgccttcggcgagcacggcagccagggcacctacagcaacaccaaggagaacggcatcaacggcgagctgaccagcgccgacagagagaccgccgaggaggtgagcgccagaatcgtgcaggtggtgaccgccgaggccgtggccgtgctgaagggcgagcaggagaaggaggcccagcacaaggaccagaccgccgccctgcccctggccgccgaggagaccgccaacctgccccccagccccccccccagccccgccagcgagcagaccgtgaccgtggaggaggccgccggcggcgagagcgccctggcccccagcgtgttcaagcaggccaaggacaaggtgagcgacggcgtgaccaagagccccgagaagagaagcagcctgcccagacccagcagcatcctgccccccagaagaggcgtgagcggcgacagagacgagaacagcttcagcctgaacagcagcatcagcagcagcgccagaagaaccaccagaagcgagcccatcagaagagccggcaagagcggcaccagcacccccaccacccccggcagcaccgccatcacccccggcaccccccccagctacagcagcagaacccccggcacccccggcacccccagctaccccagaaccccccacacccccggcacccccaagagcgccatcctggtgcccagcgagaagaaggtggccatcatcagaaccccccccaagagccccgccacccccaagcagctgagactgatcaaccagcccctgcccgacctgaagaacgtgaagagcaagatcggcagcaccgacaacatcaagtaccagcccaagggcggccaggtgcagatcgtgaccaagaagatcgacctgagccacgtgaccagcaagtgcggcagcctgaagaacatcagacacagacccggcggcggcagagtgaagatcgagagcgtgaagctggacttcaaggagaaggcccaggccaaggtgggcagcctggacaacgcccaccacgtgcccggcggcggcaacgtgaagatcgacagccagaagctgaacttcagagagcacgccaaggccagagtggaccacggcgccgagatcatcacccagagccccggcagaagcagcgtggccagccccagaagactgagcaacgtgagcagcagcggcagcatcaacctgctggagagcccccagctggccaccctggccgaggacgtgaccgccgccctggccaagcagggcctgtag

SEQ ID NO: 88964 - DNA, 321 bp, Artificial Sequence
  Description of Artificial Sequence: Synthetic coding sequence
atggccgacgagagaaaggacgaggccaaggccccccactggaccagcgcccccctgaccgaggccagcgcccacagccacccccccgagatcaaggaccagggcggcgccggcgagggcctggtgagaagcgccaacggcttcccctacagagaggacgaggagggcgccttcggcgagcacggcagccagggcacctacagcaacaccaaggagaacggcatcaacggcgagctgaccagcgccgacagagagaccgccgaggaggtgagcgccagaatcgtgcaggtggtgaccgccgaggccgtggccgtgctgtag

SEQ ID NO: 88965 - DNA, 1416 bp, Artificial Sequence; identical to SEQ ID NO: 88963
  Description of Artificial Sequence: Synthetic coding sequence

SEQ ID NO: 88966 - DNA, 5472 bp, Artificial Sequence
  Description of Artificial Sequence: Synthetic coding sequence
atggccgacgagagaaaggacgaggccaaggccccccactggaccagcgcccccctgaccgaggccagcgcccacagccacccccccgagatcaaggaccagggcggcgccggcgagggcctggtgagaagcgccaacggcttcccctacagagaggacgaggagggcgccttcggcgagcacggcagccagggcacctacagcaacaccaaggagaacggcatcaacggcgagctgaccagcgccgacagagagaccgccgaggaggtgagcgccagaatcgtgcaggtggtgaccgccgaggccgtggccgtgctgaagggcgagcaggagaaggaggcccagcacaaggaccagaccgccgccctgcccctggccgccgaggagaccgccaacctgccccccagccccccccccagccccgccagcgagcagaccgtgaccgtggaggaggccagcaagatggagttccacgaccagcaggagctgacccccagcaccgccgagcccagcgaccagaaggagaaggagagcgagaagcagagcaagcccggcgaggacctgaagcacgccgccctggtgagccagcccgagaccaccaagacctaccccgacaagaaggacatgcagggcaccgaggaggagaaggcccccctggccctgttcggccacaccctggtggccagcctggaggacatgaagcagaagaccgagcccagcctggtggtgcccggcatcgacctgcccaaggagccccccacccccaaggagcagaaggactggttcatcgagatgcccaccgaggccaagaaggacgagtggggcctggtggcccccatcagccccggccccctgacccccatgagagagaaggacgtgttcgacgacatccccaagtgggagggcaagcagttcgacagccccatgcccagccccttccagggcggcagcttcaccctgcccctggacgtgatgaagaacgagatcgtgaccgagaccagccccttcgcccccgccttcctgcagcccgacgacaagaagagcctgcagcagaccagcggccccgccaccgccaaggacagcttcaagatcgaggagccccacgaggccaagcccgacaagatggccgaggccccccccagcgaggccatgaccctgcccaaggacgcccacatccccgtggtggaggagcacgtgatgggcaaggtgctggaggaggagaaggaggccatcaaccaggagaccgtgcagcagagagacaccttcacccccagcggccaggagcccatcctgaccgagaaggagaccgagctgaagctggaggagaagaccaccatcagcgacaaggaggccgtgcccaaggagagcaagccccccaagcccgccgacgaggagatcggcatcatccagaccagcaccgagcacaccttcagcgagcagaaggaccaggagcccaccaccgacatgctgaagcaggacagcttccccgtgagcctggagcaggccgtgaccgacagcgccatgaccagcaagaccctggagaaggccatgaccgagcccagcgccctgatcgagaagagcagcatccaggagctgttcgagatgagagtggacgacaaggacaagatcgagggcgtgggcgccgccaccagcgccgagctggacatgcccttctacgaggacaagagcggcatgagcaagtacttcgagaccagcgccctgaaggaggaggccaccaagagcatcgagcccggcagcgactactacgagctgagcgacaccagagagagcgtgcacgagagcatcgacaccatgagccccatgcacaagaacggcgacaaggagttccagaccggcaaggagagccagcccagcccccccgcccaggaggccggctacagcaccctggcccagagctaccccagcgacctgcccgaggagcccagcagcccccaggagagaatgttcaccatcgaccccaaggtgtacggcgagaagagagacctgcacagcaagaacaaggacgacctgaccctgagcagaagcctgggcctgggcggcagaagcgccatcgagcagagaagcatgagcatcaacctgcccatgagctgcctggacagcatcgccctgggcttcaacttcggcagaggccacgacctgagccccctggccagcgacatcctgaccaacaccagcggcagcatggacgagggcgacgactacctgcccgccaccacccccgccctggagaaggccccctgcttccccgtggagagcaaggaggaggagcagatcgagaaggtgaaggccaccggcgaggagagcacccaggccgagatcagctgcgagagccccttcctggccaaggacttctacaagaacggcaccgtgatggcccccgacctgcccgagatgctggacctggccggcaccagaagcagactggccagcgtgagcgccgacgccgaggtggccagaagaaagagcgtgcccagcgagaccgtggtggaggacagcagaaccggcctgccccccgtgaccgacgagaaccacgtgatcgtgaagaccgacagccagctggaggacctgggctactgcgtgttcaacaagtacaccgtgcccctgcccagccccgtgcaggacagcgagaacctgagcggcgagagcggcaccttctacgagggcaccgacgacaaggtgagaagagacctggccaccgacctgagcctgatcgaggtgaagctggccgccgccggcagagtgaaggacgagttcagcgtggacaaggaggccagcgcccacatcagcggcgacaagagcggcctgagcaaggagttcgaccaggagaagaaggccaacgacagactggacaccgtgctggagaagagcgaggagcacgccgacagcaaggagcacgccaagaagaccgaggaggccggcgacgagatcgagaccttcggcctgggcgtgacctacgagcaggccctggccaaggacctgagcatccccaccgacgccagcagcgagaaggccgagaagggcctgagcagcgtgcccgagatcgccgaggtggagcccagcaagaaggtggagcagggcctggacttcgccgtgcagggccagctggacgtgaagatcagcgacttcggccagatggccagcggcctgaacatcgacgacagaagagccaccgagctgaagctggaggccacccaggacatgacccccagcagcaaggccccccaggaggccgacgccttcatgggcgtggagagcggccacatgaaggagggcaccaaggtgagcgagaccgaggtgaaggagaaggtggccaagcccgacctggtgcaccaggaggccgtggacaaggaggagagctacgagagcagcggcgagcacgagagcctgaccatggagagcctgaaggccgacgagggcaagaaggagaccagccccgagagcagcctgatccaggacgagatcgccgtgaagctgagcgtggagatcccctgcccccccgccgtgagcgaggccgacctggccaccgacgagagagccgacgtgcagatggagttcatccagggccccaaggaggagagcaaggagacccccgacatcagcatcacccccagcgacgtggccgagcccctgcacgagaccatcgtgagcgagcccgccgagatccagagcgaggaggaggagatcgaggcccagggcgagtacgacaagctgctgttcagaagcgacaccctgcagatcaccgacctgggcgtgagcggcgccagagaggagttcgtggagacctgccccagcgagcacaagggcgtgatcgagagcgtggtgaccatcgaggacgacttcatcaccgtggtgcagaccaccaccgacgagggcgagagcggcagccacagcgtgagattcgccgccctggagcagcccgaggtggagagaagacccagcccccacgacgaggaggagttcgaggtggaggaggccgccgaggcccaggccgagcccaaggacggcagccccgaggcccccgccagccccgagagagaggaggtggccctgagcgagtacaagaccgagacctacgacgactacaaggacgagaccaccatcgacgacagcatcatggacgccgacagcctgtgggtggacacccaggacgacgacagaagcatcatgaccgagcagctggagaccatccccaaggaggagaaggccgagaaggaggccagaagaagcagcctggagaagcacagaaaggagaagcccttcaagaccggcagaggcagaatcagcacccccgagagaaaggtggccaagaaggagcccagcaccgtgagcagagacgaggtgagaagaaagaaggccgtgtacaagaaggccgagctggccaagaagaccgaggtgcaggcccacagccccagcagaaagttcatcctgaagcccgccatcaagtacaccagacccacccacctgagctgcgtgaagagaaagaccaccgccgccggcggcgagagcgccctggcccccagcgtgttcaagcaggccaaggacaaggtgagcgacggcgtgaccaagagccccgagaagagaagcagcctgcccagacccagcagcatcctgccccccagaagaggcgtgagcggcgacagagacgagaacagcttcagcctgaacagcagcatcagcagcagcgccagaagaaccaccagaagcgagcccatcagaagagccggcaagagcggcaccagcacccccaccacccccggcagcaccgccatcacccccggcaccccccccagctacagcagcagaacccccggcacccccggcacccccagctaccccagaaccccccacacccccggcacccccaagagcgccatcctggtgcccagcgagaagaaggtggccatcatcagaaccccccccaagagccccgccacccccaagcagctgagactgatcaaccagcccctgcccgacctgaagaacgtgaagagcaagatcggcagcaccgacaacatcaagtaccagcccaagggcggccaggtgcagatcgtgaccaagaagatcgacctgagccacgtgaccagcaagtgcggcagcctgaagaacatcagacacagacccggcggcggcagagtgaagatcgagagcgtgaagctggacttcaaggagaaggcccaggccaaggtgggcagcctggacaacgcccaccacgtgcccggcggcggcaacgtgaagatcgacagccagaagctgaacttcagagagcacgccaaggccagagtggaccacggcgccgagatcatcacccagagccccggcagaagcagcgtggccagccccagaagactgagcaacgtgagcagcagcggcagcatcaacctgctggagagcccccagctggccaccctggccgaggacgtgaccgccgccctggccaagcagggcctgtag

SEQ ID NO: 88967 - DNA, 2664 bp, Artificial Sequence
  Description of Artificial Sequence: Synthetic coding sequence
atggagaccaccggcgaccagggcatcgagggcatggcctacatggacgagaacagaaacatcaccttcacctgccccagaacccccagcgagctgatcaacaagagcagccccctggaggtgctggagagcgccgcctgcgagaagctgcccacccccaccccccaggtggtgaaggagggcgacagcttccccgacaccctggccaagaacggccaggagatcgcccccgcccagatcagcaagagcctgatggtggacaactacaccaaggacggcgtgcccggccaggagagacccaagggccccagcgccgtggtgcccagcaccagcaccggcggcgtggccctgcccatcaccaccgccatcgagaccgtgaacatccacggcgaccacagcctgaagaacaaggccgagctggccgacagcatgaagaacgaggccggcatcgacgagggccacgtgatcggcgagagcgagagcgtgcacagcggcgccagcaagcacagcgtggagaaggtgaccgagctggccaagggccacctgctgcccggcgtgcccgtggaggaccagagcctgcccggcgaggccagagccctggagggctacgccgacagaggcaacttccccgcccaccccgtgaacgaggagaaggagaccaaggagggcagcgtggccgtgcagatccccgacctgctggaggacaaggcccagaagctgagcttctgcgaggaccagaacgcccaggacagaaacagcaagggcagcgacagcctgaacaagaaggtggacctgaccctgctgagccccaagagcgagaacgacaagctgaaggagatcagcctggcctgcaagatcaccgagctggagagcgtgagcctgcccacccccgagatccagagcgacttcctgcacagcaaggtggaggccccccccagcgaggtggccgacaccctggtgatcatgaccgccagcaagggcgtgagactgcccgagcccaaggacaagatcctggagaccccccagaagatgaccgagaagagcgagagcaagacccccggcgagggcaagaaggaggacaagagcagaatggccgagcccatgaagggctacatgagacccaccaagagcagaggcctgacccccctgctgcccaagagcaccatccaggagcaggagagacacaagcagctgaagagcgccggcatcgccagacccgaggagggcagacccgtggtgagcggcaccggcaacgacatcaccaccccccccaacaaggagctgccccccagccccgagaagaagaccaagcccctggccaccacccagcccgccaagaccagcaccagcaaggccaagacccagcccaccagcctgcccaagcagcccgcccccaccaccatcggcggcctgaacaagaagcccatgagcctggccagcggcctggtgcccgccgccccccccaagagacccgccgtggccagcgccagacccagcatcctgcccagcaaggacgtgaagcccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagccaaggtggagaagaagaccgaggccgccgccaccaccagaaagcccgagagcaacgccgtgaccaagaccgccggccccatcgccagcgcccagaagcagcccgccggcaaggtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagaccgagggcggcggcagcgaggcccccctgtgccccggcccccccgccggcgaggagcccgccatcagcgaggccgcccccgaggccggcgcccccaccagcgccagcggcctgaacggccaccccaccctgagcggcggcggcgaccagagagaggcccagaccctggacagccagatccaggagaccagcatctag

SEQ ID NO: 88968 - DNA, 1392 bp, Artificial Sequence
  Description of Artificial Sequence: Synthetic coding sequence
atctgcgaggagcccgtggccaagaagagagaggagctggcccacttcagcaacagcagcagcaacagcggcaagaaggagctgggcaccgccggcctgtacctgcacagcaagctggagcagatccccgagggcagcagcaaggagaagggccaggaggacttcagcgagaccagaatcgacagctgcagccaggtgtgccagagaggcgagaagcagcccggccagaccgccctggccggcaagaaggagatcgaggtgaccgccacccagagcacccccagcttcctgttcgagaagccccccagagacggcatcgccagacccgaggagggcagacccgtggtgagcggcaccggcaacgacatcaccaccccccccaacaaggagctgccccccagccccgagaagaagaccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagatcgagacctacagactgaccttcagagccaacgccagagccagaaccgaccacggcgccgacatcgtgagcagacccccccacttccccggcggccccaacagcggcagcagagtgctgggccccctgagcagagccgtgcactag

SEQ ID NO: 88969 - DNA, 3459 bp, Artificial Sequence
  Description of Artificial Sequence: Synthetic coding sequence
atggccgacctgagcctggccgacgccctgaccgagcccagccccgacatcgagggcgagatcaagagagacttcatcgccaccctggaggccgaggccttcgacgacgtggtgggcgagaccgtgggcaagaccgactacatccccctgctggacgtggacgagaagaccggcaacagcgagagcaagaagaagccctgcagcgagaccagccagatcgaggacacccccagcagcaagcccaccctgctggccaacggcggccacggcgtggagggcagcgacaccaccggcagccccaccgagttcctggaggagaagatggcctaccaggagtaccccaacagccagaactggcccgaggacaccaacttctgcttccagcccgagcaggtggtggaccccatccagaccgaccccttcaagatgtaccacgacgacgacctggccgacctggtgttccccagcagcgccaccgccgacaccagcatcttcgccggccagaacgaccccctgaaggacagctacggcatgagcccctgcaacaccgccgtggtgccccagggctggagcgtggaggccctgaacagcccccacagcgagagcttcgtgagccccgaggccgtggccgagcccccccagcccaccgccgtgcccctggagctggccaaggagatcgagatggccagcgaggagagaccccccgcccaggccctggagatcatgatgggcctgaagaccaccgacatggcccccagcaaggagaccgagatggccctggccaaggacatggccctggccaccaagaccgaggtggccctggccaaggacatggagagccccaccaagctggacgtgaccctggccaaggacatgcagcccagcatggagagcgacatggccctggtgaaggacatggagctgcccaccgagaaggaggtggccctggtgaaggacgtgagatggcccaccgagaccgacgtgagcagcgccaagaacgtggtgctgcccaccgagaccgaggtggcccccgccaaggacgtgaccctgctgaaggagaccgagagagccagccccatcaagatggacctggcccccagcaaggacatgggcccccccaaggagaacaagaaggagaccgagagagccagccccatcaagatggacctggcccccagcaaggacatgggcccccccaaggagaacaagatcgtgcccgccaaggacctggtgctgctgagcgagatcgaggtggcccaggccaacgacatcatcagcagcaccgagatcagcagcgccgagaaggtggccctgagcagcgagaccgaggtggccctggccagagacatgaccctgccccccgagaccaacgtgatcctgaccaaggacaaggccctgcccctggaggccgaggtggcccccgtgaaggacatggcccagctgcccgagaccgagatcgcccccgccaaggacgtggcccccagcaccgtgaaggaggtgggcctgctgaaggacatgagccccctgagcgagaccgagatggccctgggcaaggacgtgacccccccccccgagaccgaggtggtgctgatcaagaacgtgtgcctgccccccgagatggaggtggccctgaccgaggaccaggtgcccgccctgaagaccgaggcccccctggccaaggacggcgtgctgaccctggccaacaacgtgacccccgccaaggacgtgccccccctgagcgagaccgaggccacccccgtgcccatcaaggacatggagatcgcccagacccagaagggcatcagcgaggacagccacctggagagcctgcaggacgtgggccagagcgccgcccccaccttcatgatcagccccgagaccgtgaccggcaccggcaagaagtgcagcctgcccgccgaggaggacagcgtgctggagaagctgggcgagagaaagccctgcaacagccagcccagcgagctgagcagcgagaccagcggcatcgccagacccgaggagggcagacccgtggtgagcggcaccggcaacgacatcaccaccccccccaacaaggagctgccccccagccccgagaagaagaccaagcccctggccaccacccagcccgccaagaccagcaccagcaaggccaagacccagcccaccagcctgcccaagcagcccgcccccaccaccatcggcggcctgaacaagaagcccatgagcctggccagcggcctggtgcccgccgccccccccaagagacccgccgtggccagcgccagacccagcatcctgcccagcaaggacgtgaagcccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagccaaggtggagaagaagaccgaggccgccgccaccaccagaaagcccgagagcaacgccgtgaccaagaccgccggccccatcgccagcgcccagaagcagcccgccggcaaggtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagaccgagggcggcggcagcgaggcccccctgtgccccggcccccccgccggcgaggagcccgccatcagcgaggccgcccccgaggccggcgcccccaccagcgccagcggcctgaacggccaccccaccctgagcggcggcggcgaccagagagaggcccagaccctggacagccagatccaggagaccagcatctag

SEQ ID NO: 88970 - DNA, 2139 bp, Artificial Sequence
  Description of Artificial Sequence: Synthetic coding sequence
atggagaccaccggcgaccagggcatcgagggcatggcctacatggacgagaacagaaacatcaccttcacctgccccagaacccccagcgagctgatcaacaagagcagccccctggaggtgctggagagcgccgcctgcgagaagctgcccacccccaccccccaggtggtgaaggagggcgacagcttccccgacaccctggccaagaacggccaggagatcgcccccgcccagatcagcaagagcctgatggtggacaactacaccaaggacggcgtgcccggccaggagagacccaagggccccagcgccgtggtgcccagcaccagcaccggcggcgtggccctgcccatcaccaccgccatcgagaccgtgaacatccacggcgaccacagcctgaagaacaaggccgagctggccgacagcatgaagaacgaggccggcatcgacgagggccacgtgatcggcgagagcgagagcgtgcacagcggcgccagcaagcacagcgtggagaaggtgaccgagctggccaagggccacctgctgcccggcgtgcccgtggaggaccagagcctgcccggcgaggccagagccctggagggctacgccgacagaggcaacttccccgcccaccccgtgaacgaggagaaggagaccaaggagggcagcgtggccgtgcagatccccgacctgctggaggacaaggcccagaagctgagcttctgcgaggaccagaacgcccaggacagaaacagcaagggcagcgacagcctgaacaagaaggtggacctgaccctgctgagccccaagagcgagaacgacaagctgaaggagatcagcctggcctgcaagatcaccgagctggagagcgtgagcctgcccacccccgagatccagagcgacttcctgcacagcaaggtggaggccccccccagcgaggtggccgacaccctggtgatcatgaccgccagcaagggcgtgagactgcccgagcccaaggacaagatcctggagaccccccagaagatgaccgagaagagcgagagcaagacccccggcgagggcaagaaggaggacaagagcagaatggccgagcccatgaagggctacatgagacccaccaagagcagaggcctgacccccctgctgcccaagagcaccatccaggagcaggagagacacaagcagctgaagagcgccggcatcgccagacccgaggagggcagacccgtggtgagcggcaccggcaacgacatcaccaccccccccaacaaggagctgccccccagccccgagaagaagaccaagcccctggccaccacccagcccgccaagaccagcaccagcaaggccaagacccagcccaccagcctgcccaagcagcccgcccccaccaccatcggcggcctgaacaagaagcccatgagcctggccagcggcctggtgcccgccgccccccccaagagacccgccgtggccagcgccagacccagcatcctgcccagcaaggacgtgaagcccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggccaaggtggagaagaagaccgaggccgccgccaccaccagaaagcccgagagcaacgccgtgaccaagaccgccggccccatcgccagcgcccagaagcagcccgccggcaaggtgtag

SEQ ID NO: 88971 - DNA, 2436 bp, Artificial Sequence
  Description of Artificial Sequence: Synthetic coding sequence
atggccgacctgagcctggccgacgccctgaccgagcccagccccgacatcgagggcgagatcaagagagacttcatcgccaccctggaggccgaggccttcgacgacgtggtgggcgagaccgtgggcaagaccgactacatccccctgctggacgtggacgagaagaccggcaacagcgagagcaagaagaagccctgcagcgagaccagccagatcgaggacacccccagcagcaagcccaccctgctggccaacggcggccacggcgtggagggcagcgacaccaccggcagccccaccgagttcctggaggagaagatggcctaccaggagtaccccaacagccagaactggcccgaggacaccaacttctgcttccagcccgagcaggtggtggaccccatccagaccgaccccttcaagatgtaccacgacgacgacctggccgacctggtgttccccagcagcgccaccgccgacaccagcatcttcgccggccagaacgaccccctgaaggacagctacggcatgagcccctgcaacaccgccgtggtgccccagggctggagcgtggaggccctgaacagcccccacagcgagagcttcgtgagccccgaggccgtggccgagcccccccagcccaccgccgtgcccctggagctggccaaggagatcgagatggccagcgaggagagaccccccgcccaggccctggagatcatgatgggcctgaagaccaccgacatggcccccagcaaggagaccgagatggccctggccaaggacatggccctggccaccaagaccgaggtggccctggccaaggacatggagagccccaccaagctggacgtgaccctggccaaggacatgcagcccagcatggagagcgacatggccctggtgaaggacatggagctgcccaccgagaaggaggtggccctggtgaaggacggcgtgagactgcccgagcccaaggacaagatcctggagaccccccagaagatgaccgagaagagcgagagcaagacccccggcgagggcaagaaggaggacaagagcagaatggccgagcccatgaagggctacatgagacccaccaagagcagaggcctgacccccctgctgcccaagagcaccatccaggagcaggagagacacaagcagctgaagagcgccggcatcgccagacccgaggagggcagacccgtggtgagcggcaccggcaacgacatcaccaccccccccaacaaggagctgccccccagccccgagaagaagaccaagcccctggccaccacccagcccgccaagaccagcaccagcaaggccaagacccagcccaccagcctgcccaagcagcccgcccccaccaccatcggcggcctgaacaagaagcccatgagcctggccagcggcctggtgcccgccgccccccccaagagacccgccgtggccagcgccagacccagcatcctgcccagcaaggacgtgaagcccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagaccgagggcggcggcagcgaggcccccctgtgccccggcccccccgccggcgaggagcccgccatcagcgaggccgcccccgaggccggcgcccccaccagcgccagcggcctgaacggccaccccaccctgagcggcggcggcgaccagagagaggcccagaccctggacagccagatccaggagaccagcatctag

SEQ ID NO: 88972 - DNA, 3408 bp, Artificial Sequence
  Description of Artificial Sequence: Synthetic coding sequence
atggccgacctgagcctggccgacgccctgaccgagcccagccccgacatcgagggcgagatcaagagagacttcatcgccaccctggaggccgaggccttcgacgacgtggtgggcgagaccgtgggcaagaccgactacatccccctgctggacgtggacgagaagaccggcaacagcgagagcaagaagaagccctgcagcgagaccagccagatcgaggacacccccagcagcaagcccaccctgctggccaacggcggccacggcgtggagggcagcgacaccaccggcagccccaccgagttcctggaggagaagatggcctaccaggagtaccccaacagccagaactggcccgaggacaccaacttctgcttccagcccgagcaggtggtggaccccatccagaccgaccccttcaagatgtaccacgacgacgacctggccgacctggtgttccccagcagcgccaccgccgacaccagcatcttcgccggccagaacgaccccctgaaggacagctacggcatgagcccctgcaacaccgccgtggtgccccagggctggagcgtggaggccctgaacagcccccacagcgagagcttcgtgagccccgaggccgtggccgagcccccccagcccaccgccgtgcccctggagctggccaaggagatcgagatggccagcgaggagagaccccccgcccaggccctggagatcatgatgggcctgaagaccaccgacatggcccccagcaaggagaccgagatggccctggccaaggacatggccctggccaccaagaccgaggtggccctggccaaggacatggagagccccaccaagctggacgtgaccctggccaaggacatgcagcccagcatggagagcgacatggccctggtgaaggacatggagctgcccaccgagaaggaggtggccctggtgaaggacgtgagatggcccaccgagaccgacgtgagcagcgccaagaacgtggtgctgcccaccgagaccgaggtggcccccgccaaggacgtgaccctgctgaaggagaccgagagagccagccccatcaagatggacctggcccccagcaaggacatgggcccccccaaggagaacaagaaggagaccgagagagccagccccatcaagatggacctggcccccagcaaggacatgggcccccccaaggagaacaagatcgtgcccgccaaggacctggtgctgctgagcgagatcgaggtggcccaggccaacgacatcatcagcagcaccgagatcagcagcgccgagaaggtggccctgagcagcgagaccgaggtggccctggccagagacatgaccctgccccccgagaccaacgtgatcctgaccaaggacaaggccctgcccctggaggccgaggtggcccccgtgaaggacatggcccagctgcccgagaccgagatcgcccccgccaaggacgtggcccccagcaccgtgaaggaggtgggcctgctgaaggacatgagccccctgagcgagaccgagatggccctgggcaaggacgtgacccccccccccgagaccgaggtggtgctgatcaagaacgtgtgcctgccccccgagatggaggtggccctgaccgaggaccaggtgcccgccctgaagaccgaggcccccctggccaaggacggcgtgctgaccctggccaacaacgtgacccccgccaaggacgtgccccccctgagcgagaccgaggccacccccgtgcccatcaaggacatggagatcgcccagacccagaagggcatcagcgaggacagccacctggagagcctgcaggacgtgggccagagcgccgcccccaccttcatgatcagccccgagaccgtgaccggcaccggcaagaagtgcagcctgcccgccgaggaggacagcgtgctggagaagctgggcgagagaaagccctgcaacagccagcccagcgagctgagcagcgagaccagcggcatcgccagacccgaggagggcagacccgtggtgagcggcaccggcaacgacatcaccaccccccccaacaaggagctgccccccagccccgagaagaagaccaagcccctggccaccacccagcccgccaagaccagcaccagcaaggccaagacccagcccaccagcctgcccaagcagcccgcccccaccaccatcggcggcctgaacaagaagcccatgagcctggccagcggcctggtgcccgccgccccccccaagagacccgccgtggccagcgccagacccagcatcctgcccagcaaggacgtgaagcccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagccaaggtggagaagaagaccgaggccgccgccaccaccagaaagcccgagagcaacgccgtgaccaagaccgccggccccatcgccagcgcccagaagcagcccgccggcaaggtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagatcgagacctacagactgaccttcagagccaacgccagagccagaaccgaccacggcgccgacatcgtgagcagacccccccacttccccggcggccccaacagcggcagcagagtgctgggccccctgagcagagccgtgcactag

SEQ ID NO: 88973 - DNA, 2487 bp, Artificial Sequence
  Description of Artificial Sequence: Synthetic coding sequence
atgagcctgagcgacaagcagaccgccagcctgaccgccgcctacggccagctgagcaagggcaagcccgccgagtgcagaatggacagccccaaggagatcagccaggccggcttcgagtggcagagaaccgagggcaagctgaacgagatcggcctgaacgtgagcatggacggccagcccaaggacggcctggtgaagaacgccagcttcctggagcagaacaagctgtgcttcttcgagggcaagctggacaaggagctgagcatcgagatgcaggacaaggactgccaggaggccagcggccacctggagagcagatacgtgatcagcgagacctgccaccccctggagggcaacagcgtgcaccagaagaccagcgagttccacctgggcctgatcgagggccccgacaagaacaagaccatccccgtgcagggcaaggtggccggcaagaacggcctggagaccaagagccagagcgacctggacttccccggcgccgccgacatccccaccagatacgtgaaggagcaggagaccagcgtgtggaaccccagcttccaccccgtggcccagggcagcctgggcagcagagaggccacccccggcgagatggagaacagcatcacccccggctgccccgtgatcggcgtggtgaacgacaacagcgagcagctgaagtgcgagagccccctgctggtgagcctggcccaccccgcccccatcatcgagcacagccccaccaccatcccccccatcaccatggtgttcacccaggagcacctgaacgccagctgccacatcagagaccacgacaaggagctggagaagctgagcagcaccgaggaggccgtgctgaaccaggccccccagcagaagaaggccgtgagaagagccctgagcgagtgcagccacctgagcgtgccccccgccgtgaacctggccgacaagtaccccgagctgcccgccagagaggagcccagcagcggcctgctgcccccccccagcagccccatgcccagccccacccccggcaagctgggcgcccccgccatgaagagaagcatgaccgtgggcgaggagcagaccgccagctacaagctgagccccggcaagctgcccatcctgagcaccaaggagatcccccccttcatctgcgaggagcccgtggccaagaagagagaggagctggcccacttcagcaacagcagcagcaacagcggcaagaaggagctgggcaccgccggcctgtacctgcacagcaagctggagcagatccccgagggcagcagcaaggagaagggccaggaggacttcagcgagaccagaatcgacagctgcagccaggtgtgccagagaggcgagaagcagcccggccagaccgccctggccggcaagaaggagatcgaggtgaccgccacccagagcacccccagcttcctgttcgagaagccccccagagacggcatcgccagacccgaggagggcagacccgtggtgagcggcaccggcaacgacatcaccaccccccccaacaaggagctgccccccagccccgagaagaagaccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagatcgagacctacagactgaccttcagagccaacgccagagccagaaccgaccacggcgccgacatcgtgagcagacccccccacttccccggcggccccaacagcggcagcagagtgctgggccccctgagcagagccgtgcactag

SEQ ID NO: 88974 - DNA, 6894 bp, Artificial Sequence
  Description of Artificial Sequence: Synthetic coding sequence
atggccgacctgagcctggccgacgccctgaccgagcccagccccgacatcgagggcgagatcaagagagacttcatcgccaccctggaggccgaggccttcgacgacgtggtgggcgagaccgtgggcaagaccgactacatccccctgctggacgtggacgagaagaccggcaacagcgagagcaagaagaagccctgcagcgagaccagccagatcgaggacctgcccctgcccccccaccccgccagcctgagcttccacctgcccctggacacccccagcagcaagcccaccctgctggccaacggcggccacggcgtggagggcagcgacaccaccggcagccccaccgagttcctggaggagaagatggcctaccaggagtaccccaacagccagaactggcccgaggacaccaacttctgcttccagcccgagcaggtggtggaccccatccagaccgaccccttcaagatgtaccacgacgacgacctggccgacctggtgttccccagcagcgccaccgccgacaccagcatcttcgccggccagaacgaccccctgaaggacagctacggcatgagcccctgcaacaccgccgtggtgccccagggctggagcgtggaggccctgaacagcccccacagcgagagcttcgtgagccccgaggccgtggccgagcccccccagcccaccgccgtgcccctggagctggccaaggagatcgagatggccagcgaggagagaccccccgcccaggccctggagatcatgatgggcctgaagaccaccgacatggcccccagcaaggagaccgagatggccctggccaaggacatggccctggccaccaagaccgaggtggccctggccaaggacatggagagccccaccaagctggacgtgaccctggccaaggacatgcagcccagcatggagagcgacatggccctggtgaaggacatggagctgcccaccgagaaggaggtggccctggtgaaggacgtgagatggcccaccgagaccgacgtgagcagcgccaagaacgtggtgctgcccaccgagaccgaggtggcccccgccaaggacgtgaccctgctgaaggagaccgagagagccagccccatcaagatggacctggcccccagcaaggacatgggcccccccaaggagaacaagaaggagaccgagagagccagccccatcaagatggacctggcccccagcaaggacatgggcccccccaaggagaacaagatcgtgcccgccaaggacctggtgctgctgagcgagatcgaggtggcccaggccaacgacatcatcagcagcaccgagatcagcagcgccgagaaggtggccctgagcagcgagaccgaggtggccctggccagagacatgaccctgccccccgagaccaacgtgatcctgaccaaggacaaggccctgcccctggaggccgaggtggcccccgtgaaggacatggcccagctgcccgagaccgagatcgcccccgccaaggacgtggcccccagcaccgtgaaggaggtgggcctgctgaaggacatgagccccctgagcgagaccgagatggccctgggcaaggacgtgacccccccccccgagaccgaggtggtgctgatcaagaacgtgtgcctgccccccgagatggaggtggccctgaccgaggaccaggtgcccgccctgaagaccgaggcccccctggccaaggacggcgtgctgaccctggccaacaacgtgacccccgccaaggacgtgccccccctgagcgagaccgaggccacccccgtgcccatcaaggacatggagatcgcccagacccagaagggcatcagcgaggacagccacctggagagcctgcaggacgtgggccagagcgccgcccccaccttcatgatcagccccgagaccgtgaccggcaccggcaagaagtgcagcctgcccgccgaggaggacagcgtgctggagaagctgggcgagagaaagccctgcaacagccagcccagcgagctgagcagcgagaccagcgccaacttcatgtactgcggcaccccccccacccaggccaagcaggtgtgcagacccagcgacagaagaagcaccagacccaagcccgccagagtgccccccgagctgctgggcggcagccccccctggaagaccctggaccacagactgggccactgcagcctgagcgagagcggctgggtgagcggcagcagcagctgcggcggccccggcaaccagagaaagagcatccacgtggacagcctggagccccagagagacctgggcagagaggcctgggacatcgagagcacccccatcatgatgaagaagaagaagaagaagcccaagcagaagagatacagccagcccagagccggcggccccagcgacgacgacaacgccgacaagcccaagggccaccccttcgccgccgacacccagaagagcggcgtgctgcccagccagcccaccaccatgggcaccgagtacggcctggtgagcggcgagaacctgaagagagagtgcctggtgaacagcagcgccgccagactggtggccgagaacttcgtgagcgagagcctgagaatccccctgtaccccagcgaggaggcccccaagaccgccatcagcagccagagcaagctgagagtggaggaggagagcaagagcaacaagagcgtgctgcagaaccaggacaagaagctgctgaagcagcacgagtacaagccccagcccgccccccacctgaagacccccgtggacaagagccagagcgtgggccccctgaacctgaagggccccctggccgaggtgagcgcctacaacgtggagacccccctggacatcagactgaaggagggctgcagccccttcctggaccaggaggtgatgggcgtggtgagcaagcccaccgccgccaaggagatccccaacctggtgcccaccctgatcgccagcaaccccctggagtgcaacctgaaggagggcaacaacgagagcaagatgaccaagctgcagaacgtgaagctgaaggagttccccgagggcgccgaggaggacaaggagctgaagaaggaggccttccccaacgagagacaggagatcagcatcttcaccagcgagcagctgcagggccaggtgctggtgcaggtgcccggcgtggagaacgagcccttcaagagaatggccggcgacggcaagagcagaaagggcagaggcagcagcggcaagatgagaaccgacagcggcaaggtgaaggccaagagcgagctgcccttcctgctggacagccagaaggacggcagagccgtgctgatccccagcgagcccgtgagcaagaccgagggcatgaccacccaggacaagagcgaggagctgggcctgaacagcagcaagcagcccggcaccaaggccgacctgaccgaggccgtggtgatgggcgagcccaaggagatgacccagcccaaggtggccggcaccatgcaggccctgatccccctggagagcggcagcggcatgacccagaccagcggcgtgagcaccgagaccggcgacgtggtgaaggacatgggcgtgaacaaccagagcaaggagggcagatgcccctggaaggaccacgaggccgccccctggatcagcgagaagcccaagaagagaggcaacgagggcaagagcaagaagttcaagaacaactacagcacccagcccgccagaatggagagaaaggaggagatcctgaacccccccttcgagggcaaggacggcgacaccggcagcatcccccacaagagcaaggagatcggcttcaccttccccaagatgcacgacagcagcttcagccacacccccgacacccccaccgtggaggccgtggacagaaagggcggcaacttccaggtgaacttcgtggagctgggcaccctgggcgagaacaagatcagcaccgtgaaggccagcaccgtgaccgagccccccgccaaggtgaccgacgtgagctgccaggagcagatccagggcgccggcttcgtgcccagcgtggtgagcgaggagaacaagaccgacgccgccaacagatacaccgccgtggccgacaagcccagcaagagaagcaacgacggcaagagcaagaaggtgaagaacagcagccccgagaagcacatcctggagaacaagatcgacgccaccaagatccacgtgcccatggagaccaccggcgaccagggcatcgagggcatggcctacatggacgagaacagaaacatcaccttcacctgccccagaacccccagcgagctgatcaacaagagcagccccctggaggtgctggagagcgccgcctgcgagaagctgcccacccccaccccccaggtggtgaaggagggcgacagcttccccgacaccctggccaagaacggccaggagatcgcccccgcccagatcagcaagagcctgatggtggacaactacaccaaggacggcgtgcccggccaggagagacccaagggccccagcgccgtggtgcccagcaccagcaccggcggcgtggccctgcccatcaccaccgccatcgagaccgtgaacatccacggcgaccacagcctgaagaacaaggccgagctggccgacagcatgaagaacgaggccggcatcgacgagggccacgtgatcggcgagagcgagagcgtgcacagcggcgccagcaagcacagcgtggagaaggtgaccgagctggccaagggccacctgctgcccggcgtgcccgtggaggaccagagcctgcccggcgaggccagagccctggagggctacgccgacagaggcaacttccccgcccaccccgtgaacgaggagaaggagaccaaggagggcagcgtggccgtgcagatccccgacctgctggaggacaaggcccagaagctgagcttctgcgaggaccagaacgcccaggacagaaacagcaagggcagcgacagcctgaacaagaaggtggacctgaccctgctgagccccaagagcgagaacgacaagctgaaggagatcagcctggcctgcaagatcaccgagctggagagcgtgagcctgcccacccccgagatccagagcgacttcctgcacagcaaggtggaggccccccccagcgaggtggccgacaccctggtgatcatgaccgccagcaagggcgtgagactgcccgagcccaaggacaagatcctggagaccccccagaagatgaccgagaagagcgagagcaagacccccggcgagggcaagaaggaggacaagagcagaatggccgagcccatgaagggctacatgagacccaccaagagcagaggcctgacccccctgctgcccaagagcaccatccaggagcaggagagacacaagcagctgaagagcgccggcatcgccagacccgaggagggcagacccgtggtgagcggcaccggcaacgacatcaccaccccccccaacaaggagctgccccccagccccgagaagaagaccaagcccctggccaccacccagcccgccaagaccagcaccagcaaggccaagacccagcccaccagcctgcccaagcagcccgcccccaccaccatcggcggcctgaacaagaagcccatgagcctggccagcggcctggtgcccgccgccccccccaagagacccgccgtggccagcgccagacccagcatcctgcccagcaaggacgtgaagcccaagcccatcgccgacgccaaggcccccgagaagagagccagccccagcaagcccgccagcgcccccgccagcagaagcggcagcaagagcacccagaccgtggccaagaccaccaccgccgccgccgtggccagcaccggccccagcagcagaagccccagcaccctgctgcccaagaagcccaccgccatcaagaccgagggcaagcccgccgaggtgaagaagatgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagccaaggtggagaagaagaccgaggccgccgccaccaccagaaagcccgagagcaacgccgtgaccaagaccgccggccccatcgccagcgcccagaagcagcccgccggcaaggtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagaccgagggcggcggcagcgaggcccccctgtgccccggcccccccgccggcgaggagcccgccatcagcgaggccgcccccgaggccggcgcccccaccagcgccagcggcctgaacggccaccccaccctgagcggcggcggcgaccagagagaggcccagaccctggacagccagatccaggagaccagcatctag

SEQ ID NO: 88975 - DNA, 750 bp, Artificial Sequence
  Description of Artificial Sequence: Synthetic coding sequence
atgaccgccaagagcgtgcccgccgacctgagcagacccaagagcaccagcaccagcagcatgaagaagaccaccaccctgagcggcaccgcccccgccgccggcgtggtgcccagcagagtgaaggccacccccatgcccagcagacccagcaccacccccttcatcgacaagaagcccaccagcgccaagcccagcagcaccacccccagactgagcagactggccaccaacaccagcgcccccgacctgaagaacgtgagaagcaaggtgggcagcaccgagaacatcaagcaccagcccggcggcggcagagtgcagatcgtgagcaagaaggtgagctacagccacatccagagcaagtgcggcagcaaggacaacatcaagcacgtgcccggcggcggcaacgtgcagatccagaacaagaaggtggacatcagcaaggtgagcagcaagtgcggcagcaaggccaacatcaagcacaagcccggcggcggcgacgtgaagatcgagagccagaagctgaacttcaaggagaaggcccaggccaaggtgggcagcctggacaacgtgggccacctgcccgccggcggcgccgtgaagatcgagacctacagactgaccttcagagccaacgccagagccagaaccgaccacggcgccgacatcgtgagcagacccccccacttccccggcggccccaacagcggcagcagagtgctgggccccctgagcagagccgtgcactag

SEQ ID NO: 88976 - DNA, 300 bp, Artificial Sequence
  Description of Artificial Sequence: Synthetic coding sequence
atggccgacctgagcctggccgacgccctgaccgagcccagccccgacatcgagggcgagatcaagagagacttcatcgccaccctggaggccgaggccttcgacgacgtggtgggcgagaccgtgggcaagaccgactacatccccctgctggacgtggacgagaagaccggcaacagcgagagcaagaagaagccctgcagcgagaccagccagatcgaggacacccccagcagcaagcccaccctgctggccaacggcggccacggcgtggagggcagcgacaccaccgaggcctag

SEQ ID NO: 88977 - DNA, 2277 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggagcccgagagcggcaaggtggtgcaggagggcttcctgagagagcccggcccccccggcctgagccaccagctgatgagcggcatgcccggcgcccccctgctgcccgagggccccagagaggccaccagacagcccagcggcaccggccccgaggacaccgagggcggcagacacgcccccgagctgctgaagcaccagctgctgggcgacctgcaccaggagggcccccccctgaagggcgccggcggcaaggagagacccggcagcaaggaggaggtggacgaggacagagacgtggacgagagcagcccccaggacagcccccccagcaaggccagccccgcccaggacggcagacccccccagaccgccgccagagaggccaccagcatccccggcttccccgccgagggcgccatccccctgcccgtggacttcctgagcaaggtgagcaccgagatccccgccagcgagcccgacggccccagcgtgggcagagccaagggccaggacgcccccctggagttcaccttccacgtggagatcacccccaacgtgcagaaggagcaggcccacagcgaggagcacctgggcagagccgccttccccggcgcccccggcgagggccccgaggccagaggccccagcctgggcgaggacaccaaggaggccgacctgcccgagcccagcgagaagcagcccgccgccgcccccagaggcaagcccgtgagcagagtgccccagctgaaggccagaatggtgagcaagagcaaggacggcaccggcagcgacgacaagaaggccaagaccagcaccagaagcagcgccaagaccctgaagaacagaccctgcctgagccccaagcaccccacccccggcagcagcgaccccctgatccagcccagcagccccgccgtgtgccccgagccccccagcagccccaagtacgtgagcagcgtgaccagcagaaccggcagcagcggcgccaaggagatgaagctgaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88978 - DNA, 1152 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88979 - DNA, 1239 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88980 - DNA, 2331 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggagcccgagagcggcaaggtggtgcaggagggcttcctgagagagcccggcccccccggcctgagccaccagctgatgagcggcatgcccggcgcccccctgctgcccgagggccccagagaggccaccagacagcccagcggcaccggccccgaggacaccgagggcggcagacacgcccccgagctgctgaagcaccagctgctgggcgacctgcaccaggagggcccccccctgaagggcgccggcggcaaggagagacccggcagcaaggaggaggtggacgaggacagagacgtggacgagagcagcccccaggacagcccccccagcaaggccagccccgcccaggacggcagacccccccagaccgccgccagagaggccaccagcatccccggcttccccgccgagggcgccatccccctgcccgtggacttcctgagcaaggtgagcaccgagatccccgccagcgagcccgacggccccagcgtgggcagagccaagggccaggacgcccccctggagttcaccttccacgtggagatcacccccaacgtgcagaaggagcaggcccacagcgaggagcacctgggcagagccgccttccccggcgcccccggcgagggccccgaggccagaggccccagcctgggcgaggacaccaaggaggccgacctgcccgagcccagcgagaagcagcccgccgccgcccccagaggcaagcccgtgagcagagtgccccagctgaaggccagaatggtgagcaagagcaaggacggcaccggcagcgacgacaagaaggccaagaccagcaccagaagcagcgccaagaccctgaagaacagaccctgcctgagccccaagcaccccacccccggcagcagcgaccccctgatccagcccagcagccccgccgtgtgccccgagccccccagcagccccaagtacgtgagcagcgtgaccagcagaaccggcagcagcggcgccaaggagatgaagctgaagggcgccgacggcaagaccaagatcgccacccccagaggcgccgccccccccggccagaagggccaggccaacgccaccagaatccccgccaagaccccccccgcccccaagaccccccccagcagcgccaccaagcaggtgcagagaagacccccccccgccggccccagaagcgagagaggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88981 - DNA, 951 bp, Artificial Sequence
  Description of Artificial Sequence: Synthetic coding sequence
atgctgagagccctgcagcagagaaagagagaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88982 - DNA, 1326 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcatcaacaagaagctggacctgagcaacgtgcagagcaagtgcggcagcaaggacaacatcaagcacgtgcccggcggcggcagcgtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88983 - DNA, 1080 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88984 - DNA, 2331 bp, Artificial Sequence; identical to SEQ ID NO: 88980
  Description of Artificial Sequence: Synthetic coding sequence

SEQ ID NO: 88985 - DNA, 1239 bp, Artificial Sequence; identical to SEQ ID NO: 88979
  Description of Artificial Sequence: Synthetic coding sequence

SEQ ID NO: 88986 - DNA, 795 bp, Artificial Sequence
  Description of Artificial Sequence: Synthetic coding sequence
accagagaggccgagggcgccgacggcaagaccaagatcgccacccccaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88987 - DNA, 1059 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88988 - DNA, 1233 bp, Artificial Sequence
  Description of Artificial Sequence: Synthetic coding sequence
atggccgagcccagacaggagttcgaggtgatggaggaccacgccggcacctacggcctgggcgacagaaaggaccagggcggctacaccatgcaccaggaccaggagggcgacaccgacgccggcctgaaggagagccccctgcagacccccaccgaggacggcagcgaggagcccggcagcgagaccagcgacgccaagagcacccccaccgccgaggacgtgaccgcccccctggtggacgagggcgcccccggcaagcaggccgccgcccagccccacaccgagatccccgagggcaccaccgccgaggaggccggcatcggcgacacccccagcctggaggacgaggccgccggccacgtgacccaggccagaatggtgagcaagagcaaggacggcaccggcagcgacgacaagaaggccaagggcgccgacggcaagaccaagatcgccacccccagaggcgccgccccccccggccagaagggccaggccaacgccaccagaatccccgccaagaccccccccgcccccaagaccccccccagcagcggcgagccccccaagagcggcgacagaagcggctacagcagccccggcagccccggcacccccggcagcagaagcagaacccccagcctgcccaccccccccaccagagagcccaagaaggtggccgtggtgagaaccccccccaagagccccagcagcgccaagagcagactgcagaccgcccccgtgcccatgcccgacctgaagaacgtgaagagcaagatcggcagcaccgagaacctgaagcaccagcccggcggcggcaaggtgcagatcgtgtacaagcccgtggacctgagcaaggtgaccagcaagtgcggcagcctgggcaacatccaccacaagcccggcggcggccaggtggaggtgaagagcgagaagctggacttcaaggacagagtgcagagcaagatcggcagcctggacaacatcacccacgtgcccggcggcggcaacaagaagatcgagacccacaagctgaccttcagagagaacgccaaggccaagaccgaccacggcgccgagatcgtgtacaagagccccgtggtgagcggcgacaccagccccagacacctgagcaacgtgagcagcaccggcagcatcgacatggtggacagcccccagctggccaccctggccgacgaggtgagcgccagcctggccaagcagggcctgtag

SEQ ID NO: 88989 - DNA, 807 bp, Artificial Sequence
  Description of Artificial Sequence: Synthetic coding sequence
atggccgtgaacgtgtacagcaccagcgtgaccagcgacaacctgagcagacacgacatgctggcctggatcaacgagagcctgcagctgaacctgaccaagatcgagcagctgtgcagcggcgccgcctactgccagttcatggacatgctgttccccggcagcatcgccctgaagaaggtgaagttccaggccaagctggagcacgagtacatccagaacttcaagatcctgcaggccggcttcaagagaatgggcgtggacaagatcatccccgtggacaagctggtgaagggcaagttccaggacaacttcgagttcgtgcagtggttcaagaagttcttcgacgccaactacgacggcaaggactacgaccccgtggccgccagacagggccaggagaccgccgtggcccccagcctggtggcccccgccctgaacaagcccaagaagcccctgaccagcagcagcgccgccccccagagacccatcagcacccagagaaccgccgccgcccccaaggccggccccggcgtggtgagaaagaaccccggcgtgggcaacggcgacgacgaggccgccgagctgatgcagcaggtgaacgtgctgaagctgaccgtggaggacctggagaaggagagagacttctacttcggcaagctgagaaacatcgagctgatctgccaggagaacgagggcgagaacgaccccgtgctgcagagaatcgtggacatcctgtacgccaccgacgagggcttcgtgatccccgacgagggcggcccccaggaggagcaggaggagtactag

SEQ ID NO: 88990 - DNA, 984 bp, Artificial Sequence
  Description of Artificial Sequence: Synthetic coding sequence
atgcccggccccacccagaccctgagccccaacggcgagaacaacaacgacatcatccaggacaacaacggcaccatcatccccttcagaaagcacaccgtgagaggcgagagaagctacagctggggcatggccgtgaacgtgtacagcaccagcatcacccaggagaccatgagcagacacgacatcatcgcctgggtgaacgacatcgtgagcctgaactacaccaaggtggagcagctgtgcagcggcgccgcctactgccagttcatggacatgctgttccccggctgcatcagcctgaagaaggtgaagttccaggccaagctggagcacgagtacatccacaacttcaagctgctgcaggccagcttcaagagaatgaacgtggacaaggtgatccccgtggagaagctggtgaagggcagattccaggacaacctggacttcatccagtggttcaagaagttctacgacgccaactacgacggcaaggagtacgaccccgtggaggccagacagggccaggacgccatccccccccccgaccccggcgagcagatcttcaacctgcccaagaagagccaccacgccaacagccccaccgccggcgccgccaagagcagccccgccgccaagcccggcagcacccccagcagacccagcagcgccaagagagccagcagcagcggcagcgccagcaagagcgacaaggacctggagacccaggtgatccagctgaacgagcaggtgcacagcctgaagctggccctggagggcgtggagaaggagagagacttctacttcggcaagctgagagagatcgagctgctgtgccaggagcacggccaggagaacgacgacctggtgcagagactgatggacatcctgtacgccagcgaggagcacgagggccacaccgaggagcccgaggccgaggagcaggcccacgagcagcagcccccccagcaggaggagtactag

SEQ ID NO: 88991 - DNA, 855 bp, Artificial Sequence
  Description of Artificial Sequence: Synthetic coding sequence
atggccgtgaacgtgtacagcaccagcatcacccaggagaccatgagcagacacgacatcatcgcctgggtgaacgacatcgtgagcctgaactacaccaaggtggagcagctgtgcagcggcgccgcctactgccagttcatggacatgctgttccccggctgcatcagcctgaagaaggtgaagttccaggccaagctggagcacgagtacatccacaacttcaagctgctgcaggccagcttcaagagaatgaacgtggacaaggtgatccccgtggagaagctggtgaagggcagattccaggacaacctggacttcatccagtggttcaagaagttctacgacgccaactacgacggcaaggagtacgaccccgtggaggccagacagggccaggacgccatccccccccccgaccccggcgagcagatcttcaacctgcccaagaagagccaccacgccaacagccccaccgccggcgccgccaagagcagccccgccgccaagcccggcagcacccccagcagacccagcagcgccaagagagccagcagcagcggcagcgccagcaagagcgacaaggacctggagacccaggtgatccagctgaacgagcaggtgcacagcctgaagctggccctggagggcgtggagaaggagagagacttctacttcggcaagctgagagagatcgagctgctgtgccaggagcacggccaggagaacgacgacctggtgcagagactgatggacatcctgtacgccagcgaggagcacgagggccacaccgaggagcccgaggccgaggagcaggcccacgagcagcagcccccccagcaggaggagtactag

SEQ ID NO: 88992 - DNA, 948 bp, Artificial Sequence
  Description of Artificial Sequence: Synthetic coding sequence
atgaagcagaacagagaccagaagtgccccgtgagccagagaaacagcagcttccagcagcccggcagaaagcccggctgcagcagctggggcatggccgtgaacgtgtacagcaccagcatcacccaggagaccatgagcagacacgacatcatcgcctgggtgaacgacatcgtgagcctgaactacaccaaggtggagcagctgtgcagcggcgccgcctactgccagttcatggacatgctgttccccggctgcatcagcctgaagaaggtgaagttccaggccaagctggagcacgagtacatccacaacttcaagctgctgcaggccagcttcaagagaatgaacgtggacaaggtgatccccgtggagaagctggtgaagggcagattccaggacaacctggacttcatccagtggttcaagaagttctacgacgccaactacgacggcaaggagtacgaccccgtggaggccagacagggccaggacgccatccccccccccgaccccggcgagcagatcttcaacctgcccaagaagagccaccacgccaacagccccaccgccggcgccgccaagagcagccccgccgccaagcccggcagcacccccagcagacccagcagcgccaagagagccagcagcagcggcagcgccagcaagagcgacaaggacctggagacccaggtgatccagctgaacgagcaggtgcacagcctgaagctggccctggagggcgtggagaaggagagagacttctacttcggcaagctgagagagatcgagctgctgtgccaggagcacggccaggagaacgacgacctggtgcagagactgatggacatcctgtacgccagcgaggagcacgagggccacaccgaggagcccgaggccgaggagcaggcccacgagcagcagcccccccagcaggaggagtactag

SEQ ID NO: 88993 - DNA, 825 bp, Artificial Sequence
  Description of Artificial Sequence: Synthetic coding sequence
atggccagaaccaccaccaccagcagcagaatcatcaccggccccagcttcctgagcggcagcacccagtgcgccggcagcgtgcccaccggcgccgcctactgccagttcatggacatgctgttccccggctgcatcagcctgaagaaggtgaagttccaggccaagctggagcacgagtacatccacaacttcaagctgctgcaggccagcttcaagagaatgaacgtggacaaggtgatccccgtggagaagctggtgaagggcagattccaggacaacctggacttcatccagtggttcaagaagttctacgacgccaactacgacggcaaggagtacgaccccgtggaggccagacagggccaggacgccatccccccccccgaccccggcgagcagatcttcaacctgcccaagaagagccaccacgccaacagccccaccgccggcgccgccaagagcagccccgccgccaagcccggcagcacccccagcagacccagcagcgccaagagagccagcagcagcggcagcgccagcaagagcgacaaggacctggagacccaggtgatccagctgaacgagcaggtgcacagcctgaagctggccctggagggcgtggagaaggagagagacttctacttcggcaagctgagagagatcgagctgctgtgccaggagcacggccaggagaacgacgacctggtgcagagactgatggacatcctgtacgccagcgaggagcacgagggccacaccgaggagcccgaggccgaggagcaggcccacgagcagcagcccccccagcaggaggagtactag

SEQ ID NO: 88994 - DNA, 1005 bp, Artificial Sequence; identical to SEQ ID NO: 87863
  Description of Artificial Sequence: Synthetic coding sequence

SEQ ID NO: 88995 - DNA, 801 bp, Artificial Sequence
  Description of Artificial Sequence: Synthetic coding sequence
atggccgtgaacgtgtacagcaccagcgtgaccagcgagaacctgagcagacacgacatgctggcctgggtgaacgacagcctgcacctgaactacaccaagatcgagcagctgtgcagcggcgccgcctactgccagttcatggacatgctgttccccggctgcgtgcacctgagaaaggtgaagttccaggccaagctggagcacgagtacatccacaacttcaaggtgctgcaggccgccttcaagaagatgggcgtggacaagatcatccccgtggagaagctggtgaagggcaagttccaggacaacttcgagttcatccagtggttcaagaagttcttcgacgccaactacgacggcaaggactacaaccccctgctggccagacagggccaggacgtggcccccccccccaaccccgtgccccagagaaccagccccaccggccccaagaacatgcagaccagcggcagactgagcaacgtggcccccccctgcatcctgagaaagaacccccccagcgccagaaacggcggccacgagaccgacgcccagatcctggagctgaaccagcagctggtggacctgaagctgaccgtggacggcctggagaaggagagagacttctacttcagcaagctgagagacatcgagctgatctgccaggagcacgagagcgagaacagccccgtgatcagcggcatcatcggcatcctgtacgccaccgaggagggcttcgccccccccgaggacgacgagatcgaggagcaccagcaggaggaccaggacgagtactag

SEQ ID NO: 88996 - DNA, 801 bp, Artificial Sequence; identical to SEQ ID NO: 88995
  Description of Artificial Sequence: Synthetic coding sequence

SEQ ID NO: 88997 - DNA, 657 bp, Artificial Sequence
  Description of Artificial Sequence: Synthetic coding sequence
atggccgtgaacgtgtacagcaccagcgtgaccagcgagaacctgagcagacacgacatgctggcctgggtgaacgacagcctgcacctgaactacaccaagatcgagcagctgtgcagcggcgccgcctactgccagttcatggacatgctgttccccggctgcgtgcacctgagaaaggtgaagttccaggccaagctggagcacgagtacatccacaacttcaaggtgctgcaggccgccttcaagaagatgggcgtggacaagatcatccccgtggagaagctggtgaagggcaagttccaggacaacttcgagttcatccagtggttcaagaagttcttcgacgccaactacgacggcaaggactacaaccccctgctggccagacagggccaggacgtggcccccccccccaaccccggcgaccagatcttcaacaagagcaagaagctgatcggcaccgccgtgccccagagaaccagccccaccggccccaagaacatgcagaccagcggcagactgagcaacgtggcccccccctgcatcctgagaaagaacccccccagcgccagaaacggcggccacgagaccgacgcccagatcctggagctgaaccagcagctggtggacctgaagctgaccgtggacggctag

SEQ ID NO: 88998 - DNA, 2004 bp, Artificial Sequence
  Description of Artificial Sequence: Synthetic coding sequence
atggagaccctggagagcgagctgacctgccccatctgcctggagctgttcgaggaccccctgctgctgccctgcgcccacagcctgtgcttcaactgcgcccacagaatcctggtgagccactgcgccaccaacgagagcgtggagagcatcaccgccttccagtgccccacctgcagacacgtgatcaccctgagccagagaggcctggacggcctgaagagaaacgtgaccctgcagaacatcatcgacagattccagaaggccagcgtgagcggccccaacagccccagcgagaccagaagagagagagccttcgacgccaacaccatgaccagcgccgagaaggtgctgtgccagttctgcgaccaggaccccgcccaggacgccgtgaagacctgcgtgacctgcgaggtgagctactgcgacgagtgcctgaaggccacccaccccaacaagaagcccttcaccggccacagactgatcgagcccatccccgacagccacatcagaggcctgatgtgcctggagcacgaggacgagaaggtgaacatgtactgcgtgaccgacgaccagctgatctgcgccctgtgcaagctggtgggcagacacagagaccaccaggtggccgccctgagcgagagatacgacaagctgaagcagaacctggagagcaacctgaccaacctgatcaagagaaacaccgagctggagaccctgctggccaagctgatccagacctgccagcacgtggaggtgaacgccagcagacaggaggccaagctgaccgaggagtgcgacctgctgatcgagatcatccagcagagaagacagatcatcggcaccaagatcaaggagggcaaggtgatgagactgagaaagctggcccagcagatcgccaactgcaagcagtgcatcgagagaagcgccagcctgatcagccaggccgagcacagcctgaaggagaacgaccacgccagattcctgcagaccgccaagaacatcaccgagagagtgagcatggccaccgccagcagccaggtgctgatccccgagatcaacctgaacgacaccttcgacaccttcgccctggacttcagcagagagaagaagctgctggagtgcctggactacctgaccgcccccaacccccccaccatcagagaggagctgtgcaccgccagctacgacaccatcaccgtgcactggaccagcgacgacgagttcagcgtggtgagctacgagctgcagtacaccatcttcaccggccaggccaacgtggtgagcctgtgcaacagcgccgacagctggatgatcgtgcccaacatcaagcagaaccactacaccgtgcacggcctgcagagcggcaccaagtacatcttcatggtgaaggccatcaaccaggccggcagcagaagcagcgagcccggcaagctgaagaccaacagccagcccttcaagctggaccccaagagcgcccacagaaagctgaaggtgagccacgacaacctgaccgtggagagagacgagagcagcagcaagaagagccacacccccgagagattcaccagccagggcagctacggcgtggccggcaacgtgttcatcgacagcggcagacactactgggaggtggtgatcagcggcagcacctggtacgccatcggcctggcctacaagagcgcccccaagcacgagtggatcggcaagaacagcgccagctgggccctgtgcagatgcaacaacaactgggtggtgagacacaacagcaaggagatccccatcgagcccgccccccacctgagaagagtgggcatcctgctggactacgacaacggcagcatcgccttctacgacgccctgaacagcatccacctgtacaccttcgacgtggccttcgcccagcccgtgtgccccaccttcaccgtgtggaacaagtgcctgaccatcatcaccggcctgcccatccccgaccacctggactgcaccgagcagctgccctag

SEQ ID NO: 88999 - DNA, 2004 bp, Artificial Sequence; identical to SEQ ID NO: 88998
  Description of Artificial Sequence: Synthetic coding sequence

SEQ ID NO: 89000 - DNA, 2004 bp, Artificial Sequence; identical to SEQ ID NO: 88998
  Description of Artificial Sequence: Synthetic coding sequence

SEQ ID NO: 89001 - DNA, 1659 bp, Artificial Sequence
  Description of Artificial Sequence: Synthetic coding sequence
atggagaccctggagagcgagctgacctgccccatctgcctggagctgttcgaggaccccctgctgctgccctgcgcccacagcctgtgcttcaactgcgcccacagaatcctggtgagccactgcgccaccaacgagagcgtggagagcatcaccgccttccagtgccccacctgcagacacgtgatcaccctgagccagagaggcctggacggcctgaagagaaacgtgaccctgcagaacatcatcgacagattccagaaggccagcgtgagcggccccaacagccccagcgagaccagaagagagagagccttcgacgccaacaccatgaccagcgccgagaaggtgctgtgccagttctgcgaccaggaccccgcccaggacgccgtgaagacctgcgtgacctgcgaggtgagctactgcgacgagtgcctgaaggccacccaccccaacaagaagcccttcaccggccacagactgatcgagcccatccccgacagccacatcagaggcctgatgtgcctggagcacgaggacgagaaggtgaacatgtactgcgtgaccgacgaccagctgatctgcgccctgtgcaagctggtgggcagacacagagaccaccaggtggccgccctgagcgagagatacgacaagctgaagcagaacctggagagcaacctgaccaacctgatcaagagaaacaccgagctggagaccctgctggccaagctgatccagacctgccagcacgtggaggtgaacgccagcagacaggaggccaagctgaccgaggagtgcgacctgctgatcgagatcatccagcagagaagacagatcatcggcaccaagatcaaggagggcaaggtgatgagactgagaaagctggcccagcagatcgccaactgcaagcagtgcatcgagagaagcgccagcctgatcagccaggccgagcacagcctgaaggagaacgaccacgccagattcctgcagaccgccaagaacatcaccgagagagtgagcatggccaccgccagcagccaggtgctgatccccgagatcaacctgaacgacaccttcgacaccttcgccctggacttcagcagagagaagaagctgctggagtgcctggactacctgaccgcccccaacccccccaccatcagagaggagctgtgcaccgccagctacgacaccatcaccgtgcactggaccagcgacgacgagttcagcgtggtgagctacgagctgcagtacaccatcttcaccggccaggccaacgtggtgagcctgtgcaacagcgccgacagctggatgatcgtgcccaacatcaagcagaaccactacaccgtgcacggcctgcagagcggcaccaagtacatcttcatggtgaaggccatcaaccaggccggcagcagaagcagcgagcccggcaagctgaagaccaacagccagcccttcaagctggaccccaagagcgcccacagaaagctgaaggtgagccacgacaacctgaccgtggagagagacgagagcagcagcaagaagagccacacccccgagagattcaccagccagggcagctacggcgtggccggcaacgtgttcatcgacagcggcagacactactgggaggtggtgatcagcggcagcacctggtag

SEQ ID NO: 89002 - DNA, 2004 bp, Artificial Sequence; identical to SEQ ID NO: 88998
  Description of Artificial Sequence: Synthetic coding sequence

SEQ ID NO: 89003 - DNA, 2004 bp, Artificial Sequence; identical to SEQ ID NO: 88998
  Description of Artificial Sequence: Synthetic coding sequence

SEQ ID NO: 89004 - DNA, 1452 bp, Artificial Sequence
  Description of Artificial Sequence: Synthetic coding sequence
atggagaccctggagagcgagctgacctgccccatctgcctggagctgttcgaggaccccctgctgctgccctgcgcccacagcctgtgcttcaactgcgcccacagaatcctggtgagccactgcgccaccaacgagagcgtggagagcatcaccgccttccagtgccccacctgcagacacgtgatcaccctgagccagagaggcctggacggcctgaagagaaacgtgaccctgcagaacatcatcgacagattccagaaggccagcgtgagcggccccaacagccccagcgagaccagaagagagagagccttcgacgccaacaccatgaccagcgccgagaaggtgctgtgccagttctgcgaccaggaccccgcccaggacgccgtgaagacctgcgtgacctgcgaggtgagctactgcgacgagtgcctgaaggccacccaccccaacaagaagcccttcaccggccacagactgatcgagcccatccccgacagccacatcagaggcctgatgtgcctggagcacgaggacgagaaggtgaacatgtactgcgtgaccgacgaccagctgatctgcgccctgtgcaagctggtgggcagacacagagaccaccaggtggccgccctgagcgagagatacgacaagctgaagcagaacctggagagcaacctgaccaacctgatcaagagaaacaccgagctggagaccctgctggccaagctgatccagacctgccagcacgtggaggtgaacgccagcagacaggaggccaagctgaccgaggagtgcgacctgctgatcgagatcatccagcagagaagacagatcatcggcaccaagatcaaggagggcaaggtgatgagactgagaaagctggcccagcagatcgccaactgcaagcagtgcatcgagagaagcgccagcctgatcagccaggccgagcacagcctgaaggagaacgaccacgccagattcctgcagaccgccaagaacatcaccgagagagtgagcatggccaccgccagcagccaggtgctgatccccgagatcaacctgaacgacaccttcgacaccttcgccctggacttcagcagagagaagaagctgctggagtgcctggactacctgaccgcccccaacccccccaccatcagagaggagctgtgcaccgccagctacgacaccatcaccgtgcactggaccagcgacgacgagttcagcgtggtgagctacgagctgcagtacaccatcttcaccggccaggccaacgtggtgagcctgtgcaacagcgccgacagctggatgatcgtgcccaacatcaagcagaaccactacaccgtgcacggcctgcagagcggcaccaagtacatcttcatggtgaaggccatcaaccaggccggcagcagaagcagcgagcccggcaagctgaagaccaacagctag

SEQ ID NO: 89005 - DNA, 594 bp, Artificial Sequence
  Description of Artificial Sequence: Synthetic coding sequence
atggagaccctggagagcgagctgacctgccccatctgcctggagctgttcgaggaccccctgctgctgccctgcgcccacagcctgtgcttcaactgcgcccacagaatcctggtgagccactgcgccaccaacgagagcgtggagagcatcaccgccttccagtgccccacctgcagacacgtgatcaccctgagccagagaggcctggacggcctgaagagaaacgtgaccctgcagaacatcatcgacagattccagaaggccagcgtgagcggccccaacagccccagcgagaccagaagagagagagccttcgacgccaacaccatgaccagcgccgagaaggtgctgtgccagttctgcgaccaggaccccgcccaggacgccgtgaagacctgcgtgacctgcgaggtgagctactgcgacgagtgcctgaaggccacccaccccaacaagaagcccttcaccggccacagactgatcgagcccatccccgacagccacatcagaggcctgatgtgcctggagcacgaggacgagaaggtgaacatgtactgcgtgaccgacgaccagctgatctgcgccctgtag

SEQ ID NO: 89006 - DNA, 2004 bp, Artificial Sequence; identical to SEQ ID NO: 88998
  Description of Artificial Sequence: Synthetic coding sequence

SEQ ID NO: 89007 - DNA, 1854 bp, Artificial Sequence
  Description of Artificial Sequence: Synthetic coding sequence
atggagaccctggagagcgagctgacctgccccatctgcctggagctgttcgaggaccccctgctgctgccctgcgcccacagcctgtgcttcaactgcgcccacagaatcctggtgagccactgcgccaccaacgagagcgtggagagcatcaccgccttccagtgccccacctgcagacacgtgatcaccctgagccagagaggcctggacggcctgaagagaaacgtgaccctgcagaacatcatcgacagattccagaaggccagcgtgagcggccccaacagccccagcgagaccagcgccgagaaggtgctgtgccagttctgcgaccaggaccccgcccaggacgccgtgaagacctgcgtgacctgcgaggtgagctactgcgacgagtgcctgaaggccacccaccccaacaagaagcccttcaccggccacagactgatcgagcccatccccgacagccacatcagaggcctgatgtgcctggagcacgaggacgagaagcagaacctggagagcaacctgaccaacctgatcaagagaaacaccgagctggagaccctgctggccaagctgatccagacctgccagcacgtggaggtgaacgccagcagacaggaggccaagctgaccgaggagtgcgacctgctgatcgagatcatccagcagagaagacagatcatcggcaccaagatcaaggagggcaaggtgatgagactgagaaagctggcccagcagatcgccaactgcaagcagtgcatcgagagaagcgccagcctgatcagccaggccgagcacagcctgaaggagaacgaccacgccagattcctgcagaccgccaagaacatcaccgagagagtgagcatggccaccgccagcagccaggtgctgatccccgagatcaacctgaacgacaccttcgacaccttcgccctggacttcagcagagagaagaagctgctggagtgcctggactacctgaccgcccccaacccccccaccatcagagaggagctgtgcaccgccagctacgacaccatcaccgtgcactggaccagcgacgacgagttcagcgtggtgagctacgagctgcagtacaccatcttcaccggccaggccaacgtggtgagcctgtgcaacagcgccgacagctggatgatcgtgcccaacatcaagcagaaccactacaccgtgcacggcctgcagagcggcaccaagtacatcttcatggtgaaggccatcaaccaggccggcagcagaagcagcgagcccggcaagctgaagaccaacagccagcccttcaagctggaccccaagagcgcccacagaaagctgaaggtgagccacgacaacctgaccgtggagagagacgagagcagcagcaagaagagccacacccccgagagattcaccagccagggcagctacggcgtggccggcaacgtgttcatcgacagcggcagacactactgggaggtggtgatcagcggcagcacctggtacgccatcggcctggcctacaagagcgcccccaagcacgagtggatcggcaagaacagcgccagctgggccctgtgcagatgcaacaacaactgggtggtgagacacaacagcaaggagatccccatcgagcccgccccccacctgagaagagtgggcatcctgctggactacgacaacggcagcatcgccttctacgacgccctgaacagcatccacctgtacaccttcgacgtggccttcgcccagcccgtgtgccccaccttcaccgtgtggaacaagtgcctgaccatcatcaccggcctgcccatccccgaccacctggactgcaccgagcagctgccctag

SEQ ID NO: 89008 - DNA, 2208 bp, Artificial Sequence
  Description of Artificial Sequence: Synthetic coding sequence
atgggcgagagccccgccagcgtggtgctgaacgccagcggcggcctgttcagcctgaagatggagaccctggagagcgagctgacctgccccatctgcctggagctgttcgaggaccccctgctgctgccctgcgcccacagcctgtgcttcagctgcgcccacagaatcctggtgagcagctgcagcagcggcgagagcatcgagcccatcaccgccttccagtgccccacctgcagatacgtgatcagcctgaaccacagaggcctggacggcctgaagagaaacgtgaccctgcagaacatcatcgacagattccagaaggccagcgtgagcggccccaacagccccagcgagagcagaagagagagaacctacagacccaccaccgccatgagcagcgagagaatcgcctgccagttctgcgagcaggacccccccagagacgccgtgaagacctgcatcacctgcgaggtgagctactgcgacagatgcctgagagccacccaccccaacaagaagcccttcaccagccacagactggtggagcccgtgcccgacacccacctgagaggcatcacctgcctggaccacgagaacgagaaggtgaacatgtactgcgtgagcgacgaccagctgatctgcgccctgtgcaagctggtgggcagacacagagaccaccaggtggccagcctgaacgacagattcgagaagctgaagcagaccctggagatgaacctgaccaacctggtgaagagaaacagcgagctggagaaccagatggccaagctgatccagatctgccagcaggtggaggtgaacaccgccatgcacgaggccaagctgatggaggagtgcgacgagctggtggagatcatccagcagagaaagcagatgatcgccgtgaagatcaaggagaccaaggtgatgaagctgagaaagctggcccagcaggtggccaactgcagacagtgcctggagagaagcaccgtgctgatcaaccaggccgagcacatcctgaaggagaacgaccaggccagattcctgcagagcgccaagaacatcgccgagagagtggccatggccaccgccagcagccaggtgctgatccccgacatcaacttcaacgacgccttcgagaacttcgccctggacttcagcagagagaagaagctgctggagggcctggactacctgaccgcccccaacccccccagcatcagagaggagctgtgcaccgccagccacgacaccatcaccgtgcactggatcagcgacgacgagttcagcatcagcagctacgagctgcagtacaccatcttcaccggccaggccaacttcatcagcaagagctggtgcagctggggcctgtggcccgagatcagaaagtgcaaggaggccgtgagctgcagcagactggccggcgcccccagaggcctgtacaacagcgtggacagctggatgatcgtgcccaacatcaagcagaaccactacaccgtgcacggcctgcagagcggcaccagatacatcttcatcgtgaaggccatcaaccaggccggcagcagaaacagcgagcccaccagactgaagaccaacagccagcccttcaagctggaccccaagatgacccacaagaagctgaagatcagcaacgacggcctgcagatggagaaggacgagagcagcctgaagaagagccacacccccgagagattcagcggcaccggctgctacggcgccgccggcaacatcttcatcgacagcggctgccactactgggaggtggtgatgggcagcagcacctggtacgccatcggcatcgcctacaagagcgcccccaagaacgagtggatcggcaagaacgccagcagctgggtgttcagcagatgcaacagcaacttcgtggtgagacacaacaacaaggagatgctggtggacgtgcccccccacctgaagagactgggcgtgctgctggactacgacaacaacatgctgagcttctacgaccccgccaacagcctgcacctgcacaccttcgacgtgaccttcatcctgcccgtgtgccccaccttcaccatctggaacaagagcctgatgatcctgagcggcctgcccgcccccgacttcatcgactaccccgagagacaggagtgcaactgcagaccccaggagagcccctacgtgagcggcatgaagacctgccactag

SEQ ID NO: 89009 - DNA, 2118 bp, Artificial Sequence
  Description of Artificial Sequence: Synthetic coding sequence
atgggcgagagccccgccagcgtggtgctgaacgccagcggcggcctgttcagcctgaagatggagaccctggagagcgagctgacctgccccatctgcctggagctgttcgaggaccccctgctgctgccctgcgcccacagcctgtgcttcagctgcgcccacagaatcctggtgagcagctgcagcagcggcgagagcatcgagcccatcaccgccttccagtgccccacctgcagatacgtgatcagcctgaaccacagaggcctggacggcctgaagagaaacgtgaccctgcagaacatcatcgacagattccagaaggccagcgtgagcggccccaacagccccagcgagagcagaagagagagaacctacagacccaccaccgccatgagcagcgagagaatcgcctgccagttctgcgagcaggacccccccagagacgccgtgaagacctgcatcacctgcgaggtgagctactgcgacagatgcctgagagccacccaccccaacaagaagcccttcaccagccacagactggtggagcccgtgcccgacacccacctgagaggcatcacctgcctggaccacgagaacgagaaggtgaacatgtactgcgtgagcgacgaccagctgatctgcgccctgtgcaagctggtgggcagacacagagaccaccaggtggccagcctgaacgacagattcgagaagctgaagcagaccctggagatgaacctgaccaacctggtgaagagaaacagcgagctggagaaccagatggccaagctgatccagatctgccagcaggtggaggtgaacaccgccatgcacgaggccaagctgatggaggagtgcgacgagctggtggagatcatccagcagagaaagcagatgatcgccgtgaagatcaaggagaccaaggtgatgaagctgagaaagctggcccagcaggtggccaactgcagacagtgcctggagagaagcaccgtgctgatcaaccaggccgagcacatcctgaaggagaacgaccaggccagattcctgcagagcgccaagaacatcgccgagagagtggccatggccaccgccagcagccaggtgctgatccccgacatcaacttcaacgacgccttcgagaacttcgccctggacttcagcagagagaagaagctgctggagggcctggactacctgaccgcccccaacccccccagcatcagagaggagctgtgcaccgccagccacgacaccatcaccgtgcactggatcagcgacgacgagttcagcatcagcagctacgagctgcagtacaccatcttcaccggccaggccaacttcatcagcctgtacaacagcgtggacagctggatgatcgtgcccaacatcaagcagaaccactacaccgtgcacggcctgcagagcggcaccagatacatcttcatcgtgaaggccatcaaccaggccggcagcagaaacagcgagcccaccagactgaagaccaacagccagcccttcaagctggaccccaagatgacccacaagaagctgaagatcagcaacgacggcctgcagatggagaaggacgagagcagcctgaagaagagccacacccccgagagattcagcggcaccggctgctacggcgccgccggcaacatcttcatcgacagcggctgccactactgggaggtggtgatgggcagcagcacctggtacgccatcggcatcgcctacaagagcgcccccaagaacgagtggatcggcaagaacgccagcagctgggtgttcagcagatgcaacagcaacttcgtggtgagacacaacaacaaggagatgctggtggacgtgcccccccacctgaagagactgggcgtgctgctggactacgacaacaacatgctgagcttctacgaccccgccaacagcctgcacctgcacaccttcgacgtgaccttcatcctgcccgtgtgccccaccttcaccatctggaacaagagcctgatgatcctgagcggcctgcccgcccccgacttcatcgactaccccgagagacaggagtgcaactgcagaccccaggagagcccctacgtgagcggcatgaagacctgccactag

SEQ ID NO: 89010 - DNA, 660 bp, Artificial Sequence
  Description of Artificial Sequence: Synthetic coding sequence
atggagaccctggagagcgagctgacctgccccatctgcctggagctgttcgaggaccccctgctgctgccctgcgcccacagcctgtgcttcagctgcgcccacagaatcctggtgagcagctgcagcagcggcgagagcatcgagcccatcaccgccttccagtgccccacctgcagatacgtgatcagcctgaaccacagaggcctggacggcctgaagagaaacgtgaccctgcagaacatcatcgacagattccagaaggccagcgtgagcggccccaacagccccagcgagagcagaagagagagaacctacagacccaccaccgccatgagcagcgagagaatcgcctgccagttctgcgagcaggacccccccagagacgccgtgaagacctgcatcacctgcgaggtgagctactgcgacagatgcctgagagccacccaccccaacaagaagcccttcaccagccacagactggtggagcccgtgcccgacacccacctgagaggcatcacctgcctggaccacgagaacgagaaggtgaacatgtactgcgtgagcgacgaccagctgatctgcgccctgtgcaagctggtgggcagacacagagaccaccaggtggccagcctgaacgacagattcgagaagctgtag

SEQ ID NO: 89011 - DNA, 1407 bp, Artificial Sequence
  Description of Artificial Sequence: Synthetic coding sequence
atggagccccagcccggcggcgccagaagctgcagaagaggcgcccccggcggcgcctgcgagctgggccccgccgccgaggccgcccccatgagcctggccatccacagcaccaccggcaccagatacgacctggccgtgccccccgacgagaccgtggagggcctgagaaagagactgagccagagactgaaggtgcccaaggagagactggccctgctgcacaaggacaccagactgagcagcggcaagctgcaggagttcggcgtgggcgacggcagcaagctgaccctggtgcccaccgtggaggccggcctgatgagccaggccagcagacccgagcagagcgtgatgcaggccctggagagcctgaccgagacccaggtgagcgacttcctgagcggcagaagccccctgaccctggccctgagagtgggcgaccacatgatgttcgtgcagctgcagctggccgcccagcacgcccccctgcagcacagacacgtgctggccgccgccgccgccgccgccgccgccagaggcgaccccagcatcgccagccccgtgagcagcccctgcagacccgtgagcagcgccgccagagtgccccccgtgcccaccagccccagccccgccagccccagccccatcaccgccggcagcttcagaagccacgccgccagcaccacctgccccgagcagatggactgcagccccaccgccagcagcagcgccagccccggcgccagcaccaccagcacccccggcgccagccccgcccccagaagcagaaagcccggcgccgtgatcgagagcttcgtgaaccacgcccccggcgtgttcagcggcaccttcagcggcaccctgcaccccaactgccaggacagcagcggcagacccagaagagacatcggcaccatcctgcagatcctgaacgacctgctgagcgccaccagacactaccagggcatgccccccagcctggcccagctgagatgccacgcccagtgcagccccgccagccccgcccccgacctggcccccagaaccaccagctgcgagaagctgaccgccgcccccagcgccagcctgctgcagggccagagccagatcagaatgtgcaagccccccggcgacagactgagacagaccgagaacagagccaccagatgcaaggtggagagactgcagctgctgctgcagcagaagagactgagaagaaaggccagaagagacgccagaggcccctaccactggagccccagcagaaaggccggcagaagcgacagcagcagcagcggcggcggcggcagccccagcgaggccagcggcctgggcctggacttcgaggacagcgtgtggaagcccgaggtgaaccccgacatcaagagcgagttcgtggtggcctag

SEQ ID NO: 89012 - DNA, 771 bp, Artificial Sequence
  Description of Artificial Sequence: Synthetic coding sequence
atgggcgagcccagcagagaggagtacaagatccagagcttcgacgccgagacccagcagctgctgaagaccgccctgaaggtggcctgcttcgagaccgaggacggcgagtacagcgtgtgccagagaagctacagcaactgcagcagactgatgcccagcagatgcaacacccagtacagagaccccggcgccgtggacctggagaaggtggccaacgtgatcgtggaccacagcctgcaggactgcgtgttcagcaaggaggccggcagaatgtgctacgccatcatccaggccgagagcaagcaggccggccagagcgtgttcagaagaggcctgctgaacagactgcagcaggagtaccaggccagagagcagctgagagccagaagcctgcagggctgggtgtgctacgtgaccttcatctgcaacatcttcgactacctgagagtgaacaacatgcccatgatggccctggtgaaccccgtgtacgactgcctgttcagactggcccagcccgacagcctgagcaaggaggaggaggtggactgcctggtgctgcagctgcacagagtgggcgagcagctggagaagatgaacggccagagaatggacgagctgttcgtgctgatcagagacggcttcctgctgcccaccggcctgagcagcctggcccagctgctgctgctggagatcatcgagttcagagccgccggctggaagaccacccccgccgcccacaagtactactacagcgaggtgagcgactag

SEQ ID NO: 89013 - DNA, 669 bp, Artificial Sequence
  Description of Artificial Sequence: Synthetic coding sequence
atgggcgagcccagcagagaggagtacaagatccagagcttcgacgccgagacccagcagctgctgaagaccgccctgaaggaccccggcgccgtggacctggagaaggtggccaacgtgatcgtggaccacagcctgcaggactgcgtgttcagcaaggaggccggcagaatgtgctacgccatcatccaggccgagagcaagcaggccggccagagcgtgttcagaagaggcctgctgaacagactgcagcaggagtaccaggccagagagcagctgagagccagaagcctgcagggctgggtgtgctacgtgaccttcatctgcaacatcttcgactacctgagagtgaacaacatgcccatgatggccctggtgaaccccgtgtacgactgcctgttcagactggcccagcccgacagcctgagcaaggaggaggaggtggactgcctggtgctgcagctgcacagagtgggcgagcagctggagaagatgaacggccagagaatggacgagctgttcgtgctgatcagagacggcttcctgctgcccaccggcctgagcagcctggcccagctgctgctgctggagatcatcgagttcagagccgccggctggaagaccacccccgccgcccacaagtactactacagcgaggtgagcgactag

SEQ ID NO: 89014 - DNA, 792 bp, Artificial Sequence
  Description of Artificial Sequence: Synthetic coding sequence
atgggcgagcccagcagagaggagtacaagatccagagcttcgacgccgagacccagcagctgctgaagaccgccctgaaggcccccagcctggagtgcaccgtggcctgcttcgagaccgaggacggcgagtacagcgtgtgccagagaagctacagcaactgcagcagactgatgcccagcagatgcaacacccagtacagagaccccggcgccgtggacctggagaaggtggccaacgtgatcgtggaccacagcctgcaggactgcgtgttcagcaaggaggccggcagaatgtgctacgccatcatccaggccgagagcaagcaggccggccagagcgtgttcagaagaggcctgctgaacagactgcagcaggagtaccaggccagagagcagctgagagccagaagcctgcagggctgggtgtgctacgtgaccttcatctgcaacatcttcgactacctgagagtgaacaacatgcccatgatggccctggtgaaccccgtgtacgactgcctgttcagactggcccagcccgacagcctgagcaaggaggaggaggtggactgcctggtgctgcagctgcacagagtgggcgagcagctggagaagatgaacggccagagaatggacgagctgttcgtgctgatcagagacggcttcctgctgcccaccggcctgagcagcctggcccagctgctgctgctggagatcatcgagttcagagccgccggctggaagaccacccccgccgcccacaagtactactacagcgaggtgagcgactag

SEQ ID NO: 89015 - DNA, 1164 bp, Artificial Sequence
  Description of Artificial Sequence: Synthetic coding sequence
atgcccagacccagactgctggccgccctgtgcggcgccctgctgtgcgcccccagcctgctggtggccctggacatctgcagcaagaacccctgccacaacggcggcctgtgcgaggagatcagccaggaggtgagaggcgacgtgttccccagctacacctgcacctgcctgaagggctacgccggcaaccactgcgagaccaagtgcgtggagcccctgggcctggagaacggcaacatcgccaacagccagatcgccgccagcagcgtgagagtgaccttcctgggcctgcagcactgggtgcccgagctggccagactgaacagagccggcatggtgaacgcctggacccccagcagcaacgacgacaacccctggatccaggtgaacctgctgagaagaatgtgggtgaccggcgtggtgacccagggcgccagcagactggccagccacgagtacctgaaggccttcaaggtggcctacagcctgaacggccacgagttcgacttcatccacgacgtgaacaagaagcacaaggagttcgtgggcaactggaacaagaacgccgtgcacgtgaacctgttcgagacccccgtggaggcccagtacgtgagactgtaccccaccagctgccacaccgcctgcaccctgagattcgagctgctgggctgcgagctgaacggctgcgccaaccccctgggcctgaagaacaacagcatccccgacaagcagatcaccgccagcagcagctacaagacctggggcctgcacctgttcagctggaaccccagctacgccagactggacaagcagggcaacttcaacgcctgggtggccggcagctacggcaacgaccagtggctgcaggtggacctgggcagcagcaaggaggtgaccggcatcatcacccagggcgccagaaacttcggcagcgtgcagttcgtggccagctacaaggtggcctacagcaacgacagcgccaactggaccgagtaccaggaccccagaaccggcagcagcaagatcttccccggcaactgggacaaccacagccacaagaagaacctgttcgagacccccatcctggccagatacgtgagaatcctgcccgtggcctggcacaacagaatcgccctgagactggagctgctgggctgctag

SEQ ID NO: 89016 - DNA, 1140 bp, Artificial Sequence
  Description of Artificial Sequence: Synthetic coding sequence
atgtggcccttccccgagggcggcaacaccatccccatcctgcacaccgacatctgcagcaagaacccctgccacaacggcggcctgtgcgaggagatcagccaggaggtgagaggcgacgtgttccccagctacacctgcacctgcctgaagggctacgccggcaaccactgcgagaccaagtgcgtggagcccctgggcctggagaacggcaacatcgccaacagccagatcgccgccagcagcgtgagagtgaccttcctgggcctgcagcactgggtgcccgagctggccagactgaacagagccggcatggtgaacgcctggacccccagcagcaacgacgacaacccctggatccaggtgaacctgctgagaagaatgtgggtgaccggcgtggtgacccagggcgccagcagactggccagccacgagtacctgaaggccttcaaggtggcctacagcctgaacggccacgagttcgacttcatccacgacgtgaacaagaagcacaaggagttcgtgggcaactggaacaagaacgccgtgcacgtgaacctgttcgagacccccgtggaggcccagtacgtgagactgtaccccaccagctgccacaccgcctgcaccctgagattcgagctgctgggctgcgagctgaacggctgcgccaaccccctgggcctgaagaacaacagcatccccgacaagcagatcaccgccagcagcagctacaagacctggggcctgcacctgttcagctggaaccccagctacgccagactggacaagcagggcaacttcaacgcctgggtggccggcagctacggcaacgaccagtggctgcaggtggacctgggcagcagcaaggaggtgaccggcatcatcacccagggcgccagaaacttcggcagcgtgcagttcgtggccagctacaaggtggcctacagcaacgacagcgccaactggaccgagtaccaggaccccagaaccggcagcagcaagatcttccccggcaactgggacaaccacagccacaagaagaacctgttcgagacccccatcctggccagatacgtgagaatcctgcccgtggcctggcacaacagaatcgccctgagactggagctgctgggctgctag

SEQ ID NO: 89017 - DNA, 1008 bp, Artificial Sequence
  Description of Artificial Sequence: Synthetic coding sequence
atgcccagacccagactgctggccgccctgtgcggcgccctgctgtgcgcccccagcctgctggtggccctggacatctgcagcaagaacccctgccacaacggcggcctgtgcgaggagatcagccaggaggtgagaggcgacgtgttccccagctacacctgcacctgcctgaagggctacgccggcaaccactgcgagaccaagtgcgtggagcccctgggcctggagaacggcaacatcgccaacagccagatcgccgccagcagcgtgagagtgaccttcctgggcctgcagcactgggtgcccgagctggccagactgaacagagccggcatggtgaacgcctggacccccagcagcaacgacgacaacccctggatccaggtgaacctgctgagaagaatgtgggtgaccggcgtggtgacccagggcgccagcagactggccagccacgagtacctgaaggccttcaaggtggcctacagcctgaacggccacgagttcgacttcatccacgacgtgaacaagaagcacaaggagttcgtgggcaactggaacaagaacgccgtgcacgtgaacctgttcgagacccccgtggaggcccagtacgtgagactgtaccccaccagctgccacaccgcctgcaccctgagattcgagctgctgggctgcgagctgaacggctgcgccaaccccctgggcctgaagaacaacagcatccccgacaagcagatcaccgccagcagcagctacaagacctggggcctgcacctgttcagctggaaccccagctacgccagactggacaagcagggcaacttcaacgcctgggtggccggcagctacggcaacgaccagtggctgcagatcttccccggcaactgggacaaccacagccacaagaagaacctgttcgagacccccatcctggccagatacgtgagaatcctgcccgtggcctggcacaacagaatcgccctgagactggagctgctgggctgctag

SEQ ID NO: 89018 - DNA, 1929 bp, Artificial Sequence
  Description of Artificial Sequence: Synthetic coding sequence
atgccctgcggcgaggactggctgagccaccccctgggcatcgtgcagggcttcttcgcccagaacggcgtgaaccccgactgggagaagaaggtgatcgagtacttcaaggagaagctgaaggagaacaacgcccccaagtgggtgcccagcctgaacgaggtgcccctgcactacctgaagcccaacagcttcgtgaagttcagatgcatgatccaggacatgttcgaccccgagttctacatgggcgtgtacgagaccgtgaaccagaacaccaaggcccacgtgctgcacttcggcaagtacagagacgtggccgagtgcggcccccagcaggagctggacctgaacagccccagaaacaccaccctggagagacagaccttctactgcgtgcccgtgcccggcgagagcacctgggtgaaggaggcctacgtgaacgccaaccaggccagagtgagccccagcaccagctacacccccagcagacacaagagaagctacgaggacgacgacgacatggacctgcagcccaacaagcagaaggaccagcacgccggcgccagacaggccggcagcgtgggcggcctgcagtggtgcggcgagcccaagagactggagaccgaggccagcaccggccagcagctgaacagcctgaacctgagcagccccttcgacctgaacttccccctgcccggcgagaagggccccgcctgcctggtgaaggtgtacgaggactgggactgcttcaaggtgaacgacatcctggagctgtacggcatcctgagcgtggaccccgtgctgagcatcctgaacaacgacgagagagacgccagcgccctgctggaccccatggagtgcaccgacaccgccgaggagcagagagtgcacagcccccccgccagcctggtgcccagaatccacgtgatcctggcccagaagctgcagcacatcaaccccctgctgcccgcctgcctgaacaaggaggagagcaagacctgcaagttcgtgagcagcttcatgagcgagctgagccccgtgagagccgagctgctgggcttcctgacccacgccctgctgggcgacagcctggccgccgagtacctgatcctgcacctgatcagcaccgtgtacaccagaagagacgtgctgcccctgggcaagttcaccgtgaacctgagcggctgccccagaaacagcaccttcaccgagcacctgtacagaatcatccagcacctggtgcccgccagcttcagactgcagatgaccatcgagaacatgaaccacctgaagttcatcccccacaaggactacaccgccaacagactggtgagcggcctgctgcagctgcccagcaacaccagcctggtgatcgacgagaccctgctggagcagggccagctggacacccccggcgtgcacaacgtgaccgccctgagcaacctgatcacctggcagaaggtggactacgacttcagctaccaccagatggagttcccctgcaacatcaacgtgttcatcaccagcgagggcagaagcctgctgcccgccgactgccagatccacctgcagccccagctgatcccccccaacatggaggagtacatgaacagcctgctgagcgccgtgctgcccagcgtgctgaacaagttcagaatctacctgaccctgctgagattcctggagtacagcatcagcgacgagatcaccaaggccgtggaggacgacttcgtggagatgagaaagaacgacccccagagcatcaccgccgacgacctgcaccagctgctggtggtggccagatgcctgagcctgagcgccggccagaccaccctgagcagagagagatggctgagagccaagcagctggagagcctgagaagaaccagactgcagcagcagaagtgcgtgaacggcaacgagctgtag

SEQ ID NO: 89019 - DNA, 1923 bp, Artificial Sequence
  Description of Artificial Sequence: Synthetic coding sequence
atgccctgcggcgaggactggctgagccaccccctgggcatcgtgcagggcttcttcgcccagaacggcgtgaaccccgactgggagaagaaggtgatcgagtacttcaaggagaagctgaaggagaacaacgcccccaagtgggtgcccagcctgaacgaggtgcccctgcactacctgaagcccaacagcttcgtgaagttcagatgcatgatccaggacatgttcgaccccgagttctacatgggcgtgtacgagaccgtgaaccagaacaccaaggcccacgtgctgcacttcggcaagtacagagacgtggccgagtgcggcccccagcaggagctggacctgaacagccccagaaacaccaccctggagagacagaccttctactgcgtgcccgtgcccggcgagagcacctgggtgaaggaggcctacgtgaacgccaaccaggccagagtgagccccagcaccagctacacccccagcagacacaagagaagctacgaggacgacgacgacatggacctgcagcccaacaagcagaaggaccagcacgccggcgccagacaggccggcagcgtgggcggcctgcagtggtgcggcgagcccaagagactggagaccgaggccagcaccggccagcagctgaacagcctgaacctgagcagccccttcgacctgaacttccccctgcccggcgagaagggccccgcctgcctggtgaaggtgtacgaggactgggactgcttcaaggtgaacgacatcctggagctgtacggcatcctgagcgtggaccccgtgctgagcatcctgaacaacgacgagagagacgccagcgccctgctggaccccatggagtgcaccgacaccgccgaggagcagagagtgcacagcccccccgccagcctggtgcccagaatccacgtgatcctggcccagaagctgcagcacatcaaccccctgctgcccgcctgcctgaacaaggaggagagcaagaccttcgtgagcagcttcatgagcgagctgagccccgtgagagccgagctgctgggcttcctgacccacgccctgctgggcgacagcctggccgccgagtacctgatcctgcacctgatcagcaccgtgtacaccagaagagacgtgctgcccctgggcaagttcaccgtgaacctgagcggctgccccagaaacagcaccttcaccgagcacctgtacagaatcatccagcacctggtgcccgccagcttcagactgcagatgaccatcgagaacatgaaccacctgaagttcatcccccacaaggactacaccgccaacagactggtgagcggcctgctgcagctgcccagcaacaccagcctggtgatcgacgagaccctgctggagcagggccagctggacacccccggcgtgcacaacgtgaccgccctgagcaacctgatcacctggcagaaggtggactacgacttcagctaccaccagatggagttcccctgcaacatcaacgtgttcatcaccagcgagggcagaagcctgctgcccgccgactgccagatccacctgcagccccagctgatcccccccaacatggaggagtacatgaacagcctgctgagcgccgtgctgcccagcgtgctgaacaagttcagaatctacctgaccctgctgagattcctggagtacagcatcagcgacgagatcaccaaggccgtggaggacgacttcgtggagatgagaaagaacgacccccagagcatcaccgccgacgacctgcaccagctgctggtggtggccagatgcctgagcctgagcgccggccagaccaccctgagcagagagagatggctgagagccaagcagctggagagcctgagaagaaccagactgcagcagcagaagtgcgtgaacggcaacgagctgtag

SEQ ID NO: 89020 - DNA, 2628 bp, Artificial Sequence
  Description of Artificial Sequence: Synthetic coding sequence
atggacgaggaggaggacaacctgagcctgctgaccgccctgctggaggagaacgagagcgccctggactgcaacagcgaggagaacaacttcctgaccagagagaacggcgagcccgacgccttcgacgagctgttcgacgccgacggcgacggcgagagctacaccgaggaggccgacgacggcgagaccggcgagaccagagacgagaaggagaacctggccaccctgttcggcgacatggaggacctgaccgacgaggaggaggtgcccgccagccagagcaccgagaacagagtgctgcccgcccccgcccccagaagagagaagaccaacgaggagctgcaggaggagctgagaaacctgcaggagcagatgaaggccctgcaggagcagctgaaggtgaccaccatcaagcagaccgccagccccgccagactgcagaagagccccgtggagaagagccccagaccccccctgaaggagagaagagtgcagagaatccaggagagcacctgcttcagcgccgagctggacgtgcccgccctgcccagaaccaagagagtggccagaacccccaaggccagcccccccgaccccaagagcagcagcagcagaatgaccagcgcccccagccagcccctgcagaccatcagcagaaacaagcccagcggcatcaccagaggccagatcgtgggcacccccggcagcagcggcgagaccacccagcccatctgcgtggaggccttcagcggcctgagactgagaagacccagagtgagcagcaccgagatgaacaagaagatgaccggcagaaagctgatcagactgagccagatcaaggagaagatggccagagagaagctggaggagatcgactgggtgaccttcggcgtgatcctgaagaaggtgaccccccagagcgtgaacagcggcaagaccttcagcatctggaagctgaacgacctgagagacctgacccagtgcgtgagcctgttcctgttcggcgaggtgcacaaggccctgtggaagaccgagcagggcaccgtggtgggcatcctgaacgccaaccccatgaagcccaaggacggcagcgaggaggtgtgcctgagcatcgaccacccccagaaggtgctgatcatgggcgaggccctggacctgggcacctgcaaggccaagaagaagaacggcgagccctgcacccagaccgtgaacctgagagactgcgagtactgccagtaccacgtgcaggcccagtacaagaagctgagcgccaagagagccgacctgcagagcaccttcagcggcggcagaatccccaagaagttcgccagaagaggcaccagcctgaaggagagactgtgccaggacggcttctactacggcggcgtgagcagcgccagctacgccgccagcatcgccgccgccgtggcccccaagaagaagatccagaccaccctgagcaacctggtggtgaagggcaccaacctgatcatccaggagaccagacagaagctgggcatcccccagaagagcctgagctgcagcgaggagttcaaggagctgatggacctgcccacctgcggcgccagaaacctgaagcagcacctggccaaggccaccgccagcggcatcatgggcagccccaagcccgccatcaagagcatcagcgccagcgccctgctgaagcagcagaagcagagaatgctggagatgagaagaagaaagagcgaggagatccagaagagattcctgcagagcagcagcgaggtggagagccccgccgtgcccagcagcagcagacagccccccgcccagccccccagaaccggcagcgagttccccagactggagggcgcccccgccaccatgacccccaagctgggcagaggcgtgctggagggcgacgacgtgctgttctacgacgagagccccccccccagacccaagctgagcgccctggccgaggccaagaagctggccgccatcaccaagctgagagccaagggccaggtgctgaccaagaccaaccccaacagcatcaagaagaagcagaaggacccccaggacatcctggaggtgaaggagagagtggagaagaacaccatgttcagcagccaggccgaggacgagctggagcccgccagaaagaagagaagagagcagctggcctacctggagagcgaggagttccagaagatcctgaaggccaagagcaagcacaccggcatcctgaaggaggccgaggccgagatgcaggagagatacttcgagcccctggtgaagaaggagcagatggaggagaagatgagaaacatcagagaggtgaagtgcagagtggtgacctgcaagacctgcgcctacacccacttcaagctgctggagacctgcgtgagcgagcagcacgagtaccactggcacgacggcgtgaagagattcttcaagtgcccctgcggcaacagaagcatcagcctggacagactgcccaacaagcactgcagcaactgcggcctgtacaagtgggagagagacggcatgctgaaggagaagaccggccccaagatcggcggcgagaccctgctgcccagaggcgaggagcacgccaagttcctgaacagcctgaagtag

SEQ ID NO: 89021 - DNA, 2568 bp, Artificial Sequence
  Description of Artificial Sequence: Synthetic coding sequence
atggacgaggaggaggacaacctgagcctgctgaccgccctgctggaggagaacgagagcgccctggactgcaacagcgaggagaacaacttcctgaccagagagaacggcgagcccgacgccttcgacgagctgttcgacgccgacggcgacggcgagagctacaccgaggaggccgacgacggcgagaccggcgagaccagagacgagaaggagaacctggccaccctgttcggcgacatggaggacctgaccgacgaggaggaggtgcccgccagccagagcaccgagaacagagtgctgcccgcccccgcccccagaagagagaagaccaacgaggagctgcaggaggagctgagaaacctgcaggagcagatgaaggccctgcaggagcagctgaaggtgaccaccatcaagcagaccgccagccccgccagactgcagaagagccccgagaagagccccagaccccccctgaaggagagaagagtgcagagaatccaggagagcacctgcttcagcgccgagctggacgtgcccgccctgcccagaaccaagagagtggccagaacccccaaggccagcccccccgaccccaagagcagcagcagcagaatgaccagcgcccccagccagcccctgcagaccatcagcagaaacaagcccagcggcatcaccagaggccagatcgtgggcacccccggcagcagcggcgagaccacccagcccatctgcgtggaggccttcagcggcctgagactgagaagacccagagtgagcagcaccgagatgaacaagaagatgaccggcagaaagctgatcagactgagccagatcaaggagaagatggccagagagaagctggaggagatcgactgggtgaccttcggcgtgatcctgaagaaggtgaccccccagagcgtgaacagcggcaagaccttcagcatctggaagctgaacgacctgagagacctgacccagtgcgtgagcctgttcctgttcggcgaggtgcacaaggccctgtggaagaccgagcagggcaccgtggtgggcatcctgaacgccaaccccatgaagcccaaggacggcagcgaggaggtgtgcctgagcatcgaccacccccagaaggtgctgatcatgggcgaggccctggacctgggcacctgcaaggccaagaagaagaacggcgagccctgcacccagaccgtgaacctgagagactgcgagtactgccagtaccacgtgcaggcccagtacaagaagctgagcgccaagagagccgacctgcagagcaccttcagcggcggcagaatccccaagaagttcgccagaagaggcaccagcctgaaggagagactgtgccaggacggcttctactacggcggcgtgagcagcgccagctacgccgccagcatcgccgccgccgtggcccccaagaagaagatccagaccaccctgagcaacctggtggtgaagggcaccaacctgatcatccaggagaccagacagaagctgggcatcccccagaagagcctgagctgcagcgaggagttcaaggagctgatggacctgcccacctgcggcgccagaaacctgaagcagcacctggccaaggccaccgccagcggcatcatgggcagccccaagcccgccatcaagagcatcagcgccagcgccctgctgaagcagcagaagcagagaatgctggagatgagaagaagaaagagcgaggagatccagaagagattcctgcagagcagcagcgaggtggagagccccgccgtgcccagcagcagcagacagccccccgcccagccccccagaaccggcagcgagttccccagactggagggcgcccccgccaccatgacccccaagctgggcagaggcgtgctggagggcgacgacgtgctgttctacgacgagagccccccccccagacccaagctgagcgccctggccgaggccaagaagctggccgccatcaccaagctgagagccaagggccaggtgctgaccaagaccaaccccaacagcatcaagaagaagcagaaggacccccaggacatcctggaggtgaaggagagagtggagaagaacaccatgttcagcagccaggccgaggacgagctggagcccgccagaaagaagagaagagagcagctggcctacctggagagcgaggagttccagaagatcctgaaggccaagagcaagcacaccggcatcctgaaggaggccgaggccgagatgcaggagagatacttcgagcccctggtgaagaaggagcagatggaggagaagatgagaaacatcagagaggtgaagtgcagagtggtgacctgcaagacctgcgcctacacccacttcaagctgctggagacctgcgtgagcgagcagcacgagtaccactggcacgacggcgtgaagagattcttcaagtgcccctgcggcaacagaagcatcagcctggacagactgcccaacaagcactgcagcaactgcggcctgtacaagtgggagagagacggcatgctgaaggtgtgccacctgagaaccaacttctag

SEQ ID NO: 89022 - DNA, 2625 bp, Artificial Sequence
  Description of Artificial Sequence: Synthetic coding sequence
atggacgaggaggaggacaacctgagcctgctgaccgccctgctggaggagaacgagagcgccctggactgcaacagcgaggagaacaacttcctgaccagagagaacggcgagcccgacgccttcgacgagctgttcgacgccgacggcgacggcgagagctacaccgaggaggccgacgacggcgagaccggcgagaccagagacgagaaggagaacctggccaccctgttcggcgacatggaggacctgaccgacgaggaggaggtgcccgccagccagagcaccgagaacagagtgctgcccgcccccgcccccagaagagagaagaccaacgaggagctgcaggaggagctgagaaacctgcaggagcagatgaaggccctgcaggagcagctgaaggtgaccaccatcaagcagaccgccagccccgccagactgcagaagagccccgagaagagccccagaccccccctgaaggagagaagagtgcagagaatccaggagagcacctgcttcagcgccgagctggacgtgcccgccctgcccagaaccaagagagtggccagaacccccaaggccagcccccccgaccccaagagcagcagcagcagaatgaccagcgcccccagccagcccctgcagaccatcagcagaaacaagcccagcggcatcaccagaggccagatcgtgggcacccccggcagcagcggcgagaccacccagcccatctgcgtggaggccttcagcggcctgagactgagaagacccagagtgagcagcaccgagatgaacaagaagatgaccggcagaaagctgatcagactgagccagatcaaggagaagatggccagagagaagctggaggagatcgactgggtgaccttcggcgtgatcctgaagaaggtgaccccccagagcgtgaacagcggcaagaccttcagcatctggaagctgaacgacctgagagacctgacccagtgcgtgagcctgttcctgttcggcgaggtgcacaaggccctgtggaagaccgagcagggcaccgtggtgggcatcctgaacgccaaccccatgaagcccaaggacggcagcgaggaggtgtgcctgagcatcgaccacccccagaaggtgctgatcatgggcgaggccctggacctgggcacctgcaaggccaagaagaagaacggcgagccctgcacccagaccgtgaacctgagagactgcgagtactgccagtaccacgtgcaggcccagtacaagaagctgagcgccaagagagccgacctgcagagcaccttcagcggcggcagaatccccaagaagttcgccagaagaggcaccagcctgaaggagagactgtgccaggacggcttctactacggcggcgtgagcagcgccagctacgccgccagcatcgccgccgccgtggcccccaagaagaagatccagaccaccctgagcaacctggtggtgaagggcaccaacctgatcatccaggagaccagacagaagctgggcatcccccagaagagcctgagctgcagcgaggagttcaaggagctgatggacctgcccacctgcggcgccagaaacctgaagcagcacctggccaaggccaccgccagcggcatcatgggcagccccaagcccgccatcaagagcatcagcgccagcgccctgctgaagcagcagaagcagagaatgctggagatgagaagaagaaagagcgaggagatccagaagagattcctgcagagcagcagcgaggtggagagccccgccgtgcccagcagcagcagacagccccccgcccagccccccagaaccggcagcgagttccccagactggagggcgcccccgccaccatgacccccaagctgggcagaggcgtgctggagggcgacgacgtgctgttctacgacgagagccccccccccagacccaagctgagcgccctggccgaggccaagaagctggccgccatcaccaagctgagagccaagggccaggtgctgaccaagaccaaccccaacagcatcaagaagaagcagaaggacccccaggacatcctggaggtgaaggagagagtggagaagaacaccatgttcagcagccaggccgaggacgagctggagcccgccagaaagaagagaagagagcagctggcctacctggagagcgaggagttccagaagatcctgaaggccaagagcaagcacaccggcatcctgaaggaggccgaggccgagatgcaggagagatacttcgagcccctggtgaagaaggagcagatggaggagaagatgagaaacatcagagaggtgaagtgcagagtggtgacctgcaagacctgcgcctacacccacttcaagctgctggagacctgcgtgagcgagcagcacgagtaccactggcacgacggcgtgaagagattcttcaagtgcccctgcggcaacagaagcatcagcctggacagactgcccaacaagcactgcagcaactgcggcctgtacaagtgggagagagacggcatgctgaaggagaagaccggccccaagatcggcggcgagaccctgctgcccagaggcgaggagcacgccaagttcctgaacagcctgaagtag

SEQ ID NO: 89023 - DNA, 2628 bp, Artificial Sequence; identical to SEQ ID NO: 89020
  Description of Artificial Sequence: Synthetic coding sequence

SEQ ID NO: 89024 - DNA, 2466 bp, Artificial Sequence
  Description of Artificial Sequence: Synthetic coding sequence
atggacctggccgccgccgccgagcccggcgccggcagccagcacctggaggtgagagacgaggtggccgagaagtgccagaagctgttcctggacttcctggaggagttccagagcagcgacggcgagatcaagtacctgcagctggccgaggagctgatcagacccgagagaaacaccctggtggtgagcttcgtggacctggagcagttcaaccagcagctgagcaccaccatccaggaggagttctacagagtgtacccctacctgtgcagagccctgaagaccttcgtgaaggacagaaaggagatccccctggccaaggacttctacgtggccttccaggacctgcccaccagacacaagatcagagagctgaccagcagcagaatcggcctgctgaccagaatcagcggccaggtggtgagaacccaccccgtgcaccccgagctggtgagcggcaccttcctgtgcctggactgccagaccgtgatcagagacgtggagcagcagttcaagtacacccagcccaacatctgcagaaaccccgtgtgcgccaacagaagaagattcctgctggacaccaacaagagcagattcgtggacttccagaaggtgagaatccaggagacccaggccgagctgcccagaggcagcatccccagaagcctggaggtgatcctgagagccgaggccgtggagagcgcccaggccggcgacaagtgcgacttcaccggcaccctgatcgtggtgcccgacgtgagcaagctgagcacccccggcgccagagccgagaccaacagcagagtgagcggcgtggacggctacgagaccgagggcatcagaggcctgagagccctgggcgtgagagacctgagctacagactggtgttcctggcctgctgcgtggcccccaccaaccccagattcggcggcaaggagctgagagacgaggagcagaccgccgagagcatcaagaaccagatgaccgtgaaggagtgggagaaggtgttcgagatgagccaggacaagaacctgtaccacaacctgtgcaccagcctgttccccaccatccacggcaacgacgaggtgaagagaggcgtgctgctgatgctgttcggcggcgtgcccaagaccaccggcgagggcaccagcctgagaggcgacatcaacgtgtgcatcgtgggcgaccccagcaccgccaagagccagttcctgaagcacgtggaggagttcagccccagagccgtgtacaccagcggcaaggccagcagcgccgccggcctgaccgccgccgtggtgagagacgaggagagccacgagttcgtgatcgaggccggcgccctgatgctggccgacaacggcgtgtgctgcatcgacgagttcgacaagatggacgtgagagaccaggtggccatccacgaggccatggagcagcagaccatcagcatcaccaaggccggcgtgaaggccaccctgaacgccagaaccagcatcctggccgccgccaaccccatcagcggccactacgacagaagcaagagcctgaagcagaacatcaacctgagcgcccccatcatgagcagattcgacctgttcttcatcctggtggacgagtgcaacgaggtgaccgactacgccatcgccagaagaatcgtggacctgcacagcagaatcgaggagagcatcgacagagtgtacagcctggacgacatcagaagatacctgctgttcgccagacagttcaagcccaagatcagcaaggagagcgaggacttcatcgtggagcagtacaagcacctgagacagagagacggcagcggcgtgaccaagagcagctggagaatcaccgtgagacagctggagagcatgatcagactgagcgaggccatggccagaatgcactgctgcgacgaggtgcagcccaagcacgtgaaggaggccttcagactgctgaacaagagcatcatcagagtggagacccccgacgtgaacctggaccaggaggaggagatccagatggaggtggacgagggcgccggcggcatcaacggccacgccgacagccccgcccccgtgaacggcatcaacggctacaacgaggacatcaaccaggagagcgcccccaaggccagcctgagactgggcttcagcgagtactgcagaatcagcaacctgatcgtgctgcacctgagaaaggtggaggaggaggaggacgagagcgccctgaagagaagcgagctggtgaactggtacctgaaggagatcgagagcgagatcgacagcgaggaggagctgatcaacaagaagagaatcatcgagaaggtgatccacagactgacccactacgaccacgtgctgatcgagctgacccaggccggcctgaagggcagcaccgagggcagcgagagctacgaggaggacccctacctggtggtgaaccccaactacctgctggaggactag

SEQ ID NO: 89025 - DNA, 2160 bp, Artificial Sequence
  Description of Artificial Sequence: Synthetic coding sequence
atggccctgaaggactacgccctggagaaggagaaggtgaagaagttcctgcaggagttctaccaggacgacgagctgggcaagaagcagttcaagtacggcaaccagctggtgagactggcccacagagagcaggtggccctgtacgtggacctggacgacgtggccgaggacgaccccgagctggtggacagcatctgcgagaacgccagaagatacgccaagctgttcgccgacgccgtgcaggagctgctgccccagtacaaggagagagaggtggtgaacaaggacgtgctggacgtgtacatcgagcacagactgatgatggagcagagaagcagagaccccggcatggtgagaagcccccagaaccagtaccccgccgagctgatgagaagattcgagctgtacttccagggccccagcagcaacaagcccagagtgatcagagaggtgagagccgacagcgtgggcaagctggtgaccgtgagaggcatcgtgaccagagtgagcgaggtgaagcccaagatggtggtggccacctacacctgcgaccagtgcggcgccgagacctaccagcccatccagagccccaccttcatgcccctgatcatgtgccccagccaggagtgccagaccaacagaagcggcggcagactgtacctgcagaccagaggcagcagattcatcaagttccaggagatgaagatgcaggagcacagcgaccaggtgcccgtgggcaacatccccagaagcatcaccgtgctggtggagggcgagaacaccagaatcgcccagcccggcgaccacgtgagcgtgaccggcatcttcctgcccatcctgagaaccggcttcagacaggtggtgcagggcctgctgagcgagacctacctggaggcccacagaatcgtgaagatgaacaagagcgaggacgacgagagcggcgccggcgagctgaccagagaggagctgagacagatcgccgaggaggacttctacgagaagctggccgccagcatcgcccccgagatctacggccacgaggacgtgaagaaggccctgctgctgctgctggtgggcggcgtggaccagagccccagaggcatgaagatcagaggcaacatcaacatctgcctgatgggcgaccccggcgtggccaagagccagctgctgagctacatcgacagactggcccccagaagccagtacaccaccggcagaggcagcagcggcgtgggcctgaccgccgccgtgctgagagacagcgtgagcggcgagctgaccctggagggcggcgccctggtgctggccgaccagggcgtgtgctgcatcgacgagttcgacaagatggccgaggccgacagaaccgccatccacgaggtgatggagcagcagaccatcagcatcgccaaggccggcatcctgaccaccctgaacgccagatgcagcatcctggccgccgccaaccccgcctacggcagatacaaccccagaagaagcctggagcagaacatccagctgcccgccgccctgctgagcagattcgacctgctgtggctgatccaggacagacccgacagagacaacgacctgagactggcccagcacatcacctacgtgcaccagcacagcagacagccccccagccagttcgagcccctggacatgaagctgatgagaagatacatcgccatgtgcagagagaagcagcccatggtgcccgagagcctggccgactacatcaccgccgcctacgtggagatgagaagagaggcctgggccagcaaggacgccacctacaccagcgccagaaccctgctggccatcctgagactgagcaccgccctggccagactgagaatggtggacgtggtggagaaggaggacgtgaacgaggccatcagactgatggagatgagcaaggacagcctgctgggcgacaagggccagaccgccagaacccagagacccgccgacgtgatcttcgccaccgtgagagagctggtgagcggcggcagaagcgtgagattcagcgaggccgagcagagatgcgtgagcagaggcttcacccccgcccagttccaggccgccctggacgagtacgaggagctgaacgtgtggcaggtgaacgccagcagaaccagaatcaccttcgtgtag

SEQ ID NO: 89026 - DNA, 1170 bp, Artificial Sequence
  Description of Artificial Sequence: Synthetic coding sequence
atggccctgaaggactacgccctggagaaggagaaggtgaagaagttcctgcaggagttctaccaggacgacgagctgggcaagaagcagttcaagtacggcaaccagctggtgagactggcccacagagagcaggtggccctgtacgtggacctggacgacgtggccgaggacgaccccgagctggtggacagcatctgcgagaacgccagaagatacgccaagctgttcgccgacgccgtgcaggagctgctgccccagtacaaggagagagaggtggtgaacaaggacgtgctggacgtgtacatcgagcacagactgatgatggagcagagaagcagagaccccggcatggtgagaagcccccagaaccagtaccccgccgagctgatgagaagattcgagctgtacttccagggccccagcagcaacaagcccagagtgatcagagaggtgagagccgacagcgtgggcaagctggtgaccgtgagaggcatcgtgaccagagtgagcgaggtgaagcccaagatggtggtggccacctacacctgcgaccagtgcggcgccgagacctaccagcccatccagagccccaccttcatgcccctgatcatgtgccccagccaggagtgccagaccaacagaagcggcggcagactgtacctgcagaccagaggcagcagattcatcaagttccaggagatgaagatgcaggagcacagcgaccaggtgcccgtgggcaacatccccagaagcatcaccgtgctggtggagggcgagaacaccagaatcgcccagcccggcgaccacgtgagcgtgaccggcatcttcctgcccatcctgagaaccggcttcagacaggtggtgcagggcctgctgagcgagacctacctggaggcccacagaatcgtgaagatgaacaagagcgaggacgacgagagcggcgccggcgagctgaccagagaggagctgagacagatcgccgacgtgatcttcgccaccgtgagagagctggtgagcggcggcagaagcgtgagattcagcgaggccgagcagagatgcgtgagcagaggcttcacccccgcccagttccaggccgccctggacgagtacgaggagctgaacgtgtggcaggtgaacgccagcagaaccagaatcaccttcgtgtag

SEQ ID NO: 89027 - DNA, 1632 bp, Artificial Sequence
  Description of Artificial Sequence: Synthetic coding sequence
atggtggtggccacctacacctgcgaccagtgcggcgccgagacctaccagcccatccagagccccaccttcatgcccctgatcatgtgccccagccaggagtgccagaccaacagaagcggcggcagactgtacctgcagaccagaggcagcagattcatcaagttccaggagatgaagatgcaggagcacagcgaccaggtgcccgtgggcaacatccccagaagcatcaccgtgctggtggagggcgagaacaccagaatcgcccagcccggcgaccacgtgagcgtgaccggcatcttcctgcccatcctgagaaccggcttcagacaggtggtgcagggcctgctgagcgagacctacctggaggcccacagaatcgtgaagatgaacaagagcgaggacgacgagagcggcgccggcgagctgaccagagaggagctgagacagatcgccgaggaggacttctacgagaagctggccgccagcatcgcccccgagatctacggccacgaggacgtgaagaaggccctgctgctgctgctggtgggcggcgtggaccagagccccagaggcatgaagatcagaggcaacatcaacatctgcctgatgggcgaccccggcgtggccaagagccagctgctgagctacatcgacagactggcccccagaagccagtacaccaccggcagaggcagcagcggcgtgggcctgaccgccgccgtgctgagagacagcgtgagcggcgagctgaccctggagggcggcgccctggtgctggccgaccagggcgtgtgctgcatcgacgagttcgacaagatggccgaggccgacagaaccgccatccacgaggtgatggagcagcagaccatcagcatcgccaaggccggcatcctgaccaccctgaacgccagatgcagcatcctggccgccgccaaccccgcctacggcagatacaaccccagaagaagcctggagcagaacatccagctgcccgccgccctgctgagcagattcgacctgctgtggctgatccaggacagacccgacagagacaacgacctgagactggcccagcacatcacctacgtgcaccagcacagcagacagccccccagccagttcgagcccctggacatgaagctgatgagaagatacatcgccatgtgcagagagaagcagcccatggtgcccgagagcctggccgactacatcaccgccgcctacgtggagatgagaagagaggcctgggccagcaaggacgccacctacaccagcgccagaaccctgctggccatcctgagactgagcaccgccctggccagactgagaatggtggacgtggtggagaaggaggacgtgaacgaggccatcagactgatggagatgagcaaggacagcctgctgggcgacaagggccagaccgccagaacccagagacccgccgacgtgatcttcgccaccgtgagagagctggtgagcggcggcagaagcgtgagattcagcgaggccgagcagagatgcgtgagcagaggcttcacccccgcccagttccaggccgccctggacgagtacgaggagctgaacgtgtggcaggtgaacgccagcagaaccagaatcaccttcgtgtag

SEQ ID NO: 89028 - DNA, 1839 bp, Artificial Sequence
  Description of Artificial Sequence: Synthetic coding sequence
atgatggagcagagaagcagagaccccggcatggtgagaagcccccagaaccagtaccccgccgagctgatgagaagattcgagctgtacttccagggccccagcagcaacaagcccagagtgatcagagaggtgagagccgacagcgtgggcaagctggtgaccgtgagaggcatcgtgaccagagtgagcgaggtgaagcccaagatggtggtggccacctacacctgcgaccagtgcggcgccgagacctaccagcccatccagagccccaccttcatgcccctgatcatgtgccccagccaggagtgccagaccaacagaagcggcggcagactgtacctgcagaccagaggcagcagattcatcaagttccaggagatgaagatgcaggagcacagcgaccaggtgcccgtgggcaacatccccagaagcatcaccgtgctggtggagggcgagaacaccagaatcgcccagcccggcgaccacgtgagcgtgaccggcatcttcctgcccatcctgagaaccggcttcagacaggtggtgcagggcctgctgagcgagacctacctggaggcccacagaatcgtgaagatgaacaagagcgaggacgacgagagcggcgccggcgagctgaccagagaggagctgagacagatcgccgaggaggacttctacgagaagctggccgccagcatcgcccccgagatctacggccacgaggacgtgaagaaggccctgctgctgctgctggtgggcggcgtggaccagagccccagaggcatgaagatcagaggcaacatcaacatctgcctgatgggcgaccccggcgtggccaagagccagctgctgagctacatcgacagactggcccccagaagccagtacaccaccggcagaggcagcagcggcgtgggcctgaccgccgccgtgctgagagacagcgtgagcggcgagctgaccctggagggcggcgccctggtgctggccgaccagggcgtgtgctgcatcgacgagttcgacaagatggccgaggccgacagaaccgccatccacgaggtgatggagcagcagaccatcagcatcgccaaggccggcatcctgaccaccctgaacgccagatgcagcatcctggccgccgccaaccccgcctacggcagatacaaccccagaagaagcctggagcagaacatccagctgcccgccgccctgctgagcagattcgacctgctgtggctgatccaggacagacccgacagagacaacgacctgagactggcccagcacatcacctacgtgcaccagcacagcagacagccccccagccagttcgagcccctggacatgaagctgatgagaagatacatcgccatgtgcagagagaagcagcccatggtgcccgagagcctggccgactacatcaccgccgcctacgtggagatgagaagagaggcctgggccagcaaggacgccacctacaccagcgccagaaccctgctggccatcctgagactgagcaccgccctggccagactgagaatggtggacgtggtggagaaggaggacgtgaacgaggccatcagactgatggagatgagcaaggacagcctgctgggcgacaagggccagaccgccagaacccagagacccgccgacgtgatcttcgccaccgtgagagagctggtgagcggcggcagaagcgtgagattcagcgaggccgagcagagatgcgtgagcagaggcttcacccccgcccagttccaggccgccctggacgagtacgaggagctgaacgtgtggcaggtgaacgccagcagaaccagaatcaccttcgtgtag

SEQ ID NO: 89029 - DNA, 1971 bp, Artificial Sequence
  Description of Artificial Sequence: Synthetic coding sequence
atgacccccagctggtggacccagttcgtgagaatgcccggcgccaccagaagcagcctgctgatgccctactacaaggagagagaggtggtgaacaaggacgtgctggacgtgtacatcgagcacagactgatgatggagcagagaagcagagaccccggcatggtgagaagcccccagaaccagtaccccgccgagctgatgagaagattcgagctgtacttccagggccccagcagcaacaagcccagagtgatcagagaggtgagagccgacagcgtgggcaagctggtgaccgtgagaggcatcgtgaccagagtgagcgaggtgaagcccaagatggtggtggccacctacacctgcgaccagtgcggcgccgagacctaccagcccatccagagccccaccttcatgcccctgatcatgtgccccagccaggagtgccagaccaacagaagcggcggcagactgtacctgcagaccagaggcagcagattcatcaagttccaggagatgaagatgcaggagcacagcgaccaggtgcccgtgggcaacatccccagaagcatcaccgtgctggtggagggcgagaacaccagaatcgcccagcccggcgaccacgtgagcgtgaccggcatcttcctgcccatcctgagaaccggcttcagacaggtggtgcagggcctgctgagcgagacctacctggaggcccacagaatcgtgaagatgaacaagagcgaggacgacgagagcggcgccggcgagctgaccagagaggagctgagacagatcgccgaggaggacttctacgagaagctggccgccagcatcgcccccgagatctacggccacgaggacgtgaagaaggccctgctgctgctgctggtgggcggcgtggaccagagccccagaggcatgaagatcagaggcaacatcaacatctgcctgatgggcgaccccggcgtggccaagagccagctgctgagctacatcgacagactggcccccagaagccagtacaccaccggcagaggcagcagcggcgtgggcctgaccgccgccgtgctgagagacagcgtgagcggcgagctgaccctggagggcggcgccctggtgctggccgaccagggcgtgtgctgcatcgacgagttcgacaagatggccgaggccgacagaaccgccatccacgaggtgatggagcagcagaccatcagcatcgccaaggccggcatcctgaccaccctgaacgccagatgcagcatcctggccgccgccaaccccgcctacggcagatacaaccccagaagaagcctggagcagaacatccagctgcccgccgccctgctgagcagattcgacctgctgtggctgatccaggacagacccgacagagacaacgacctgagactggcccagcacatcacctacgtgcaccagcacagcagacagccccccagccagttcgagcccctggacatgaagctgatgagaagatacatcgccatgtgcagagagaagcagcccatggtgcccgagagcctggccgactacatcaccgccgcctacgtggagatgagaagagaggcctgggccagcaaggacgccacctacaccagcgccagaaccctgctggccatcctgagactgagcaccgccctggccagactgagaatggtggacgtggtggagaaggaggacgtgaacgaggccatcagactgatggagatgagcaaggacagcctgctgggcgacaagggccagaccgccagaacccagagacccgccgacgtgatcttcgccaccgtgagagagctggtgagcggcggcagaagcgtgagattcagcgaggccgagcagagatgcgtgagcagaggcttcacccccgcccagttccaggccgccctggacgagtacgaggagctgaacgtgtggcaggtgaacgccagcagaaccagaatcaccttcgtgtag

SEQ ID NO: 89030 - DNA, 2475 bp, Artificial Sequence
  Description of Artificial Sequence: Synthetic coding sequence
atgaacggcgagtacagaggcagaggcttcggcagaggcagattccagagctggaagagaggcagaggcggcggcaacttcagcggcaagtggagagagagagagcacagacccgacctgagcaagaccaccggcaagagaaccagcgagcagaccccccagttcctgctgagcaccaagaccccccagagcatgcagagcaccctggacagattcatcccctacaagggctggaagctgtacttcagcgaggtgtacagcgacagcagccccctgatcgagaagatccaggccttcgagaagttcttcaccagacacatcgacctgtacgacaaggacgagatcgagagaaagggcagcatcctggtggacttcaaggagctgaccgagggcggcgaggtgaccaacctgatccccgacatcgccaccgagctgagagacgcccccgagaagaccctggcctgcatgggcctggccatccaccaggtgctgaccaaggacctggagagacacgccgccgagctgcaggcccaggagggcctgagcaacgacggcgagaccatggtgaacgtgccccacatccacgccagagtgtacaactacgagcccctgacccagctgaagaacgtgagagccaactactacggcaagtacatcgccctgagaggcaccgtggtgagagtgagcaacatcaagcccctgtgcaccaagatggccttcctgtgcgccgcctgcggcgagatccagagcttccccctgcccgacggcaagtacagcctgcccaccaagtgccccgtgcccgtgtgcagaggcagaagcttcaccgccctgagaagcagccccctgaccgtgaccatggactggcagagcatcaagatccaggagctgatgagcgacgaccagagagaggccggcagaatccccagaaccatcgagtgcgagctggtgcacgacctggtggacagctgcgtgcccggcgacaccgtgaccatcaccggcatcgtgaaggtgagcaacgccgaggaggccaacagcatcagcaacagcaagggccagaagaccaagagcagcgaggacggctgcaagcacggcatgctgatggagttcagcctgaaggacctgtacgccatccaggagatccaggccgaggagaacctgttcaagctgatcgtgaacagcctgtgccccgtgatcttcggccacgagctggtgaaggccggcctggccctggccctgttcggcggcagccagaagtacgccgacgacaagaacagaatccccatcagaggcgacccccacatcctggtggtgggcgaccccggcctgggcaagagccagatgctgcaggccgcctgcaacgtggcccccagaggcgtgtacgtgtgcggcaacaccaccaccaccagcggcctgaccgtgaccctgagcaaggacagcagcagcggcgacttcgccctggaggccggcgccctggtgctgggcgaccagggcatctgcggcatcgacgagttcgacaagatgggcaaccagcaccaggccctgctggaggccatggagcagcagagcatcagcctggccaaggccggcgtggtgtgcagcctgcccgccagaaccagcatcatcgccgccgccaaccccgtgggcggccactacaacaaggccaagaccgtgagcgagaacctgaagatgggcagcgccctgctgagcagattcgacctggtgttcatcctgctggacacccccaacgagcaccacgaccacctgctgagcgagcacgtgatcgccatcagagccggcaagcagagaaccatcagcagcgccaccgtggccagaatgaacagccaggacagcaacaccagcgtgctggaggtggtgagcgagaagcccctgagcgagagactgaaggtggtgcccggcgagaccatcgaccccatcccccaccagctgctgagaaagtacatcggctacgccagacagtacgtgtaccccagactgagcaccgaggccgccagagtgctgcaggacttctacctggagctgagaaagcagagccagagactgaacagcagccccatcaccaccagacagctggagagcctgatcagactgaccgaggccagagccagactggagctgagagaggaggccaccaaggaggacgccgaggacatcgtggagatcatgaagtacagcatgctgggcacctacagcgacgagttcggcaacctggacttcgagagaagccagcacggcagcggcatgagcaacagaagcaccgccaagagattcatcagcgccctgaacaacgtggccgagagaacctacaacaacatcttccagttccaccagctgagacagatcgccaaggagctgaacatccaggtggccgacttcgagaacttcatcggcagcctgaacgaccagggctacctgctgaagaagggccccaaggtgtaccagctgcagaccatgtag

SEQ ID NO: 89031 - DNA, 2382 bp, Artificial Sequence
  Description of Artificial Sequence: Synthetic coding sequence
atgaacggcgagtacagaggcagaggcttcggcagaggcagattccagagctggaagagaggcagaggcggcggcaacttcagcggcaagtggagagagagagagcacagacccgacctgagcaagaccaccggcaagagaaccagcgagcagaccccccagttcctgctgagcaccaagaccccccagagcatgcagagcaccctggacagattcatcccctacaagggctggaagctgtacttcagcgaggtgtacagcgacagcagccccctgatcgagaagatccaggccttcgagaagttcttcaccagacacatcgacctgtacgacaaggacgagatcgagagaaagggcagcatcctggtggacttcaaggagctgaccgagggcggcgaggtgaccaacctgatccccgacatcgccaccgagctgagagacgcccccgagaagaccctggcctgcatgggcctggccatccaccaggtgctgaccaaggacctggagagacacgccgccgagctgcaggcccaggagggcctgagcaacgacggcgagaccatggtgaacgtgccccacatccacgccagagtgtacaactacgagcccctgacccagctgaagaacgtgagagccaactactacggcaagtacatcgccctgagaggcaccgtggtgagagtgagcaacatcaagcccctgtgcaccaagatggccttcctgtgcgccgcctgcggcgagatccagagcttccccctgcccgacggcaagtacagcctgcccaccaagtgccccgtgcccgtgtgcagaggcagaagcttcaccgccctgagaagcagccccctgaccgtgaccatggactggcagagcatcaagatccaggagctgatgagcgacgaccagagagaggccggcagaatccccagaaccatcgagtgcgagctggtgcacgacctggtggacagctgcgtgcccggcgacaccgtgaccatcaccggcatcgtgaaggtgagcaacgccgaggagggcagcagaaacaagaacgacaagtgcatgttcctgctgtacatcgaggccaacagcatcagcaacagcaagggccagaagaccaagagcagcgaggacggctgcaagcacggcatgctgatggagttcagcctgaaggacctgtacgccatccaggagatccaggccgaggagaacctgttcaagctgatcgtgaacagcctgtgccccgtgatcttcggccacgaggccgcctgcaacgtggcccccagaggcgtgtacgtgtgcggcaacaccaccaccaccagcggcctgaccgtgaccctgagcaaggacagcagcagcggcgacttcgccctggaggccggcgccctggtgctgggcgaccagggcatctgcggcatcgacgagttcgacaagatgggcaaccagcaccaggccctgctggaggccatggagcagcagagcatcagcctggccaaggccggcgtggtgtgcagcctgcccgccagaaccagcatcatcgccgccgccaaccccgtgggcggccactacaacaaggccaagaccgtgagcgagaacctgaagatgggcagcgccctgctgagcagattcgacctggtgttcatcctgctggacacccccaacgagcaccacgaccacctgctgagcgagcacgtgatcgccatcagagccggcaagcagagaaccatcagcagcgccaccgtggccagaatgaacagccaggacagcaacaccagcgtgctggaggtggtgagcgagaagcccctgagcgagagactgaaggtggtgcccggcgagaccatcgaccccatcccccaccagctgctgagaaagtacatcggctacgccagacagtacgtgtaccccagactgagcaccgaggccgccagagtgctgcaggacttctacctggagctgagaaagcagagccagagactgaacagcagccccatcaccaccagacagctggagagcctgatcagactgaccgaggccagagccagactggagctgagagaggaggccaccaaggaggacgccgaggacatcgtggagatcatgaagtacagcatgctgggcacctacagcgacgagttcggcaacctggacttcgagagaagccagcacggcagcggcatgagcaacagaagcaccgccaagagattcatcagcgccctgaacaacgtggccgagagaacctacaacaacatcttccagttccaccagctgagacagatcgccaaggagctgaacatccaggtggccgacttcgagaacttcatcggcagcctgaacgaccagggctacctgctgaagaagggccccaaggtgtaccagctgcagaccatgtag

SEQ ID NO: 89032 - DNA, 2643 bp, Artificial Sequence
  Description of Artificial Sequence: Synthetic coding sequence
atgaacggcgagtacagaggcagaggcttcggcagaggcagattccagagctggaagagaggcagaggcggcggcaacttcagcggcaagtggagagagagagagcacagacccgacctgagcaagaccaccggcaagagaaccagcgagcagaccccccagttcctgctgagcaccaagaccccccagagcatgcagagcaccctggacagattcatcccctacaagggctggaagctgtacttcagcgaggtgtacagcgacagcagccccctgatcgagaagatccaggccttcgagaagttcttcaccagacacatcgacctgtacgacaaggacgagatcgagagaaagggcagcatcctggtggacttcaaggagctgaccgagggcggcgaggtgaccaacctgatccccgacatcgccaccgagctgagagacgcccccgagaagaccctggcctgcatgggcctggccatccaccaggtgctgaccaaggacctggagagacacgccgccgagctgcaggcccaggagggcctgagcaacgacggcgagaccatggtgaacgtgccccacatccacgccagagtgtacaactacgagcccctgacccagctgaagaacgtgagagccaactactacggcaagtacatcgccctgagaggcaccgtggtgagagtgagcaacatcaagcccctgtgcaccaagatggccttcctgtgcgccgcctgcggcgagatccagagcttccccctgcccgacggcaagtacagcctgcccaccaagtgccccgtgcccgtgtgcagaggcagaagcttcaccgccctgagaagcagccccctgaccgtgaccatggactggcagagcatcaagatccaggagctgatgagcgacgaccagagagaggccggcagaatccccagaaccatcgagtgcgagctggtgcacgacctggtggacagctgcgtgcccggcgacaccgtgaccatcaccggcatcgtgaaggtgagcaacgccgaggagggcagcagaaacaagaacgacaagtgcatgttcctgctgtacatcgaggccaacagcatcagcaacagcaagggccagaagaccaagagcagcgaggacggctgcaagcacggcatgctgatggagttcagcctgaaggacctgtacgccatccaggagatccaggccgaggagaacctgttcaagctgatcgtgaagtggagcctggccctgagccccagactggagtacagcggcgccatcagcgcccactgcaacctgcacctgcccagcagcaacagcagccccaccagcgcctgcagagtggccggcaccaccggcatgagacaccagacccagctgctgctgctggtgaaggccggcctggccctggccctgttcggcggcagccagaagtacgccgacgacaagaacagaatccccatcagaggcgacccccacatcctggtggtgggcgaccccggcctgggcaagagccagatgctgcaggccgcctgcaacgtggcccccagaggcgtgtacgtgtgcggcaacaccaccaccaccagcggcctgaccgtgaccctgagcaaggacagcagcagcggcgacttcgccctggaggccggcgccctggtgctgggcgaccagggcatctgcggcatcgacgagttcgacaagatgggcaaccagcaccaggccctgctggaggccatggagcagcagagcatcagcctggccaaggccggcgtggtgtgcagcctgcccgccagaaccagcatcatcgccgccgccaaccccgtgggcggccactacaacaaggccaagaccgtgagcgagaacctgaagatgggcagcgccctgctgagcagattcgacctggtgttcatcctgctggacacccccaacgagcaccacgaccacctgctgagcgagcacgtgatcgccatcagagccggcaagcagagaaccatcagcagcgccaccgtggccagaatgaacagccaggacagcaacaccagcgtgctggaggtggtgagcgagaagcccctgagcgagagactgaaggtggtgcccggcgagaccatcgaccccatcccccaccagctgctgagaaagtacatcggctacgccagacagtacgtgtaccccagactgagcaccgaggccgccagagtgctgcaggacttctacctggagctgagaaagcagagccagagactgaacagcagccccatcaccaccagacagctggagagcctgatcagactgaccgaggccagagccagactggagctgagagaggaggccaccaaggaggacgccgaggacatcgtggagatcatgaagtacagcatgctgggcacctacagcgacgagttcggcaacctggacttcgagagaagccagcacggcagcggcatgagcaacagaagcaccgccaagagattcatcagcgccctgaacaacgtggccgagagaacctacaacaacatcttccagttccaccagctgagacagatcgccaaggagctgaacatccaggtggccgacttcgagaacttcatcggcagcctgaacgaccagggctacctgctgaagaagggccccaaggtgtaccagctgcagaccatgtag

SEQ ID NO: 89033 - DNA, 2523 bp, Artificial Sequence
  Description of Artificial Sequence: Synthetic coding sequence
atgaacggcgagtacagaggcagaggcttcggcagaggcagattccagagctggaagagaggcagaggcggcggcaacttcagcggcaagtggagagagagagagcacagacccgacctgagcaagaccaccggcaagagaaccagcgagcagaccccccagttcctgctgagcaccaagaccccccagagcatgcagagcaccctggacagattcatcccctacaagggctggaagctgtacttcagcgaggtgtacagcgacagcagccccctgatcgagaagatccaggccttcgagaagttcttcaccagacacatcgacctgtacgacaaggacgagatcgagagaaagggcagcatcctggtggacttcaaggagctgaccgagggcggcgaggtgaccaacctgatccccgacatcgccaccgagctgagagacgcccccgagaagaccctggcctgcatgggcctggccatccaccaggtgctgaccaaggacctggagagacacgccgccgagctgcaggcccaggagggcctgagcaacgacggcgagaccatggtgaacgtgccccacatccacgccagagtgtacaactacgagcccctgacccagctgaagaacgtgagagccaactactacggcaagtacatcgccctgagaggcaccgtggtgagagtgagcaacatcaagcccctgtgcaccaagatggccttcctgtgcgccgcctgcggcgagatccagagcttccccctgcccgacggcaagtacagcctgcccaccaagtgccccgtgcccgtgtgcagaggcagaagcttcaccgccctgagaagcagccccctgaccgtgaccatggactggcagagcatcaagatccaggagctgatgagcgacgaccagagagaggccggcagaatccccagaaccatcgagtgcgagctggtgcacgacctggtggacagctgcgtgcccggcgacaccgtgaccatcaccggcatcgtgaaggtgagcaacgccgaggagggcagcagaaacaagaacgacaagtgcatgttcctgctgtacatcgaggccaacagcatcagcaacagcaagggccagaagaccaagagcagcgaggacggctgcaagcacggcatgctgatggagttcagcctgaaggacctgtacgccatccaggagatccaggccgaggagaacctgttcaagctgatcgtgaacagcctgtgccccgtgatcttcggccacgagctggtgaaggccggcctggccctggccctgttcggcggcagccagaagtacgccgacgacaagaacagaatccccatcagaggcgacccccacatcctggtggtgggcgaccccggcctgggcaagagccagatgctgcaggccgcctgcaacgtggcccccagaggcgtgtacgtgtgcggcaacaccaccaccaccagcggcctgaccgtgaccctgagcaaggacagcagcagcggcgacttcgccctggaggccggcgccctggtgctgggcgaccagggcatctgcggcatcgacgagttcgacaagatgggcaaccagcaccaggccctgctggaggccatggagcagcagagcatcagcctggccaaggccggcgtggtgtgcagcctgcccgccagaaccagcatcatcgccgccgccaaccccgtgggcggccactacaacaaggccaagaccgtgagcgagaacctgaagatgggcagcgccctgctgagcagattcgacctggtgttcatcctgctggacacccccaacgagcaccacgaccacctgctgagcgagcacgtgatcgccatcagagccggcaagcagagaaccatcagcagcgccaccgtggccagaatgaacagccaggacagcaacaccagcgtgctggaggtggtgagcgagaagcccctgagcgagagactgaaggtggtgcccggcgagaccatcgaccccatcccccaccagctgctgagaaagtacatcggctacgccagacagtacgtgtaccccagactgagcaccgaggccgccagagtgctgcaggacttctacctggagctgagaaagcagagccagagactgaacagcagccccatcaccaccagacagctggagagcctgatcagactgaccgaggccagagccagactggagctgagagaggaggccaccaaggaggacgccgaggacatcgtggagatcatgaagtacagcatgctgggcacctacagcgacgagttcggcaacctggacttcgagagaagccagcacggcagcggcatgagcaacagaagcaccgccaagagattcatcagcgccctgaacaacgtggccgagagaacctacaacaacatcttccagttccaccagctgagacagatcgccaaggagctgaacatccaggtggccgacttcgagaacttcatcggcagcctgaacgaccagggctacctgctgaagaagggccccaaggtgtaccagctgcagaccatgtag

SEQ ID NO: 89034 - DNA, 612 bp, Artificial Sequence
  Description of Artificial Sequence: Synthetic coding sequence
atgaacggcgagtacagaggcagaggcttcggcagaggcagattccagagctggaagagaggcagaggcggcggcaacttcagcggcaagtggagagagagagagcacagacccgacctgagcaagaccaccggcaagagaaccagcgagcagaccccccagttcctgctgagcaccaagaccccccagagcatgcagagcaccctggacagattcatcccctacaagggctggaagctgtacttcagcgaggtgtacagcgacagcagccccctgatcgagaagatccaggccttcgagaagttcttcaccagacacatcgacctgtacgacaaggacgagatcgagagaaagggcagcatcctggtggacttcaaggagctgaccgagggcggcgaggtgaccaacctgatccccgacatcgccaccgagctgagagacgcccccgagaagaccctggcctgcatgggcctggccatccaccaggtgctgaccaaggacctggagagacacgccgccgagctgcaggcccaggagggcctgagcaacgacggcgagaccatggtgaacgtgccccacatccacttcctgaagaagaagaagaagatctag

SEQ ID NO: 89035 - DNA, 1329 bp, Artificial Sequence
  Description of Artificial Sequence: Synthetic coding sequence
atggagaactggagcaaggacatcacccacagctacctggagcaggagaccaccggcatcaacaagagcacccagcccgacgagcagctgaccatgaacagcgagaagagcatgcacagaaagagcaccgagctggtgaacgagatcacctgcgagaacaccgagtggcccggccagagaagcaccaacttccagatcatcagcagctaccccgacgacgagagcgtgtactgcaccaccgagaagtacaacgtgatggagcacagacacaacgacatgcactacgagtgcatgaccccctgccaggtgaccagcgacagcgacaaggagaagaccatcgccttcctgctgaaggagctggacatcctgagaaccagcaacaagaagctgcagcagaagctggccaaggaggacaaggagcagagaaagctgaagttcaagctggagctgcaggagaaggagaccgaggccaagatcgccgagaagaccgccgccctggtggaggaggtgtacttcgcccagaaggagagagacgaggccgtgatgagcagactgcagctggccatcgaggagagagacgaggccatcgccagagccaagcacatggagatgagcctgaaggtgctggagaacatcaaccccgaggagaacgacatgaccctgcaggagctgctgaacagaatcaacaacgccgacaccggcatcgccatccagaagaacggcgccatcatcgtggacagaatctacaagaccaaggagtgcaagatgagaatcaccgccgaggagatgagcgccctgatcgaggagagagacgccgccctgagcaagtgcaagagactggagcaggagctgcaccacgtgaaggagcagaaccagaccagcgccaacaacatgagacacctgaccgccgagaacaaccaggagagagccctgaaggccaagctgctgagcatgcagcaggccagagagaccgccgtgcagcagtacaagaagctggaggaggagatccagaccctgagagtgtactacagcctgcacaagagcctgagccaggaggagaacctgaaggaccagttcaactacaccctgagcacctacgaggaggccctgaagaacagagagaacatcgtgagcatcacccagcagcagaacgaggagctggccacccagctgcagcaggccctgaccgagagagccaacatggagctgcagctgcagcacgccagagaggccagccaggtggccaacgagaaggtgcagaagctggagagactggtggacgtgctgagaaagaaggtgggcaccggcaccatgagaaccgtgatctag

SEQ ID NO: 89036 - DNA, 1329 bp, Artificial Sequence; identical to SEQ ID NO: 89035
  Description of Artificial Sequence: Synthetic coding sequence

SEQ ID NO: 89037 - DNA, 786 bp, Artificial Sequence
  Description of Artificial Sequence: Synthetic coding sequence
atgagcagactgcagctggccatcgaggagagagacgaggccatcgccagagccaagcacatggagatgagcctgaaggtgctggagaacatcaaccccgaggagaacgacatgaccctgcaggagctgctgaacagaatcaacaacgccgacaccggcatcgccatccagaagaacggcgccatcatcgtggacagaatctacaagaccaaggagtgcaagatgagaatcaccgccgaggagatgagcgccctgatcgaggagagagacgccgccctgagcaagtgcaagagactggagcaggagctgcaccacgtgaaggagcagaaccagaccagcgccaacaacatgagacacctgaccgccgagaacaaccaggagagagccctgaaggccaagctgctgagcatgcagcaggccagagagaccgccgtgcagcagtacaagaagctggaggaggagatccagaccctgagagtgtactacagcctgcacaagagcctgagccaggaggagaacctgaaggaccagttcaactacaccctgagcacctacgaggaggccctgaagaacagagagaacatcgtgagcatcacccagcagcagaacgaggagctggccacccagctgcagcaggccctgaccgagagagccaacatggagctgcagctgcagcacgccagagaggccagccaggtggccaacgagaaggtgcagaagctggagagactggtggacgtgctgagaaagaaggtgggcaccggcaccatgagaaccgtgatctag

SEQ ID NO: 89038 - DNA, 1329 bp, Artificial Sequence; identical to SEQ ID NO: 89035
  Description of Artificial Sequence: Synthetic coding sequence

SEQ ID NO: 89039 - DNA, 1275 bp, Artificial Sequence
  Description of Artificial Sequence: Synthetic coding sequence
atgaacagcgagaagagcatgcacagaaagagcaccgagctggtgaacgagatcacctgcgagaacaccgagtggcccggccagagaagcaccaacttccagatcatcagcagctaccccgacgacgagagcgtgtactgcaccaccgagaagtacaacgtgatggagcacagacacaacgacatgcactacgagtgcatgaccccctgccaggtgaccagcgacagcgacaaggagaagaccatcgccttcctgctgaaggagctggacatcctgagaaccagcaacaagaagctgcagcagaagctggccaaggaggacaaggagcagagaaagctgaagttcaagctggagctgcaggagaaggagaccgaggccaagatcgccgagaagaccgccgccctggtggaggaggtgtacttcgcccagaaggagagagacgaggccgtgatgagcagactgcagctggccatcgaggagagagacgaggccatcgccagagccaagcacatggagatgagcctgaaggtgctggagaacatcaaccccgaggagaacgacatgaccctgcaggagctgctgaacagaatcaacaacgccgacaccggcatcgccatccagaagaacggcgccatcatcgtggacagaatctacaagaccaaggagtgcaagatgagaatcaccgccgaggagatgagcgccctgatcgaggagagagacgccgccctgagcaagtgcaagagactggagcaggagctgcaccacgtgaaggagcagaaccagaccagcgccaacaacatgagacacctgaccgccgagaacaaccaggagagagccctgaaggccaagctgctgagcatgcagcaggccagagagaccgccgtgcagcagtacaagaagctggaggaggagatccagaccctgagagtgtactacagcctgcacaagagcctgagccaggaggagaacctgaaggaccagttcaactacaccctgagcacctacgaggaggccctgaagaacagagagaacatcgtgagcatcacccagcagcagaacgaggagctggccacccagctgcagcaggccctgaccgagagagccaacatggagctgcagctgcagcacgccagagaggccagccaggtggccaacgagaaggtgcagaagagccagatccagatctacttcatccccaacaagaaggacgagagagagaagttcctgatggacaagagaagaaagatcgtggcccacagcaagcagaacagctag

SEQ ID NO: 89040 - DNA, 315 bp, Artificial Sequence
  Description of Artificial Sequence: Synthetic coding sequence
atggagaactggagcaaggacatcacccacagctacctggagcaggagaccaccggcatcaacaagagcacccagcccgacgagcagctgaccatgaacagcgagaagagcatgcacagaaagagcaccgagctggtgaacgagatcacctgcgagaacaccgagtggcccggccagagaagcaccaacttccagatcatcagcagctaccccgacgacgagagcgtgtactgcaccaccgagaagtacaacgtgatggagcacagacacaacgacatgcactacgagtgcatgaccccctgccaggtgacctag

SEQ ID NO: 89041 - DNA, 387 bp, Artificial Sequence
  Description of Artificial Sequence: Synthetic coding sequence
atggagaactggagcaaggacatcacccacagctacctggagcaggagaccaccggcatcaacaagagcacccagcccgacgagcagctgaccatgaacagcgagaagagcatgcacagaaagagcaccgagctggtgaacgagatcacctgcgagaacaccgagtggcccggccagagaagcaccaacttccagatcatcagcagctaccccgacgacgagagcgtgtactgcaccaccgagaagtacaacgtgatggagcacagacacaacgacatgcactacgagtgcatgaccccctgccaggtgaccagcgacagcgacaaggagaagaccatcgccttcctgctgaaggagctggacatcctgagaaccagcaacaagtag

SEQ ID NO: 89042 - DNA, 3912 bp, Artificial Sequence
  Description of Artificial Sequence: Synthetic coding sequence
atgggcgaccccgcccccgccagaagcctggacgacatcgacctgagcgccctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagcaggagatcaacatgctgaagaagtacagccaccacagaaacatcgccacctactacggcgccttcatcaagaagagcccccccggcaacgacgaccagctgtggctggtgatggagttctgcggcgccggcagcgtgaccgacctggtgaagaacaccaagggcaacgccctgaaggaggactgcatcgcctacatctgcagagagatcctgagaggcctggcccacctgcacgcccacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacatctggagcctgggcatcaccgccatcgagatggccgagggcgccccccccctgtgcgacatgcaccccatgagagccctgttcctgatccccagaaaccccccccccagactgaagagcaagaagtggagcaagaagttcatcgacttcatcgacacctgcctgatcaagacctacctgagcagaccccccaccgagcagctgctgaagttccccttcatcagagaccagcccaccgagagacaggtgagaatccagctgaaggaccacatcgacagaagcagaaagaagagaggcgagaaggaggagaccgagtacgagtacagcggcagcgaggaggaggacgacagccacggcgaggagggcgagcccagcagcatcatgaacgtgcccggcgagagcaccctgagaagagagttcctgagactgcagcaggagaacaagagcaacagcgaggccctgaagcagcagcagcagctgcagcagcagcagcagagagaccccgaggcccacatcaagcacctgctgcaccagagacagagaagaatcgaggagcagaaggaggagagaagaagagtggaggagcagcagagaagagagagagagcagagaaagctgcaggagaaggagcagcagagaagactggaggacatgcaggccctgagaagagaggaggagagaagacaggccgagagagagcaggagtacaagagaaagcagctggaggagcagagacagagcgagagactgcagagacagctgcagcaggagcacgcctacctgaagagcctgcagcagcagcagcagcagcagcagctgcagaagcagcagcagcagcagctgctgcccggcgacagaaagcccctgtaccactacggcagaggcatgaaccccgccgacaagcccgcctgggccagagaggtggaggagagaaccagaatgaacaagcagcagaacagccccctggccaagagcaagcccggcagcaccggccccgagccccccatcccccaggccagccccggcccccccggccccctgagccagaccccccccatgcagagacccgtggagccccaggagggcccccacaagagcctggtggcccacagagtgcccctgaagccctacgccgcccccgtgcccagaagccagagcctgcaggaccagcccaccagaaacctggccgccttccccgccagccacgaccccgaccccgccatccccgcccccaccgccacccccagcgccagaggcgccgtgatcagacagaacagcgaccccaccagcgagggccccggccccagccccaacccccccgcctgggtgagacccgacaacgaggccccccccaaggtgccccagagaaccagcagcatcgccaccgccctgaacaccagcggcgccggcggcagcagacccgcccaggccgtgagagccagcaaccccgacctgagaagaagcgaccccggctgggagagaagcgacagcgtgctgcccgccagccacggccacctgccccaggccggcagcctggagagaaacagagtgggcgtgagcagcaagcccgacagcagccccgtgctgagccccggcaacaaggccaagcccgacgaccacagaagcagacccggcagacccgccagctacaagagagccatcggcgaggacttcgtgctgctgaaggagagaaccctggacgaggcccccagaccccccaagaaggccatggactacagcagcagcagcgaggaggtggagagcagcgaggacgacgaggaggagggcgagggcggccccgccgagggcagcagagacacccccggcggcagaagcgacggcgacaccgacagcgtgagcaccatggtggtgcacgacgtggaggagatcaccggcacccagcccccctacggcggcggcaccatggtggtgcagagaacccccgaggaggagagaaacctgctgcacgccgacagcaacggctacaccaacctgcccgacgtggtgcagcccagccacagccccaccgagaacagcaagggccagagcccccccagcaaggacggcagcggcgactaccagagcagaggcctggtgaaggcccccggcaagagcagcttcaccatgttcgtggacctgggcatctaccagcccggcggcagcggcgacagcatccccatcaccgccctggtgggcggcgagggcaccagactggaccagctgcagtacgacgtgagaaagggcagcgtggtgaacgtgaaccccaccaacaccagagcccacagcgagacccccgagatcagaaagtacaagaagagattcaacagcgagatcctgtgcgccgccctgtggggcgtgaacctgctggtgggcaccgagaacggcctgatgctgctggacagaagcggccagggcaaggtgtacggcctgatcggcagaagaagattccagcagatggacgtgctggagggcctgaacctgctgatcaccatcagcggcaagagaaacaagctgagagtgtactacctgagctggctgagaaacaagatcctgcacaacgaccccgaggtggagaagaagcagggctggaccaccgtgggcgacatggagggctgcggccactacagagtggtgaagtacgagagaatcaagttcctggtgatcgccctgaagagcagcgtggaggtgtacgcctgggcccccaagccctaccacaagttcatggccttcaagagcttcgccgacctgccccacagacccctgctggtggacctgaccgtggaggagggccagagactgaaggtgatctacggcagcagcgccggcttccacgccgtggacgtggacagcggcaacagctacgacatctacatccccgtgcacatccagagccagatcaccccccacgccatcatcttcctgcccaacaccgacggcatggagatgctgctgtgctacgaggacgagggcgtgtacgtgaacacctacggcagaatcatcaaggacgtggtgctgcagtggggcgagatgcccaccagcgtggcctacatctgcagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgaacagaaactgcatcatgaactggtag

SEQ ID NO: 89043 - DNA, 3999 bp, Artificial Sequence
  Description of Artificial Sequence: Synthetic coding sequence
atgggcgaccccgcccccgccagaagcctggacgacatcgacctgagcgccctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagcaggagatcaacatgctgaagaagtacagccaccacagaaacatcgccacctactacggcgccttcatcaagaagagcccccccggcaacgacgaccagctgtggctggtgatggagttctgcggcgccggcagcgtgaccgacctggtgaagaacaccaagggcaacgccctgaaggaggactgcatcgcctacatctgcagagagatcctgagaggcctggcccacctgcacgcccacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacatctggagcctgggcatcaccgccatcgagatggccgagggcgccccccccctgtgcgacatgcaccccatgagagccctgttcctgatccccagaaaccccccccccagactgaagagcaagaagtggagcaagaagttcatcgacttcatcgacacctgcctgatcaagacctacctgagcagaccccccaccgagcagctgctgaagttccccttcatcagagaccagcccaccgagagacaggtgagaatccagctgaaggaccacatcgacagaagcagaaagaagagaggcgagaaggaggagaccgagtacgagtacagcggcagcgaggaggaggacgacagccacggcgaggagggcgagcccagcagcatcatgaacgtgcccggcgagagcaccctgagaagagagttcctgagactgcagcaggagaacaagagcaacagcgaggccctgaagcagcagcagcagctgcagcagcagcagcagagagaccccgaggcccacatcaagcacctgctgcaccagagacagagaagaatcgaggagcagaaggaggagagaagaagagtggaggagcagcagagaagagagagagagcagagaaagctgcaggagaaggagcagcagagaagactggaggacatgcaggccctgagaagagaggaggagagaagacaggccgagagagagcaggagtacaagagaaagcagctggaggagcagagacagagcgagagactgcagagacagctgcagcaggagcacgcctacctgaagagcctgcagcagcagcagcagcagcagcagctgcagaagcagcagcagcagcagctgctgcccggcgacagaaagcccctgtaccactacggcagaggcatgaaccccgccgacaagcccgcctgggccagagaggtggaggagagaaccagaatgaacaagcagcagaacagccccctggccaagagcaagcccggcagcaccggccccgagccccccatcccccaggccagccccggcccccccggccccctgagccagaccccccccatgcagagacccgtggagccccaggagggcccccacaagagcctggtggcccacagagtgcccctgaagccctacgccgcccccgtgcccagaagccagagcctgcaggaccagcccaccagaaacctggccgccttccccgccagccacgaccccgaccccgccatccccgcccccaccgccacccccagcgccagaggcgccgtgatcagacagaacagcgaccccaccagcgagggccccggccccagccccaacccccccgcctgggtgagacccgacaacgaggccccccccaaggtgccccagagaaccagcagcatcgccaccgccctgaacaccagcggcgccggcggcagcagacccgcccaggccgtgagagccagacccagaagcaacagcgcctggcagatctacctgcagagaagagccgagagaggcacccccaagccccccggcccccccgcccagccccccggcccccccaacgccagcagcaaccccgacctgagaagaagcgaccccggctgggagagaagcgacagcgtgctgcccgccagccacggccacctgccccaggccggcagcctggagagaaacagagtgggcgtgagcagcaagcccgacagcagccccgtgctgagccccggcaacaaggccaagcccgacgaccacagaagcagacccggcagacccgccgacttcgtgctgctgaaggagagaaccctggacgaggcccccagaccccccaagaaggccatggactacagcagcagcagcgaggaggtggagagcagcgaggacgacgaggaggagggcgagggcggccccgccgagggcagcagagacacccccggcggcagaagcgacggcgacaccgacagcgtgagcaccatggtggtgcacgacgtggaggagatcaccggcacccagcccccctacggcggcggcaccatggtggtgcagagaacccccgaggaggagagaaacctgctgcacgccgacagcaacggctacaccaacctgcccgacgtggtgcagcccagccacagccccaccgagaacagcaagggccagagcccccccagcaaggacggcagcggcgactaccagagcagaggcctggtgaaggcccccggcaagagcagcttcaccatgttcgtggacctgggcatctaccagcccggcggcagcggcgacagcatccccatcaccgccctggtgggcggcgagggcaccagactggaccagctgcagtacgacgtgagaaagggcagcgtggtgaacgtgaaccccaccaacaccagagcccacagcgagacccccgagatcagaaagtacaagaagagattcaacagcgagatcctgtgcgccgccctgtggggcgtgaacctgctggtgggcaccgagaacggcctgatgctgctggacagaagcggccagggcaaggtgtacggcctgatcggcagaagaagattccagcagatggacgtgctggagggcctgaacctgctgatcaccatcagcggcaagagaaacaagctgagagtgtactacctgagctggctgagaaacaagatcctgcacaacgaccccgaggtggagaagaagcagggctggaccaccgtgggcgacatggagggctgcggccactacagagtggtgaagtacgagagaatcaagttcctggtgatcgccctgaagagcagcgtggaggtgtacgcctgggcccccaagccctaccacaagttcatggccttcaagagcttcgccgacctgccccacagacccctgctggtggacctgaccgtggaggagggccagagactgaaggtgatctacggcagcagcgccggcttccacgccgtggacgtggacagcggcaacagctacgacatctacatccccgtgcacatccagagccagatcaccccccacgccatcatcttcctgcccaacaccgacggcatggagatgctgctgtgctacgaggacgagggcgtgtacgtgaacacctacggcagaatcatcaaggacgtggtgctgcagtggggcgagatgcccaccagcgtggcctacatctgcagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgaacagaaactgcatcatgaactggtag

SEQ ID NO: 89044 - DNA, 3939 bp, Artificial Sequence
  Description of Artificial Sequence: Synthetic coding sequence
atgggcgaccccgcccccgccagaagcctggacgacatcgacctgagcgccctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagcaggagatcaacatgctgaagaagtacagccaccacagaaacatcgccacctactacggcgccttcatcaagaagagcccccccggcaacgacgaccagctgtggctggtgatggagttctgcggcgccggcagcgtgaccgacctggtgaagaacaccaagggcaacgccctgaaggaggactgcatcgcctacatctgcagagagatcctgagaggcctggcccacctgcacgcccacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacatctggagcctgggcatcaccgccatcgagatggccgagggcgccccccccctgtgcgacatgcaccccatgagagccctgttcctgatccccagaaaccccccccccagactgaagagcaagaagtggagcaagaagttcatcgacttcatcgacacctgcctgatcaagacctacctgagcagaccccccaccgagcagctgctgaagttccccttcatcagagaccagcccaccgagagacaggtgagaatccagctgaaggaccacatcgacagaagcagaaagaagagaggcgagaaggaggagaccgagtacgagtacagcggcagcgaggaggaggacgacagccacggcgaggagggcgagcccagcagcatcatgaacgtgcccggcgagagcaccctgagaagagagttcctgagactgcagcaggagaacaagagcaacagcgaggccctgaagcagcagcagcagctgcagcagcagcagcagagagaccccgaggcccacatcaagcacctgctgcaccagagacagagaagaatcgaggagcagaaggaggagagaagaagagtggaggagcagcagagaagagagagagagcagagaaagctgcaggagaaggagcagcagagaagactggaggacatgcaggccctgagaagagaggaggagagaagacaggccgagagagagcaggagtacaagagaaagcagctggaggagcagagacagagcgagagactgcagagacagctgcagcaggagcacgcctacctgaagagcctgcagcagcagcagcagcagcagcagctgcagaagcagcagcagcagcagctgctgcccggcgacagaaagcccctgtaccactacggcagaggcatgaaccccgccgacaagcccgcctgggccagagaggtggaggagagaaccagaatgaacaagcagcagaacagccccctggccaagagcaagcccggcagcaccggccccgagccccccatcccccaggccagccccggcccccccggccccctgagccagaccccccccatgcagagacccgtggagccccaggagggcccccacaagagcctgcaggaccagcccaccagaaacctggccgccttccccgccagccacgaccccgaccccgccatccccgcccccaccgccacccccagcgccagaggcgccgtgatcagacagaacagcgaccccaccagcgagggccccggccccagccccaacccccccgcctgggtgagacccgacaacgaggccccccccaaggtgccccagagaaccagcagcatcgccaccgccctgaacaccagcggcgccggcggcagcagacccgcccaggccgtgagagccagacccagaagcaacagcgcctggcagatctacctgcagagaagagccgagagaggcacccccaagccccccggcccccccgcccagccccccggcccccccaacgccagcagcaaccccgacctgagaagaagcgaccccggctgggagagaagcgacagcgtgctgcccgccagccacggccacctgccccaggccggcagcctggagagaaacagagtgggcgtgagcagcaagcccgacagcagccccgtgctgagccccggcaacaaggccaagcccgacgaccacagaagcagacccggcagacccgccgacttcgtgctgctgaaggagagaaccctggacgaggcccccagaccccccaagaaggccatggactacagcagcagcagcgaggaggtggagagcagcgaggacgacgaggaggagggcgagggcggccccgccgagggcagcagagacacccccggcggcagaagcgacggcgacaccgacagcgtgagcaccatggtggtgcacgacgtggaggagatcaccggcacccagcccccctacggcggcggcaccatggtggtgcagagaacccccgaggaggagagaaacctgctgcacgccgacagcaacggctacaccaacctgcccgacgtggtgcagcccagccacagccccaccgagaacagcaagggccagagcccccccagcaaggacggcagcggcgactaccagagcagaggcctggtgaaggcccccggcaagagcagcttcaccatgttcgtggacctgggcatctaccagcccggcggcagcggcgacagcatccccatcaccgccctggtgggcggcgagggcaccagactggaccagctgcagtacgacgtgagaaagggcagcgtggtgaacgtgaaccccaccaacaccagagcccacagcgagacccccgagatcagaaagtacaagaagagattcaacagcgagatcctgtgcgccgccctgtggggcgtgaacctgctggtgggcaccgagaacggcctgatgctgctggacagaagcggccagggcaaggtgtacggcctgatcggcagaagaagattccagcagatggacgtgctggagggcctgaacctgctgatcaccatcagcggcaagagaaacaagctgagagtgtactacctgagctggctgagaaacaagatcctgcacaacgaccccgaggtggagaagaagcagggctggaccaccgtgggcgacatggagggctgcggccactacagagtggtgaagtacgagagaatcaagttcctggtgatcgccctgaagagcagcgtggaggtgtacgcctgggcccccaagccctaccacaagttcatggccttcaagagcttcgccgacctgccccacagacccctgctggtggacctgaccgtggaggagggccagagactgaaggtgatctacggcagcagcgccggcttccacgccgtggacgtggacagcggcaacagctacgacatctacatccccgtgcacatccagagccagatcaccccccacgccatcatcttcctgcccaacaccgacggcatggagatgctgctgtgctacgaggacgagggcgtgtacgtgaacacctacggcagaatcatcaaggacgtggtgctgcagtggggcgagatgcccaccagcgtggcctacatctgcagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgaacagaaactgcatcatgaactggtag

SEQ ID NO: 89045 - DNA, 879 bp, Artificial Sequence
  Description of Artificial Sequence: Synthetic coding sequence
atgctgctggacagaagcggccagggcaaggtgtacggcctgatcggcagaagaagattccagcagatggacgtgctggagggcctgaacctgctgatcaccatcagcggcaagagaaacaagctgagagtgtactacctgagctggctgagaaacaagatcctgcacaacgaccccgaggtggagaagaagcagggctggaccaccgtgggcgacatggagggctgcggccactacagagtggtgaagtacgagagaatcaagttcctggtgatcgccctgaagagcagcgtggaggtgtacgcctgggcccccaagccctaccacaagttcatggccttcaagagcttcgccgacctgccccacagacccctgctggtggacctgaccgtggaggagggccagagactgaaggtgatctacggcagcagcgccggcttccacgccgtggacgtggacagcggcaacagctacgacatctacatccccgtgcacatccagagccagatcaccccccacgccatcatcttcctgcccaacaccgacggcatggagatgctgctgtgctacgaggacgagggcgtgtacgtgaacacctacggcagaatcatcaaggacgtggtgctgcagtggggcgagatgcccaccagcgtggcctacatctgcagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgaacagaaactgcatcatgaactggtag

SEQ ID NO: 89046 - DNA, 336 bp, Artificial Sequence
  Description of Artificial Sequence: Synthetic coding sequence
atgggcgaccccgcccccgccagaagcctggacgacatcgacctgagcgccctgagagccctgtggttccagttcttctaccacagcggcagcagcctggagagccccggcatgctgaacggccccttccagcacagaaacagcagaatcatgacccacagaagcgccgagaagaccctgctgggcagcctgagcctgtggagatggagcgccatggagcccaccgacagatgcaccagagtgggcatgagcagaagaggcagctggctgcccagcagaagctggatgagcagaagaaccagaagaaagagaagcaacagaagaagcacctgctag

SEQ ID NO: 89047 - DNA, 1014 bp, Artificial Sequence
  Description of Artificial Sequence: Synthetic coding sequence
atgggcgccgccggcagcagcgccctggccagattcgtgctgctggcccagagcagacccggctggctgggcgtggccgccctgggcctgaccgccgtggccctgggcgccgtggcctggagaagagcctggcccaccagaagaagaagactgctgcagcaggtgggcaccgtggcccagctgtggatctaccccgtgaagagctgcaagggcgtgcccgtgagcgaggccgagtgcaccgccatgggcctgagaagcggcaacctgagagacagattctggctggtgatcaaccaggagggcaacatggtgaccgccagacaggagcccagactggtgctgatcagcctgacctgcgacggcgacaccctgaccctgagcgccgcctacaccaaggacctgctgctgcccatcaagacccccaccaccaacgccgtgcacaagtgcagagtgcacggcctggagatcgagggcagagactgcggcgaggccaccgcccagtggatcaccagcttcctgaagagccagccctacagactggtgcacttcgagccccacatgagacccagaagaccccaccagatcgccgacctgttcagacccaaggaccagatcgcctacagcgacaccagccccttcctgatcctgagcgaggccagcctggccgacctgaacagcagactggagaagaaggtgaaggccaccaacttcagacccaacatcgtgatcagcggctgcgacgtgtacgccgaggacagctgggacgagctgctgatcggcgacgtggagctgaagagagtgatggcctgcagcagatgcatcctgaccaccgtggaccccgacaccggcgtgatgagcagaaaggagcccctggagaccctgaagagctacagacagtgcgaccccagcgagagaaagctgtacggcaagagccccctgttcggccagtacttcgtgctggagaaccccggcaccatcaaggtgggcgaccccgtgtacctgctgggccagtag

SEQ ID NO: 89048 - DNA, 774 bp, Artificial Sequence
  Description of Artificial Sequence: Synthetic coding sequence
atgggcgccagcagcagcagcgccctggccagactgggcctgcccgccagaccctggcccagatggctgggcgtggccgccctgggcctggccgccgtggccctgggcaccgtggcctggagaagagcctggcccagaagaagaagaagactgcagcaggtgggcaccgtggccaagctgtggatctaccccgtgaagagctgcaagggcgtgcccgtgagcgaggccgagtgcaccgccatgggcctgagaagcggcaacctgagagacagattctggctggtgatcaaggaggacggccacatggtgaccgccagacaggagcccagactggtgctgatcagcatcatctacgagaacaactgcctgatcttcagagcccccgacatggaccagctggtgctgcccagcaagcagcccagcagcaacaagctgcacaactgcagaatcttcggcctggacatcaagggcagagactgcggcaacgaggccgccaagtggttcaccaacttcctgaagaccgaggcctacagactggtgcagttcgagaccaacatgaagggcagaaccagcagaaagctgctgcccaccctggaccagaacttccaggtggcctaccccgactactgccccctgctgatcatgaccgacgccagcctggtggacctgaacaccagaatggagaagaagatgaagatggagaacttcagacccaacatcgtggtgaccggctgcgacgccttcgaggaggccagcgccaccagaagagactag

SEQ ID NO: 89049 - DNA, 1008 bp, Artificial Sequence
  Description of Artificial Sequence: Synthetic coding sequence
atgggcgccagcagcagcagcgccctggccagactgggcctgcccgccagaccctggcccagatggctgggcgtggccgccctgggcctggccgccgtggccctgggcaccgtggcctggagaagagcctggcccagaagaagaagaagactgcagcaggtgggcaccgtggccaagctgtggatctaccccgtgaagagctgcaagggcgtgcccgtgagcgaggccgagtgcaccgccatgggcctgagaagcggcaacctgagagacagattctggctggtgatcaaggaggacggccacatggtgaccgccagacaggagcccagactggtgctgatcagcatcatctacgagaacaactgcctgatcttcagagcccccgacatggaccagctggtgctgcccagcaagcagcccagcagcaacaagctgcacaactgcagaatcttcggcctggacatcaagggcagagactgcggcaacgaggccgccaagtggttcaccaacttcctgaagaccgaggcctacagactggtgcagttcgagaccaacatgaagggcagaaccagcagaaagctgctgcccaccctggaccagaacttccaggtggcctaccccgactactgccccctgctgatcatgaccgacgccagcctggtggacctgaacaccagaatggagaagaagatgaagatggagaacttcagacccaacatcgtggtgaccggctgcgacgccttcgaggaggacacctgggacgagctgctgatcggcagcgtggaggtgaagaaggtgatggcctgccccagatgcatcctgaccaccgtggaccccgacaccggcgtgatcgacagaaagcagcccctggacaccctgaagagctacagactgtgcgaccccagcgagagagagctgtacaagctgagccccctgttcggcatctactacagcgtggagaagatcggcagcctgagagtgggcgaccccgtgtacagaatggtgtag

SEQ ID NO: 89050 - DNA, 519 bp, Artificial Sequence
  Description of Artificial Sequence: Synthetic coding sequence
ggccacatggtgaccgccagacaggagcccagactggtgctgatcagcatcatctacgagaacaactgcctgatcttcagagcccccgacatggaccagctggtgctgcccagcaagcagcccagcagcaacaagctgcacaactgcagaatcttcggcctggacatcaagggcagagactgcggcaacgaggccgccaagtggttcaccaacttcctgaagaccgaggcctacagactggtgcagttcgagaccaacatgaagggcagaaccagcagaaagctgctgcccaccctggaccagaacttccaggtggcctaccccgactactgccccctgctgatcatgaccgacgccagcctggtggacctgaacaccagaatggagaagaagatgaagatggagaacttcagacccaacatcgtggtgaccggctgcgacgccttcgaggaggacacctgggacgagctgctgatcggcagcgtggaggtgaagaaggtgatggcctgccccagatag

SEQ ID NO: 89051 - DNA, 447 bp, Artificial Sequence
  Description of Artificial Sequence: Synthetic coding sequence
atgcccttcgccgaggacaagacctacaagtacatctgcagaaacttcagcaacttctgcaacgtggacgtggtggagatcctgccctacctgccctgcctgaccgccagagaccaggacagactgagagccacctgcaccctgagcggcaacagagacaccctgtggcacctgttcaacaccctgcagctgcccacctgggccggcgaggagacccccggcggccagagcagcggcagaggcctggacttcagcagcctgaccagcggcgccgtgtggctgtggcagatgagcgacttctggagctgcttcagcacctggaccgtgagcatctggctgatcctgcactgggtgctgctgagactgaacctgcaggtgttcgccaagtgcctggcccagagcaagtggcccctgctgctgcccagcctgagctgccccacctggtag

SEQ ID NO: 89052 - DNA, 375 bp, Artificial Sequence
  Description of Artificial Sequence: Synthetic coding sequence
atgcccttcgccgaggacaagacctacaagtacatctgcagaaacttcagcaacttctgcaacgtggacgtggtggagatcctgccctacctgccctgcctgaccgccagagaccaggacagactgagagccacctgcaccctgagcggcaacagagacaccctgtggcacctgttcaacaccctgcagagaagacccggctgggtggagtacttcatcgccgccctgagaggctgcgagctggtggacctggccgacgaggtggccagcgtgtaccagagctaccagccccagttcagagccagccccgccgacgcccagccccagagccaccccaaggagagcagatggtggccccccggcgtgctgctgtag

SEQ ID NO: 89053 - DNA, 1200 bp, Artificial Sequence
  Description of Artificial Sequence: Synthetic coding sequence
atgcccgtgcaggagacccaggcccccgagagccccggcgagaacagcgagcaggccctgcagaccctgagccccagagccatccccagaaaccccgacggcggccccctggagagcagcagcgacctggccgccctgagccccctgaccagcagcggccaccaggagcaggacaccgagctgggcagcacccacaccgccggcgccaccagcagcctgacccccagcagaggccccgtgagccccagcgtgagcttccagcccctggccagaagcacccccagagccagcagactgcccggccccaccggcagcgtggtgagcaccggcaccagcttcagcagcagcagccccggcctggccagcgccggcgccgccgagggcaagcagggcgccgagagcgaccaggccgagcccatcatctgcagcagcggcgccgaggcccccgccaacagcctgcccagcaaggtgcccaccaccctgatgcccgtgaacaccgtggccctgaaggtgcccgccaaccccgccagcgtgagcaccgtgcccagcaagctgcccaccagcagcaagccccccggcgccgtgcccagcaacgccctgaccaaccccgcccccagcaagctgcccatcaacagcaccagagccggcatggtgcccagcaaggtgcccaccagcatggtgctgaccaaggtgagcgccagcaccgtgcccaccgacggcagcagcagaaacgaggagacccccgccgcccccacccccgccggcgccaccggcggcagcagcgcctggctggacagcagcagcgagaacagaggcctgggcagcgagctgagcaagcccggcgtgctggccagccaggtggacagccccttcagcggctgcttcgaggacctggccatcagcgccagcaccagcctgggcatgggcccctgccacggccccgaggagaacgagtacaagagcgagggcaccttcggcatccacgtggccgagaaccccagcatccagctgctggagggcaaccccggcccccccgccgaccccgacggcggccccagaccccaggccgacagaaagttccaggagagagaggtgccctgccacagacccagccccggcgccctgtggctgcaggtggccgtgaccggcgtgctggtggtgaccctgctggtggtgctgtacagaagaagactgcactag

SEQ ID NO: 89054 - DNA, 1623 bp, Artificial Sequence
  Description of Artificial Sequence: Synthetic coding sequence
atgcccttcgccgaggacaagacctacaagtacatctgcagaaacttcagcaacttctgcaacgtggacgtggtggagatcctgccctacctgccctgcctgaccgccagagaccaggacagactgagagccacctgcaccctgagcggcaacagagacaccctgtggcacctgttcaacaccctgcagagaagacccggctgggtggagtacttcatcgccgccctgagaggctgcgagctggtggacctggccgacgaggtggccagcgtgtaccagagctaccagcccagaaccagcgacagaccccccgaccccctggagccccccagcctgcccgccgagagacccggcccccccacccccgccgccgcccacagcatcccctacaacagctgcagagagaaggagcccagctaccccatgcccgtgcaggagacccaggcccccgagagccccggcgagaacagcgagcaggccctgcagaccctgagccccagagccatccccagaaaccccgacggcggccccctggagagcagcagcgacctggccgccctgagccccctgaccagcagcggccaccaggagcaggacaccgagctgggcagcacccacaccgccggcgccaccagcagcctgacccccagcagaggccccgtgagccccagcgtgagcttccagcccctggccagaagcacccccagagccagcagactgcccggccccaccggcagcgtggtgagcaccggcaccagcttcagcagcagcagccccggcctggccagcgccggcgccgccgagggcaagcagggcgccgagagcgaccaggccgagcccatcatctgcagcagcggcgccgaggcccccgccaacagcctgcccagcaaggtgcccaccaccctgatgcccgtgaacaccgtggccctgaaggtgcccgccaaccccgccagcgtgagcaccgtgcccagcaagctgcccaccagcagcaagccccccggcgccgtgcccagcaacgccctgaccaaccccgcccccagcaagctgcccatcaacagcaccagagccggcatggtgcccagcaaggtgcccaccagcatggtgctgaccaaggtgagcgccagcaccgtgcccaccgacggcagcagcagaaacgaggagacccccgccgcccccacccccgccggcgccaccggcggcagcagcgcctggctggacagcagcagcgagaacagaggcctgggcagcgagctgagcaagcccggcgtgctggccagccaggtggacagccccttcagcggctgcttcgaggacctggccatcagcgccagcaccagcctgggcatgggcccctgccacggccccgaggagaacgagtacaagagcgagggcaccttcggcatccacgtggccgagaaccccagcatccagctgctggagggcaaccccggcccccccgccgaccccgacggcggccccagaccccaggccgacagaaagttccaggagagagaggtgccctgccacagacccagccccggcgccctgtggctgcaggtggccgtgaccggcgtgctggtggtgaccctgctggtggtgctgtacagaagaagactgcactag

SEQ ID NO: 89055 - DNA, 993 bp, Artificial Sequence
  Description of Artificial Sequence: Synthetic coding sequence
atggccgccgccgccggcagaagcctgctgctgctgctgagcagcagaggcggcggcggcggcggcgccggcggctgcggcgccctgaccgccggctgcttccccggcctgggcgtgagcagacacagacagcagcagcaccacagaaccgtgcaccagagaatcgccagctggcagaacctgggcgccgtgtactgcagcaccgtggtgcccagcgacgacgtgaccgtggtgtaccagaacggcctgcccgtgatcagcgtgagactgcccagcagaagagagagatgccagttcaccctgaagcccatcagcgacagcgtgggcgtgttcctgagacagctgcaggaggaggacagaggcatcgacagagtggccatctacagccccgacggcgtgagagtggccgccagcaccggcatcgacctgctgctgctggacgacttcaagctggtgatcaacgacctgacctaccacgtgagaccccccaagagagtggagatgggcttctgccacgtgggccagaacggcttcgagctgctgaccagcagctacctgcccgccagcgccagccagagcgccgagatcatcgccgtgagaatcgagatcagcagaaaggccgagaagagaaccaccctggtgctgtggggcggcctggcctacatggccacccagttcggcatcctggccagactgacctggtgggagtacagctgggacatcatggagcccgtgacctacttcatcacctacggcagcgccatggccatgtacgcctacttcgtgatgaccagacaggagtacgtgtaccccgaggccagagacagacagtacctgctgttcttccacaagggcgccaagaagagcagattcgacctggagaagtacaaccagctgaaggacgccatcgcccaggccgagatggacctgaagagactgagagaccccctgcaggtgcacctgcccctgagacagatcggcgagaaggactag

SEQ ID NO: 89056 - DNA, 1056 bp, Artificial Sequence
  Description of Artificial Sequence: Synthetic coding sequence
atggccgccgccgccggcagaagcctgctgctgctgctgagcagcagaggcggcggcggcggcggcgccggcggctgcggcgccctgaccgccggctgcttccccggcctgggcgtgagcagacacagacagcagcagcaccacagaaccgtgcaccagagaatcgccagctggcagaacctgggcgccgtgtactgcagcaccgtggtgcccagcgacgacgtgaccgtggtgtaccagaacggcctgcccgtgatcagcgtgagactgcccagcagaagagagagatgccagttcaccctgaagcccatcagcgacagcgtgggcgtgttcctgagacagctgcaggaggaggacagaggcatcgacagagtggccatctacagccccgacggcgtgagagtggccgccagcaccggcatcgacctgctgctgctggacgacttcaagctggtgatcaacgacctgacctaccacgtgagaccccccaagagagacctgctgagccacgagaacgccgccaccctgaacgacgtgaagaccctggtgcagcagctgtacaccaccctgtgcatcgagcagcaccagctgaacaaggagagagagctgatcgagagactggaggacctgaaggagcagctggcccccctggagaaggtgagaatcgagatcagcagaaaggccgagaagagaaccaccctggtgctgtggggcggcctggcctacatggccacccagttcggcatcctggccagactgacctggtgggagtacagctgggacatcatggagcccgtgacctacttcatcacctacggcagcgccatggccatgtacgcctacttcgtgatgaccagacaggagtacgtgtaccccgaggccagagacagacagtacctgctgttcttccacaagggcgccaagaagagcagattcgacctggagaagtacaaccagctgaaggacgccatcgcccaggccgagatggacctgaagagactgagagaccccctgcaggtgcacctgcccctgagacagatcggcgagaaggactag

SEQ ID NO: 89057 - DNA, 909 bp, Artificial Sequence
  Description of Artificial Sequence: Synthetic coding sequence
atggtgcaccagagaatcgccagctggcagaacctgggcgccgtgtactgcagcaccgtggtgcccagcgacgacgtgaccgtggtgtaccagaacggcctgcccgtgatcagcgtgagactgcccagcagaagagagagatgccagttcaccctgaagcccatcagcgacagcgtgggcgtgttcctgagacagctgcaggaggaggacagaggcatcgacagagtggccatctacagccccgacggcgtgagagtggccgccagcaccggcatcgacctgctgctgctggacgacttcaagctggtgatcaacgacctgacctaccacgtgagaccccccaagagagacctgctgagccacgagaacgccgccaccctgaacgacgtgaagaccctggtgcagcagctgtacaccaccctgtgcatcgagcagcaccagctgaacaaggagagagagctgatcgagagactggaggacctgaaggagcagctggcccccctggagaaggtgagaatcgagatcagcagaaaggccgagaagagaaccaccctggtgctgtggggcggcctggcctacatggccacccagttcggcatcctggccagactgacctggtgggagtacagctgggacatcatggagcccgtgacctacttcatcacctacggcagcgccatggccatgtacgcctacttcgtgatgaccagacaggagtacgtgtaccccgaggccagagacagacagtacctgctgttcttccacaagggcgccaagaagagcagattcgacctggagaagtacaaccagctgaaggacgccatcgcccaggccgagatggacctgaagagactgagagaccccctgcaggtgcacctgcccctgagacagatcggcgagaaggactag

SEQ ID NO: 89058 - DNA, 912 bp, Artificial Sequence
  Description of Artificial Sequence: Synthetic coding sequence
atggccgacgccgccagccaggtgctgctgggcagcggcctgaccatcctgagccagcccctgatgtacgtgaaggtgctgatccaggtgggctacgagcccctgccccccaccatcggcagaaacatcttcggcagacaggtgtgccagctgcccggcctgttcagctacgcccagcacatcgccagcatcgacggcagaagaggcctgttcaccggcctgacccccagactgtgcagcggcgtgctgggcaccgtggtgcacggcaaggtgctgcagcactaccaggagagcgacaagggcgaggagctgggccccggcaacgtgcagaaggaggtgagcagcagcttcgaccacgtgatcaaggagaccaccagagagatgatcgccagaagcgccgccaccctgatcacccaccccttccacgtgatcaccctgagaagcatggtgcagttcatcggcagagagagcaagtactgcggcctgtgcgacagcatcatcaccatctacagagaggagggcatcctgggcttcttcgccggcctggtgcccagactgctgggcgacatcctgagcctgtggctgtgcaacagcctggcctacctggtgaacacctacgccctggacagcggcgtgagcaccatgaacgagatgaagagctacagccaggccgtgaccggcttcttcgccagcatgctgacctaccccttcgtgctggtgagcaacctgatggccgtgaacaactgcggcctggccggcggctgccccccctacagccccatctacaccagctggatcgactgctggtgcatgctgcagaaggagggcaacatgagcagaggcaacagcctgttcttcagaaaggtgcccttcggcaagacctactgctgcgacctgaagatgctgatctag

SEQ ID NO: 89059 - DNA, 468 bp, Artificial Sequence
  Description of Artificial Sequence: Synthetic coding sequence
atggtgcagttcatcggcagagagagcaagtactgcggcctgtgcgacagcatcatcaccatctacagagaggagggcatcctgggcttcttcgccggcctggtgcccagactgctgggcgacatcctgagcctgtggctgtgcaacagcctggcctacctggtgaacacctacgccctggacagcggcgtgagcaccatgaacgagatgaagagctacagccaggccgtgaccggcttcttcgccagcatgctgacctaccccttcgtgctggtgagcaacctgatggccgtgaacaactgcggcctggccggcggctgccccccctacagccccatctacaccagctggatcgactgctggtgcatgctgcagaaggagggcaacatgagcagaggcaacagcctgttcttcagaaaggtgcccttcggcaagacctactgctgcgacctgaagatgctgatctag

SEQ ID NO: 89060 - DNA, 360 bp, Artificial Sequence
  Description of Artificial Sequence: Synthetic coding sequence
atggtgctgcccctgccctggctgagcagataccacttcctgagactgctgctgcccagctggagcctggccccccagggcagccacggctgctgcagccagaaccccaaggccagcatggaggagcagaccagcagcagaggcaacggcaagatgaccagcccccccagaggccccggcacccacagaaccgccgagctggccagagccgaggagctgctggagcagcagctggagctgtaccaggccctgctggagggccaggagggcgcctgggaggcccaggccctggtgctgaagatccagaagctgaaggagcagatgagaagacaccaggagagcctgggcggcggcgcctag

SEQ ID NO: 89061 - DNA, 360 bp, Artificial Sequence
  Description of Artificial Sequence: Synthetic coding sequence
atggtgctgcccctgccctggctgagcagataccacttcctgagactgctgctgcccagctggagcctggccccccagggcagccacggctgctgcagccagaaccccaaggccagcatggaggagcagaccaacagcagaggcaacggcaagatgaccagcccccccagaggccccggcacccacagaaccgccgagctggccagagccgaggagctgctggagcagcagctggagctgtaccaggccctgctggagggccaggagggcgcctgggaggcccaggccctggtgctgaagatccagaagctgaaggagcagatgagaagacaccaggagagcctgggcggcggcgcctag

SEQ ID NO: 89062 - DNA, 360 bp, Artificial Sequence; identical to SEQ ID NO: 89061
  Description of Artificial Sequence: Synthetic coding sequence

SEQ ID NO: 89063 - DNA, 360 bp, Artificial Sequence; identical to SEQ ID NO: 89060
  Description of Artificial Sequence: Synthetic coding sequence

SEQ ID NO: 89064 - DNA, 360 bp, Artificial Sequence; identical to SEQ ID NO: 89060
  Description of Artificial Sequence: Synthetic coding sequence

SEQ ID NO: 89065 - DNA, 360 bp, Artificial Sequence
  Description of Artificial Sequence: Synthetic coding sequence
atggtgctgcccctgccctggctgagcagataccacttcctgagactgctgctgcccagctggagcctggccccccagggcagccacggctgctgcagccagaaccccaaggccagcatggagaagcagaccaacagcagaggcaacggcaagatgaccagcccccccagaggccccggcacccacagaaccgccgagctggccagagccgaggagctgctggagcagcagctggagctgtaccaggccctgctggagggccaggagggcgcctgggaggcccaggccctggtgctgaagatccagaagctgaaggagcagatgagaagacaccaggagagcctgggcggcggcgcctag

SEQ ID NO: 89066 - DNA, 360 bp, Artificial Sequence; identical to SEQ ID NO: 89061
  Description of Artificial Sequence: Synthetic coding sequence

SEQ ID NO: 89067 - DNA, 360 bp, Artificial Sequence; identical to SEQ ID NO: 89061
  Description of Artificial Sequence: Synthetic coding sequence

SEQ ID NO: 89068 - DNA, 1059 bp, Artificial Sequence
  Description of Artificial Sequence: Synthetic coding sequence
atggagagcggcggcagacccagcctgtgccagttcatcctgctgggcaccaccagcgtggtgaccgccgccctgtacagcgtgtacagacagaaggccagagtgagccaggagctgaagggcgccaagaaggtgcacctgggcgaggacctgaagagcatcctgagcgaggcccccggcaagtgcgtgccctacgccgtgatcgagggcgccgtgagaagcgtgaaggagaccctgaacagccagttcgtggagaactgcaagggcgtgatccagagactgaccctgcaggagcacaagatggtgtggaacagaaccacccacctgtggaacgactgcagcaagatcatccaccagagaaccaacaccgtgcccttcgacctggtgccccacgaggacggcgtggacgtggccgtgagagtgctgaagcccctggacagcgtggacctgggcctggagaccgtgtacgagaagttccaccccagcatccagagcttcaccgacgtgatcggccactacatcagcggcgagagacccaagggcatccaggagaccgaggagatgctgaaggtgggcgccaccctgaccggcgtgggcgagctggtgctggacaacaacagcgtgagactgcagccccccaagcagggcatgcagtactacctgagcagccaggacttcgacagcctgctgcagagacaggagagcagcgtgagactgtggaaggtgctggccctggtgttcggcttcgccacctgcgccaccctgttcttcatcctgagaaagcagtacctgcagagacaggagagactgagactgaagcagatgcaggaggagttccaggagcacgaggcccagctgctgagcagagccaagcccgaggacagagagagcctgaagagcgcctgcgtggtgtgcctgagcagcttcaagagctgcgtgttcctggagtgcggccacgtgtgcagctgcaccgagtgctacagagccctgcccgagcccaagaagtgccccatctgcagacaggccatcaccagagtgatccccctgtacaacagctag

SEQ ID NO: 89069 - DNA, 2142 bp, Artificial Sequence
  Description of Artificial Sequence: Synthetic coding sequence
atgctgtgcgtgggcagactgggcggcctgggcgccagagccgccgccctgccccccagaagagccggcagaggcagcctggaggccggcatcagagccagaagagtgagcaccagctggagccccgtgggcgccgccttcaacgtgaagccccagggcagcagactggacctgttcggcgagagaagaggcctgttcggcgtgcccgagctgagcgcccccgagggcttccacatcgcccaggagaaggccctgagaaagaccgagctgctggtggacagagcctgcagcaccccccccggcccccagaccgtgctgatcttcgacgagctgagcgacagcctgtgcagagtggccgacctggccgacttcgtgaagatcgcccaccccgagcccgccttcagagaggccgccgaggaggcctgcagaagcatcggcaccatggtggagaagctgaacaccaacgtggacctgtaccagagcctgcagaagctgctggccgacaagaagctggtggacagcctggaccccgagaccagaagagtggccgagctgttcatgttcgacttcgagatcagcggcatccacctggacaaggagaagagaaagagagccgtggacctgaacgtgaagatcctggacctgagcagcaccttcctgatgggcaccaacttccccaacaagatcgagaagcacctgctgcccgagcacatcagaagaaacttcaccagcgccggcgaccacatcatcatcgacggcctgcacgccgagagccccgacgacctggtgagagaggccgcctacaagatcttcctgtaccccaacgccggccagctgaagtgcctggaggagctgctgagcagcagagacctgctggccaagctggtgggctacagcaccttcagccacagagccctgcagggcaccatcgccaagaaccccgagaccgtgatgcagttcctggagaagctgagcgacaagctgagcgagagaaccctgaaggacttcgagatgatcagaggcatgaagatgaagctgaacccccagaacagcgaggtgatgccctgggaccccccctactacagcggcgtgatcagagccgagagatacaacatcgagcccagcctgtactgccccttcttcagcctgggcgcctgcatggagggcctgaacatcctgctgaacagactgctgggcatcagcctgtacgccgagcagcccgccaagggcgaggtgtggagcgaggacgtgagaaagctggccgtggtgcacgagagcgagggcctgctgggctacatctactgcgacttcttccagagagccgacaagccccaccaggactgccacttcaccatcagaggcggcagactgaaggaggacggcgactaccagctgcccgtggtggtgctgatgctgaacctgcccagaagcagcagaagcagccccaccctgctgacccccagcatgatggagaacctgttccacgagatgggccacgccatgcacagcatgctgggcagaaccagataccagcacgtgaccggcaccagatgccccaccgacttcgccgaggtgcccagcatcctgatggagtacttcgccaacgactacagagtggtgaaccagttcgccagacactaccagaccggccagcccctgcccaagaacatggtgagcagactgtgcgagagcaagaaggtgtgcgccgccgccgacatgcagctgcaggtgttctacgccaccctggaccagatctaccacggcaagcaccccctgagaaacagcaccaccgacatcctgaaggagacccaggagaagttctacggcctgccctacgtgcccaacaccgcctggcagctgagattcagccacctggtgggctacggcgccagatactacagctacctgatgagcagagccgtggccagcatggtgtggaaggagtgcttcctgcaggaccccttcaacagagccgccggcgagagatacagaagagagatgctggcccacggcggcggcagagagcccatgctgatggtggagggcatgctgcagaagtgccccagcgtggacgacttcgtgagcgccctggtgagcgacctggacctggacttcgagaccttcctgatggacagcgagtag

SEQ ID NO: 89070 - DNA, 1353 bp, Artificial Sequence; identical to SEQ ID NO: 77832
  Description of Artificial Sequence: Synthetic coding sequence

SEQ ID NO: 89071 - DNA, 1170 bp, Artificial Sequence
  Description of Artificial Sequence: Synthetic coding sequence
atgagagtgctggtgagaagatgctggggcccccccctggcccacggcgccagaagaggcagacccagcccccagtggagagccctggccagactgggctgggaggactgcagagacagcagagtgagagagaagcccccctggagagtgctgttcttcggcaccgaccagttcgccagagaggccctgagagccctgcacgccgccagagagaacaaggaggaggagctgatcgacaagctggaggtggtgaccatgcccagccccagccccaagggcctgcccgtgaagcagtacgccgtgcagagccagctgcccgtgtacgagtggcccgacgtgggcagcggcgagtacgacgtgggcgtggtggccagcttcggcagactgctgaacgaggccctgatcctgaagttcccctacggcatcctgaacgtgcaccccagctgcctgcccagatggagaggccccgcccccgtgatccacaccgtgctgcacggcgacaccgtgaccggcgtgaccatcatgcagatcagacccaagagattcgacgtgggccccatcctgaagcaggagaccgtgcccgtgccccccaagagcaccgccaaggagctggaggccgtgctgagcagactgggcgccaacatgctgatcagcgtgctgaagaacctgcccgagagcctgagcaacggcagacagcagcccatggagggcgccacctacgcccccaagatcagcgccggcaccagctgcatcaagtgggaggagcagaccagcgagcagatcttcagactgtacagagccatcggcaacatcatccccctgcagaccctgtggatggccaacaccatcaagctgctggacctggtggaggtgaacagcagcgtgctggccgaccccaagctgaccggccaggccctgatccccggcagcgtgatctaccacaagcagagccagatcctgctggtgtactgcaaggacggctggatcggcgtgagaagcgtgatgctgaagaagagcctgaccgccaccgacttctacaacggctacctgcacccctggtaccagaagaacagccaggcccagcccagccagtgcagattccagaccctgagactgcccaccaagaagaagcagaagaagaccgtggccatgcagcagtgcatcgagtag

SEQ ID NO: 89072 - DNA, 1749 bp, Artificial Sequence
  Description of Artificial Sequence: Synthetic coding sequence
atggccgtgcccggcgtgggcctgctgaccagactgaacctgtgcgccagaagaagaaccagagtgcagagacccatcgtgagactgctgagctgccccggcaccgtggccaaggacctgagaagagacgagcagcccagcggcagcgtggagaccggcttcgaggacaagatccccaagagaagattcagcgagatgcagaacgagagaagagagcaggcccagagaaccgtgctgatccactgccccgagaagatcagcgagaacaagttcctgaagtacctgagccagttcggccccatcaacaaccacttcttctacgagagcttcggcctgtacgccgtggtggagttctgccagaaggagagcatcggcagcctgcagaacggcacccacacccccagcaccgccatggagaccgccatccccttcagaagcagattcttcaacctgaagctgaagaaccagaccagcgagagaagcagagtgagaagcagcaaccagctgcccagaagcaacaagcagctgttcgagctgctgtgctacgccgagagcatcgacgaccagctgaacaccctgctgaaggagttccagctgaccgaggagaacaccaagctgagatacctgacctgcagcctgatcgaggacatggccgccgcctacttccccgactgcatcgtgagacccttcggcagcagcgtgaacaccttcggcaagctgggctgcgacctggacatgttcctggacctggacgagaccagaaacctgagcgcccacaagatcagcggcaacttcctgatggagttccaggtgaagaacgtgcccagcgagagaatcgccacccagaagatcctgagcgtgctgggcgagtgcctggaccacttcggccccggctgcgtgggcgtgcagaagatcctgaacgccagatgccccctggtgagattcagccaccaggccagcggcttccagtgcgacctgaccaccaacaacagaatcgccctgaccagcagcgagctgctgtacatctacggcgccctggacagcagagtgagagccctggtgttcagcgtgagatgctgggccagagcccacagcctgaccagcagcatccccggcgcctggatcaccaacttcagcctgaccatgatggtgatcttcttcctgcagagaagaagcccccccatcctgcccaccctggacagcctgaagaccctggccgacgccgaggacaagtgcgtgatcgagggcaacaactgcaccttcgtgagagacctgagcagaatcaagcccagccagaacaccgagaccctggagctgctgctgaaggagttcttcgagtacttcggcaacttcgccttcgacaagaacagcatcaacatcagacagggcagagagcagaacaagcccgacagcagccccctgtacatccagaaccccttcgagaccagcctgaacatcagcaagaacgtgagccagagccagctgcagaagttcgtggacctggccagagagagcgcctggatcctgcagcaggaggacaccgacagacccagcatcagcagcaacagaccctggggcctggtgagcctgctgctgcccagcgcccccaacagaaagagcttcaccaagaagaagagcaacaagttcgccatcgagaccgtgaagaacctgctggagagcctgaagggcaacagaaccgagaacttcaccaagaccagcggcaagagaaccatcagcacccagacctag

SEQ ID NO: 89073 - DNA, 2139 bp, Artificial Sequence
  Description of Artificial Sequence: Synthetic coding sequence
atggcctgggccaagaaggtgggcggcagagccggccagggcagaagcctgagcagatgcgaccccatcatcctggaccccgagtggctgtacggcccccccgagggcgagggcggccccgagggcgtgggcggcgagaccagagccagcatccacccccccctgagaaccggcagacaccaccagaaggtgaaccacaacatcagaggccccgagggcagcgccaaggacgccgcccccggcggcggcggccaccaccaggccggccccggccagagaggcgacgaggacggcgccctgcagcacctgtgcggcggcggcggcggcgtgggcgtgagcgtgggcagaggcaccggcaccagcgtggccgccgagcaccccagcctgcaggtgaagctgctggagctgcaggagctggtgctgagactggccggcgaccacaacgagggccacggcaagttcctggccgccgcccagaaccccgccgacgaccccgcccccggcgcccccgccccccaggagctgggcgccgccgacaagcagggcggcttcgaggacaagatccccaagagaagattcagcgagatgcagaacgagagaagagagcaggcccagagaaccgtgctgatccactgccccgagaagatcagcgagaacaagttcctgaagtacctgagccagttcggccccatcaacaaccacttcttctacgagagcttcggcctgtacgccgtggtggagttctgccagaaggagagcatcggcagcctgcagaacggcacccacacccccagcaccgccatggagaccgccatccccttcagaagcagattcttcaacctgaagctgaagaaccagaccagcgagagaagcagagtgagaagcagcaaccagctgcccagaagcaacaagcagctgttcgagctgctgtgctacgccgagagcatcgacgaccagctgaacaccctgctgaaggagttccagctgaccgaggagaacaccaagctgagatacctgacctgcagcctgatcgaggacatggccgccgcctacttccccgactgcatcgtgagacccttcggcagcagcgtgaacaccttcggcaagctgggctgcgacctggacatgttcctggacctggacgagaccagaaacctgagcgcccacaagatcagcggcaacttcctgatggagttccaggtgaagaacgtgcccagcgagagaatcgccacccagaagatcctgagcgtgctgggcgagtgcctggaccacttcggccccggctgcgtgggcgtgcagaagatcctgaacgccagatgccccctggtgagattcagccaccaggccagcggcttccagtgcgacctgaccaccaacaacagaatcgccctgaccagcagcgagctgctgtacatctacggcgccctggacagcagagtgagagccctggtgttcagcgtgagatgctgggccagagcccacagcctgaccagcagcatccccggcgcctggatcaccaacttcagcctgaccatgatggtgatcttcttcctgcagagaagaagcccccccatcctgcccaccctggacagcctgaagaccctggccgacgccgaggacaagtgcgtgatcgagggcaacaactgcaccttcgtgagagacctgagcagaatcaagcccagccagaacaccgagaccctggagctgctgctgaaggagttcttcgagtacttcggcaacttcgccttcgacaagaacagcatcaacatcagacagggcagagagcagaacaagcccgacagcagccccctgtacatccagaaccccttcgagaccagcctgaacatcagcaagaacgtgagccagagccagctgcagaagttcgtggacctggccagagagagcgcctggatcctgcagcaggaggacaccgacagacccagcatcagcagcaacagaccctggggcctggtgagcctgctgctgcccagcgcccccaacagaaagagcttcaccaagaagaagagcaacaagttcgccatcgagaccgtgaagaacctgctggagagcctgaagggcaacagaaccgagaacttcaccaagaccagcggcaagagaaccatcagcacccagacctag

SEQ ID NO: 89074 - DNA, 660 bp, Artificial Sequence
  Description of Artificial Sequence: Synthetic coding sequence
atgcagaacgagagaagagagcaggcccagagaaccgtgctgatccactgccccgagaagatcagcgagaacaagttcctgaagtacctgagccagttcggccccatcaacaaccacttcttctacgagagcttcggcctgtacgccgtggtggagttctgccagaaggagagcatcggcagcctgcagaacggcacccacacccccagcaccgccatggagaccgccatccccttcagaagcagattcttcaacctgaagctgaagaaccagaccagcgagagaagcagagtgagaagcagcaaccagctgcccagaagcaacaagcagctgttcgagctgctgtgctacgccgagagcatcgacgaccagctgaacaccctgctgaaggagttccagctgaccgaggagaacaccaagctgagatacctgacctgcagcctgatcgaggacatggccgccgcctacttccccgactgcatcgtgagacccttcggcagcagcgtgaacaccttcggcaagctgggctgcgacctggacatgttcctggacctggacgagaccagaaacctgagcgcccacaagatcagcggcaacttcctgatggagttccaggtgaagaacgtgcccagcgagagaatcgccacccagaagatctag

SEQ ID NO: 89075 - DNA, 453 bp, Artificial Sequence
  Description of Artificial Sequence: Synthetic coding sequence
gacctgagaagagacgagcagcccagcggcagcgtggagaccggcttcgaggacaagatccccaagagaagattcagcgagatgcagaacgagagaagagagcaggcccagagaaccgtgctgatccactgccccgagaagatcagcgagaacaagttcctgaagtacctgagccagttcggccccatcaacaaccacttcttctacgagagcttcggcctgtacgccgtggtggagttctgccagaaggagagcatcggcagcctgcagaacggcacccacacccccagcaccgccatggagaccgccatccccttcagaagcagattcttcaacctgaagctgaagaaccagaccagcgagagaagcagagtgagaagcagcaaccagctgcccagaagcaacaagcagctgttcgagctgctgtgctacgccgagagcgtgagcttctag

SEQ ID NO: 89076 - DNA, 309 bp, Artificial Sequence
  Description of Artificial Sequence: Synthetic coding sequence
atgttcctgaccgccctgctgtggagaggcagaatccccggcagacagtggatcggcaagcacagaagacccagattcgtgagcctgagagccaagcagaacatgatcagaagactggagatcgaggccgagaaccactactggctgagcatgccctacatgaccagagagcaggagagaggccacgccgccgtgagaagaagagaggccttcgaggccatcaaggccgccgccaccagcaagttccccccccacagattcatcgccgaccagctggaccacctgaacgtgaccaagaagtggagctag

SEQ ID NO: 89077 - DNA, 978 bp, Artificial Sequence
  Description of Artificial Sequence: Synthetic coding sequence
atggccgccgccgtgagatgcatgggcagagccctgatccaccaccagagacacagcctgagcaagatggtgtaccagaccagcctgtgcagctgcagcgtgaacatcagagtgcccaacagacacttcgccgccgccaccaagagcgccaagaagaccaagaagggcgccaaggagaagacccccgacgagaagaaggacgagatcgagaagatcaaggcctacccctacatggagggcgagcccgaggacgacgtgtacctgaagagactgtaccccagacagatctacgaggtggagaaggccgtgcacctgctgaagaagttccagatcctggacttcaccagccccaagcagagcgtgtacctggacctgaccctggacatggccctgggcaagaagaagaacgtggagcccttcaccagcgtgctgagcctgccctaccccttcgccagcgagatcaacaaggtggccgtgttcaccgagaacgccagcgaggtgaagatcgccgaggagaacggcgccgccttcgccggcggcaccagcctgatccagaagatctgggacgacgagatcgtggccgacttctacgtggccgtgcccgagatcatgcccgagctgaacagactgagaaagaagctgaacaagaagtaccccaagctgagcagaaacagcatcggcagagacatccccaagatgctggagctgttcaagaacggccacgagatcaaggtggacgaggagagagagaacttcctgcagaccaagatcgccaccctggacatgagcagcgaccagatcgccgccaacctgcaggccgtgatcaacgaggtgtgcagacacagacccctgaacctgggccccttcgtggtgagagccttcctgagaagcagcaccagcgagggcctgctgctgaagatcgaccccctgctgcccaaggaggtgaagaacgaggagagcgagaaggaggacgcctag

SEQ ID NO: 89078 - DNA, 909 bp, Artificial Sequence
  Description of Artificial Sequence: Synthetic coding sequence
atggtgtaccagaccagcctgtgcagctgcagcgtgaacatcagagtgcccaacagacacttcgccgccgccaccaagagcgccaagaagaccaagaagggcgccaaggagaagacccccgacgagaagaaggacgagatcgagaagatcaaggcctacccctacatggagggcgagcccgaggacgacgtgtacctgaagagactgtaccccagacagatctacgaggtggagaaggccgtgcacctgctgaagaagttccagatcctggacttcaccagccccaagcagagcgtgtacctggacctgaccctggacatggccctgggcaagaagaagaacgtggagcccttcaccagcgtgctgagcctgccctaccccttcgccagcgagatcaacaaggtggccgtgttcaccgagaacgccagcgaggtgaagatcgccgaggagaacggcgccgccttcgccggcggcaccagcctgatccagaagatctgggacgacgagatcgtggccgacttctacgtggccgtgcccgagatcatgcccgagctgaacagactgagaaagaagctgaacaagaagtaccccaagctgagcagaaacagcatcggcagagacatccccaagatgctggagctgttcaagaacggccacgagatcaaggtggacgaggagagagagaacttcctgcagaccaagatcgccaccctggacatgagcagcgaccagatcgccgccaacctgcaggccgtgatcaacgaggtgtgcagacacagacccctgaacctgggccccttcgtggtgagagccttcctgagaagcagcaccagcgagggcctgctgctgaagatcgaccccctgctgcccaaggagatcaagagccagcccaagaagaagaagaactag

SEQ ID NO: 89079 - DNA, 816 bp, Artificial Sequence
  Description of Artificial Sequence: Synthetic coding sequence
atgatcagcgcccactgcaacctgcacctgcccggcagcagcgacagccccgccagcgccagccaggtggccggcatcaccggcagactgcccaccctgcagaccgtgagatacggcagcaaggccgtgaccagacacagaagagtgatgcacttccagagacagaagctgatggccgtgaccgagtacatcccccccaagcccgccatccaccccagctgcctgcccagcccccccagccccccccaggaggagatcggcctgatcagactgctgagaagagagatcgccgccgtgttccaggacaacagaatgatcgccgtgtgccagaacgtggccctgagcgccgaggacaagctgctgatgagacaccagctgagaaagcacaagatcctgatgaaggtgttccccaaccaggtgctgaagcccttcctggaggacagcaagtaccagaacctgctgcccctgttcgtgggccacaacatgctgctggtgagcgaggagcccaaggtgaaggagatggtgagaatcctgagaaccgtgcccttcctgcccctgctgggcggctgcatcgacgacaccatcctgagcagacagggcttcatcaactacagcaagctgcccagcctgcccctggtgcagggcgagctggtgggcggcctgacctgcctgaccgcccagacccacagcctgctgcagcaccagcccctgcagctgaccaccctgctggaccagtacatcagagagcagagagagaaggacagcgtgatgagcgccaacggcaagcccgaccccgacaccgtgcccgacagctag

SEQ ID NO: 89080 - DNA, 786 bp, Artificial Sequence
  Description of Artificial Sequence: Synthetic coding sequence
atggccgccgccgtggccggcatgctgagaggcggcctgctgccccaggccggcagactgcccaccctgcagaccgtgagatacggcagcaaggccgtgaccagacacagaagagtgatgcacttccagagacagaagctgatggccgtgaccgagtacatcccccccaagcccgccatccaccccagctgcctgcccagcccccccagccccccccaggaggagatcggcctgatcagactgctgagaagagagatcgccgccgtgttccaggacaacagaatgatcgccgtgtgccagaacgtggccctgagcgccgaggacaagctgctgatgagacaccagctgagaaagcacaagatcctgatgaaggtgttccccaaccaggtgctgaagcccttcctggaggacagcaagtaccagaacctgctgcccctgttcgtgggccacaacatgctgctggtgagcgaggagcccaaggtgaaggagatggtgagaatcctgagaaccgtgcccttcctgcccctgctgggcggctgcatcgacgacaccatcctgagcagacagggcttcatcaactacagcaagctgcccagcctgcccctggtgcagggcgagctggtgggcggcctgacctgcctgaccgcccagacccacagcctgctgcagcaccagcccctgcagctgaccaccctgctggaccagtacatcagagagcagagagagaaggacagcgtgatgagcgccaacggcaagcccgaccccgacaccgtgcccgacagctag

SEQ ID NO: 89081 - DNA, 816 bp, Artificial Sequence; identical to SEQ ID NO: 89079
  Description of Artificial Sequence: Synthetic coding sequence

SEQ ID NO: 89082 - DNA, 579 bp, Artificial Sequence
  Description of Artificial Sequence: Synthetic coding sequence
atgagcaagctgggcagagccgccagaggcctgagaaagcccgaggtgggcggcgtgatcagagccatcgtgagagccggcctggccatgcccggcccccccctgggccccgtgctgggccagagaggcgtgagcatcaaccagttctgcaaggagttcaacgagagaaccaaggacatcaaggagggcatccccctgcccaccaagatcctggtgaagcccgacagaaccttcgagatcaagatcggccagcccaccgtgagctacttcctgaaggccgccgccggcatcgagaagggcgccagacagaccggcaaggaggtggccggcctggtgaccctgaagcacgtgtacgagatcgccagaatcaaggcccaggacgaggccttcgccctgcaggacgtgcccctgagcagcgtggtgagaagcatcatcggcagcgccagaagcctgggcatcagagtggtgaaggacctgagcagcgaggagctggccgccttccagaaggagagagccatcttcctggccgcccagaaggaggccgacctggccgcccaggaggaggccgccaagaagtag

SEQ ID NO: 89083 - DNA, 546 bp, Artificial Sequence
  Description of Artificial Sequence: Synthetic coding sequence
atgagcaagctgggcagagccgccagaggcctgagaaagcccgaggtgggcggcgtgatcagagccatcgtgagagccggcctggccatgcccggcccccccctgggccccgtgctgggccagagaggcgtgagcatcaaccagttctgcaaggagttcaacgagagaaccaaggacatcaaggagggcatccccctgcccaccaagatcctggtgaagcccgacagaaccttcgagatcaagatcggccagcccaccgtgagctacttcctgaaggccgccgccggcatcgagaagggcgccagacagaccggcaaggaggtggccggcctggtgaccctgaagcacgtgtacgagatcgccagaatcaaggcccaggacgaggccttcgccctgcaggacgtgcccctgagcagcgtggtgagaagcatcatcggcagcgccagaagcctgggcatcagagtggtgaaggagagatgcagcgccaacgtgctgagaaacggcaagatcagcatgaaggaccccagcggcagaagcagcgtgtag

SEQ ID NO: 89084 - DNA, 501 bp, Artificial Sequence
  Description of Artificial Sequence: Synthetic coding sequence
atgagcaagctgggcagagccgccagaggcctgagaaagcccgagagaggcgtgagcatcaaccagttctgcaaggagttcaacgagagaaccaaggacatcaaggagggcatccccctgcccaccaagatcctggtgaagcccgacagaaccttcgagatcaagatcggccagcccaccgtgagctacttcctgaaggccgccgccggcatcgagaagggcgccagacagaccggcaaggaggtggccggcctggtgaccctgaagcacgtgtacgagatcgccagaatcaaggcccaggacgaggccttcgccctgcaggacgtgcccctgagcagcgtggtgagaagcatcatcggcagcgccagaagcctgggcatcagagtggtgaaggacctgagcagcgaggagctggccgccttccagaaggagagagccatcttcctggccgcccagaaggaggccgacctggccgcccaggaggaggccgccaagaagtag

SEQ ID NO: 89085 - DNA, 891 bp, Artificial Sequence
  Description of Artificial Sequence: Synthetic coding sequence
atggccgccgaggccagagtgagcagatggtacttcggcggcctggccagctgcggcgccgcctgctgcacccaccccctggacctgctgaaggtgcacctgcagacccagcaggaggtgaagctgagaatgaccggcatggccctgagagtggtgagaaccgacggcatcctggccctgtacagcggcctgagcgccagcctgtgcagacagatgacctacagcctgaccagattcgccatctacgagaccgtgagagacagagtggccaagggcagccagggccccctgcccttccacgagaaggtgctgctgggcagcgtgagcggcctggccggcggcttcgtgggcacccccgccgacctggtgaacgtgagaatgcagaacgacgtgaagctgccccagggccagagaagaaactacgcccacgccctggacggcctgtacagagtggccagagaggagggcctgagaagactgttcagcggcgccaccatggccagcagcagaggcgccctggtgaccgtgggccagctgagctgctacgaccaggccaagcagctggtgctgagcaccggctacctgagcgacaacatcttcacccacttcgtggccagcttcatcgccgccgccggcgacgagccccccccccagggcggctgcgccaccttcctgtgccagcccctggacgtgctgaagaccagactgatgaacagcaagggcgagtaccagggcgtgttccactgcgccgtggagaccgccaagctgggccccctggccttctacaagggcctggtgcccgccggcatcagactgatcccccacaccgtgctgaccttcgtgttcctggagcagctgagaaagaacttcggcatcaaggtgcccagctag

SEQ ID NO: 89086 - DNA, 537 bp, Artificial Sequence
  Description of Artificial Sequence: Synthetic coding sequence
atgctgcccgccgccgccagacccctgtggggcccctgcctgggcctgagagccgccgccttcagactggccagaagacaggtgccctgcgtgtgcgccgtgagacacatgagaagcagcggccaccagagatgcgaggccctggccggcgcccccctggacaacgcccccaaggagtacccccccaagatccagcagctggtgcaggacatcgccagcctgaccctgctggagatcagcgacctgaacgagctgctgaagaagaccctgaagatccaggacgtgggcctggtgcccatgggcggcgtgatgagcggcgccgtgcccgccgccgccgcccaggaggccgtggaggaggacatccccatcgccaaggagagaacccacttcaccgtgagactgaccgaggccaagcccgtggacaaggtgaagctgatcaaggagatcaagaactacatcaaggccagcaccagcagcagacagagaagctggtggagcccctgccccggcaaccagagccagtgcagacagagctag

SEQ ID NO: 89087 - DNA, 597 bp, Artificial Sequence
  Description of Artificial Sequence: Synthetic coding sequence
atgctgcccgccgccgccagacccctgtggggcccctgcctgggcctgagagccgccgccttcagactggccagaagacaggtgccctgcgtgtgcgccgtgagacacatgagaagcagcggccaccagagatgcgaggccctggccggcgcccccctggacaacgcccccaaggagtacccccccaagatccagcagctggtgcaggacatcgccagcctgaccctgctggagatcagcgacctgaacgagctgctgaagaagaccctgaagatccaggacgtgggcctggtgcccatgggcggcgtgatgagcggcgccgtgcccgccgccgccgcccaggaggccgtggaggaggacatccccatcgccaaggagagaacccacttcaccgtgagactgaccgaggccaagcccgtggacaaggtgaagctgatcaaggagatcaagaactacatccagggcatcaacctggtgcaggccaagaagctggtggagagcctgccccaggagatcaaggccaacgtggccaaggccgaggccgagaagatcaaggccgccctggaggccgtgggcggcaccgtggtgctggagtag

SEQ ID NO: 89088 - DNA, 864 bp, Artificial Sequence
  Description of Artificial Sequence: Synthetic coding sequence
atggccgccgaggccagagtgagcagatggtacttcggcggcctggccagctgcggcgccgcctgctgcacccaccccctggacctgctgaaggtgcacctgcagacccagcaggaggtgaagctgagaatgaccggcatggccctgagagtggtgagaaccgacggcatcctggccctgtacagcggcctgagcgccagcctgtgcagacagatgacctacagcctgaccagattcgccatctacgagaccgtgagagacagagtggccaagggcagccagggccccctgcccttccacgagaaggtgctgctgggcagcgtgagcggcctggccggcggcttcgtgggcacccccgccgacctggtgaacgtgagaatgcagaacgacgtgaagctgccccagggccagagaagaaactacgcccacgccctggacggcctgtacagagtggccagagaggagggcctgagaagactgttcagcggcgccaccatggccagcagcagaggcgccctggtgaccgtgggccagctgagctgctacgaccaggccaagcagctggtgctgagcaccggctacctgagcgacaacatcttcacccacttcgtggccagcttcatcgccggcggctgcgccaccttcctgtgccagcccctggacgtgctgaagaccagactgatgaacagcaagggcgagtaccagggcgtgttccactgcgccgtggagaccgccaagctgggccccctggccttctacaagggcctggtgcccgccggcatcagactgatcccccacaccgtgctgaccttcgtgttcctggagcagctgagaaagaacttcggcatcaaggtgcccagctag

SEQ ID NO: 89089 - DNA, 1329 bp, Artificial Sequence
  Description of Artificial Sequence: Synthetic coding sequence
atgctgcccgccgccgccagacccctgtggggcccctgcctgggcctgagagccgccgccttcagactggccagaagacaggtgccctgcgtgtgcgccgtgagacacatgagaagcagcggccaccagagatgcgaggccctggccggcgcccccctggacaacgcccccaaggagtacccccccaagatccagcagctggtgcaggacatcgccagcctgaccctgctggagatcagcgacctgaacgagctgctgaagaagaccctgaagatccaggacgtgggcctggtgcccatgggcggcgtgatgagcggcgccgtgcccgccgccgccgcccaggaggccgtggaggaggacatccccatcgccaaggagagaacccacttcaccgtgagactgaccgaggccaagcccgtggacaaggtgaagctgatcaaggagatcaagaactacatccagggcatcaacctggtgcaggccaagaagctggtggagagcctgccccaggagatcaaggccaacgtggccaaggccgaggccgagaagatcaaggccgccctggaggccacccagcaggaggtgaagctgagaatgaccggcatggccctgagagtggtgagaaccgacggcatcctggccctgtacagcggcctgagcgccagcctgtgcagacagatgacctacagcctgaccagattcgccatctacgagaccgtgagagacagagtggccaagggcagccagggccccctgcccttccacgagaaggtgctgctgggcagcgtgagcggcctggccggcggcttcgtgggcacccccgccgacctggtgaacgtgagaatgcagaacgacgtgaagctgccccagggccagagaagaaactacgcccacgccctggacggcctgtacagagtggccagagaggagggcctgagaagactgttcagcggcgccaccatggccagcagcagaggcgccctggtgaccgtgggccagctgagctgctacgaccaggccaagcagctggtgctgagcaccggctacctgagcgacaacatcttcacccacttcgtggccagcttcatcgccggcggctgcgccaccttcctgtgccagcccctggacgtgctgaagaccagactgatgaacagcaagggcgagtaccagggcgtgttccactgcgccgtggagaccgccaagctgggccccctggccttctacaagggcctggtgcccgccggcatcagactgatcccccacaccgtgctgaccttcgtgttcctggagcagctgagaaagaacttcggcatcaaggtgcccagctag

SEQ ID NO: 89090 - DNA, 735 bp, Artificial Sequence
  Description of Artificial Sequence: Synthetic coding sequence
atgaccggcatggccctgagagtggtgagaaccgacggcatcctggccctgtacagcggcctgagcgccagcctgtgcagacagatgacctacagcctgaccagattcgccatctacgagaccgtgagagacagagtggccaagggcagccagggccccctgcccttccacgagaaggtgctgctgggcagcgtgagcggcctggccggcggcttcgtgggcacccccgccgacctggtgaacgtgagaatgcagaacgacgtgaagctgccccagggccagagaagaaactacgcccacgccctggacggcctgtacagagtggccagagaggagggcctgagaagactgttcagcggcgccaccatggccagcagcagaggcgccctggtgaccgtgggccagctgagctgctacgaccaggccaagcagctggtgctgagcaccggctacctgagcgacaacatcttcacccacttcgtggccagcttcatcgccggcggctgcgccaccttcctgtgccagcccctggacgtgctgaagaccagactgatgaacagcaagggcgagtaccagggcgtgttccactgcgccgtggagaccgccaagctgggccccctggccttctacaagggcctggtgcccgccggcatcagactgatcccccacaccgtgctgaccttcgtgttcctggagcagctgagaaagaacttcggcatcaaggtgcccagctag

SEQ ID NO: 89091 - DNA, 438 bp, Artificial Sequence
  Description of Artificial Sequence: Synthetic coding sequence
atggccttcttcaccggcctgtggggccccttcacctgcgtgagcagagtgctgagccaccactgcttcagcaccaccggcagcctgagcgccatccagaagatgaccagagtgagagtggtggacaacagcgccctgggcaacagcccctaccacagagcccccagatgcatccacgtgtacaagaagaacggcgtgggcaaggtgggcgaccagatcctgctggccatcaagggccagaagaagaaggccctgatcgtgggccactgcatgcccggccccagaatgacccccagattcgacagcaacaacgtggtgctgatcgaggacaacggcaaccccgtgggcaccagaatcaagacccccatccccaccagcctgagaaagagagagggcgagtacagcaaggtgctggccatcgcccagaacttcgtgtag

SEQ ID NO: 89092 - DNA, 891 bp, Artificial Sequence
  Description of Artificial Sequence: Synthetic coding sequence
atggccggccccctgcagggcggcggcgccagagccctggacctgctgagaggcctgcccagagtgagcctggccaacctgaagcccaaccccggcagcaagaagcccgagagaagacccagaggcagaagaagaggcagaaagtgcggcagaggccacaagggcgagagacagagaggcaccagacccagactgggcttcgagggcggccagacccccttctacatcagaatccccaagtacggcttcaacgagggccacagcttcagaagacagtacaagcccctgagcctgaacagactgcagtacctgatcgacctgggcagagtggaccccagccagcccatcgacctgacccagctggtgaacggcagaggcgtgaccatccagcccctgaagagagactacggcgtgcagctggtggaggagggcgccgacaccttcaccgccaaggtgaacatcgaggtgcagctggccagcgagctggccatcgccgccatcgagaagaacggcggcgtggtgaccaccgccttctacgaccccagaagcctggacatcgtgtgcaagcccgtgcccttcttcctgagaggccagcccatccccaagagaatgctgccccccgaggagctggtgccctactacaccgacgccaagaacagaggctacctggccgaccccgccaagttccccgaggccagactggagctggccagaaagtacggctacatcctgcccgacatcaccaaggacgagctgttcaagatgctgtgcaccagaaaggaccccagacagatcttcttcggcctggcccccggctgggtggtgaacatggccgacaagaagatcctgaagcccaccgacgagaacctgctgaagtactacaccagctag

SEQ ID NO: 89093 - DNA, 756 bp, Artificial Sequence
  Description of Artificial Sequence: Synthetic coding sequence
atgtggagactgctggccagagccagcgcccccctgctgagagtgcccctgagcgacagctgggccctgctgcccgccagcgccggcgtgaagaccctgctgcccgtgcccagcttcgaggacgtgagcatccccgagaagcccaagctgagattcatcgagagagcccccctggtgcccaaggtgagaagagagcccaagaacctgagcgacatcagaggccccagcaccgaggccaccgagttcaccgagggcaacttcgccatcctggccctgggcggcggctacctgcactggggccacttcgagatgatgagactgaccatcaacagaagcatggaccccaagaacatgttcgccatctggagagtgcccgcccccttcaagcccatcaccagaaagagcgtgggccacagaatgggcggcggcaagggcgccatcgaccactacgtgacccccgtgaaggccggcagactggtggtggagatgggcggcagatgcgagttcgaggaggtgcagggcttcctggaccaggtggcccacaagctgcccttcgccgccaaggccgtgagcagaggcaccctggagaagatgagaaaggaccaggaggagagagagagaaacaaccagaacccctggaccttcgagagaatcgccaccgccaacatgctgggcatcagaaaggtgctgagcccctacgacctgacccacaagggcaagtactggggcaagttctacatgcccaagagagtgtag

SEQ ID NO: 89094 - DNA, 528 bp, Artificial Sequence
  Description of Artificial Sequence: Synthetic coding sequence
atgagactgagcgtggccgccgccatcagccacggcagagtgttcagaagaatgggcctgggccccgagagcagaatccacctgctgagaaacctgctgaccggcctggtgagacacgagagaatcgaggccccctgggccagagtggacgagatgagaggctacgccgagaagctgatcgactacggcaagctgggcgacaccaacgagagagccatgagaatggccgacttctggctgaccgagaaggacctgatccccaagctgttccaggtgctggcccccagatacaaggaccagaccggcggctacaccagaatgctgcagatccccaacagaagcctggacagagccaagatggccgtgatcgagtacaagggcaactgcctgccccccctgcccctgcccagaagagacagccacctgaccctgctgaaccagctgctgcagggcctgagacaggacctgagacagagccaggaggccagcaaccacagcagccacaccgcccagacccccggcatctag

SEQ ID NO: 89095 - DNA, 543 bp, Artificial Sequence
  Description of Artificial Sequence: Synthetic coding sequence
atggccctgagaagcagattctggggcctgttcagcgtgtgcagaaaccccggctgcagattcgccgccctgagcaccagcagcgagcccgccgccaagcccgaggtggaccccgtggagaacgaggccgtggcccccgagttcaccaacagaaaccccagaaacctggagctgctgagcgtggccagaaaggagagaggctggagaaccgtgttccccagcagagagttctggcacagactgagagtgatcagaacccagcaccacgtggaggccctggtggagcaccagaacggcaaggtggtggtgagcgccagcaccagagagtgggccatcaagaagcacctgtacagcaccagaaacgtggtggcctgcgagagcatcggcagagtgctggcccagagatgcctggaggccggcatcaacttcatggtgtaccagcccaccccctgggaggccgccagcgacagcatgaagagactgcagagcgccatgaccgagggcggcgtggtgctgagagagccccagagaatctacgagtag

SEQ ID NO: 89096 - DNA, 879 bp, Artificial Sequence
  Description of Artificial Sequence: Synthetic coding sequence
atggccgcctgcatcgccgccggccactgggccgccatgggcctgggcagaagcttccaggccgccagaaccctgctgcccccccccgccagcatcgcctgcagagtgcacgccggccccgtgagacagcagagcaccggccccagcgagcccggcgccttccagcccccccccaagcccgtgatcgtggacaagcacagacccgtggagcccgagagaagattcctgagccccgagttcatccccagaagaggcagaaccgaccccctgaagttccagatcgagagaaaggacatgctggagagaagaaaggtgctgcacatccccgagttctacgtgggcagcatcctgagagtgaccaccgccgacccctacgccagcggcaagatcagccagttcctgggcatctgcatccagagaagcggcagaggcctgggcgccaccttcatcctgagaaacgtgatcgagggccagggcgtggagatctgcttcgagctgtacaaccccagagtgcaggagatccaggtggtgaagctggagaagagactggacgacagcctgctgtacctgagagacgccctgcccgagtacagcaccttcgacgtgaacatgaagcccgtggtgcaggagcccaaccagaaggtgcccgtgaacgagctgaaggtgaagatgaagcccaagccctggagcaagagatgggagagacccaacttcaacatcaagggcatcagattcgacctgtgcctgaccgagcagcagatgaaggaggcccagaagtggaaccagccctggctggagttcgacatgatgagagagtacgacaccagcaagatcgaggccgccatctggaaggagatcgaggccagcaagagaagctag

SEQ ID NO: 89097 - DNA, 879 bp, Artificial Sequence; identical to SEQ ID NO: 89096
  Description of Artificial Sequence: Synthetic coding sequence

SEQ ID NO: 89098 - DNA, 240 bp, Artificial Sequence
  Description of Artificial Sequence: Synthetic coding sequence
aaggtgcccgtgaacgagctgaaggtgaagatgaagcccaagccctggagcaagagatgggagagacccaacttcaacatcaagggcatcagattcgacctgtgcctgaccgagcagcagatgaaggaggcccagaagtggaaccagccctggctggagttcgacatgatgagagagtacgacaccagcaagatcgaggccgccatctggaaggagatcgaggccagcaagagaagctag

SEQ ID NO: 89099 - DNA, 918 bp, Artificial Sequence
  Description of Artificial Sequence: Synthetic coding sequence
atggccctgtgcgccctgaccagagccctgagaagcctgaacctggccccccccaccgtggccgcccccgcccccagcctgttccccgccgcccagatgatgaacaacggcctgctgcagcagcccagcgccctgatgctgctgccctgcagacccgtgctgaccagcgtggccctgaacgccaacttcgtgagctggaagagcagaaccaagtacaccatcacccccgtgaagatgagaaagagcggcggcagagaccacaccggcagaatcagagtgcacggcatcggcggcggccacaagcagagatacagaatgatcgacttcctgagattcagacccgaggagaccaagagcggccccttcgaggagaaggtgatccaggtgagatacgacccctgcagaagcgccgacatcgccctggtggccggcggcagcagaaagagatggatcatcgccaccgagaacatgcaggccggcgacaccatcctgaacagcaaccacatcggcagaatggccgtggccgccagagagggcgacgcccaccccctgggcgccctgcccgtgggcaccctgatcaacaacgtggagagcgagcccggcagaggcgcccagtacatcagagccgccggcacctgcggcgtgctgctgagaaaggtgaacggcaccgccatcatccagctgcccagcaagagacagatgcaggtgctggagacctgcgtggccaccgtgggcagagtgagcaacgtggaccacaacaagagagtgatcggcaaggccggcagaaacagatggctgggcaagagacccaacagcggcagatggcacagaaagggcggctgggccggcagaaagatcagacccctgccccccatgaagagctacgtgaagctgcccagcgccagcgcccagagctag

SEQ ID NO: 89100 - DNA, 450 bp, Artificial Sequence
  Description of Artificial Sequence: Synthetic coding sequence
atggtgttcctgaccgcccagctgtggctgagaaacagagtgaccgacagatacttcagaatccaggaggtgctgaagcacgccagacacttcagaggcagaaagaacagatgctacagactggccgtgagaaccgtgatcagagccttcgtgaagtgcaccaaggccagatacctgaagaagaagaacatgagaaccctgtggatcaacagaatcaccgccgccagccaggagcacggcctgaagtaccccgccctgatcggcaacctggtgaagtgccaggtggagctgaacagaaaggtgctggccgacctggccatctacgagcccaagaccttcaagagcctggccgccctggccagcagaagaagacacgagggcttcgccgccgccctgggcgacggcaaggagcccgagggcatcttcagcagagtggtgcagtaccactag

SEQ ID NO: 89101 - DNA, 618 bp, Artificial Sequence
  Description of Artificial Sequence: Synthetic coding sequence
atggccgccagcagcctgaccgtgaccctgggcagactggccagcgcctgcagccacagcatcctgagacccagcggccccggcgccgccagcctgtggagcgccagcagaagattcaacagccagagcaccagctacctgcccggctacgtgcccaagaccagcctgagcagccccccctggcccgaggtggtgctgcccgaccccgtggaggagaccagacaccacgccgaggtggtgaagaaggtgaacgagatgatcgtgaccggccagtacggcagactgttcgccgtggtgcacttcgccagcagacagtggaaggtgaccagcgaggacctgatcctgatcggcaacgagctggacctggcctgcggcgagagaatcagactggagaaggtgctgctggtgggcgccgacaacttcaccctgctgggcaagcccctgctgggcaaggacctggtgagagtggaggccaccgtgatcgagaagaccgagagctggcccagaatcatcatgagattcagaaagagaaagaacttcaagaagaagagaatcgtgaccaccccccagaccgtgctgagaatcaacagcatcgagatcgccccctgcctgctgtag

SEQ ID NO: 89102 - DNA, 843 bp, Artificial Sequence
  Description of Artificial Sequence: Synthetic coding sequence
atggccgccagcagcctgaccgtgaccctgggcagactggccagcgcctgcagccacagcatcctgagacccagcggccccggcgccgccagcctgtggagcgccagcagaagattcaacagccagagcaccagctacctgcccggctacgtgcccaagaccagcctgagcagccccccctggcccgaggtggtgctgcccgaccccgtggaggagaccagacaccacgccgaggtggtgaagaaggtgaacgagatgatcgtgaccggccagtacggcagactgttcgccgtggtgcacttcgccagcagacagtggaaggtgaccagcgaggacctgatcctgatcggcaacgagctggacctggcctgcggcgagagaatcagactggagaaggtgctgctggtgggcgccgacaacttcaccctgctgggcaagcccctgctgggcaaggacctggtgagagtggaggccaccgtgatcgagaagaccgagagctggcccagaatcatcatgagattcagaaagagaaagaacttcaagaagaagagaagcaagctggagaaggtgcccctgggccccgtggccagatgctggctgcccagaagaatgagaaccgagggcgtgggccacgtgggcctgggcaccggcagccccggcagaagccagcccggctgccactgccccctggccaccctgatcctggagggcgcccccagaggcagcagcctggcccccctgctgctgcacgcccccagagtgaccccccccagaagccccagcccccccagaagcgccagagaccccaccagcctgcccttcagcagcaccctgagagcctag

SEQ ID NO: 89103 - DNA, 363 bp, Artificial Sequence
  Description of Artificial Sequence: Synthetic coding sequence
atgatcgtgaccggccagtacggcagactgttcgccgtggtgcacttcgccagcagacagtggaaggtgaccagcgaggacctgatcctgatcggcaacgagctggacctggcctgcggcgagagaatcagactggagaaggtgctgctggtgggcgccgacaacttcaccctgctgggcaagcccctgctgggcaaggacctggtgagagtggaggccaccgtgatcgagaagaccgagagctggcccagaatcatcatgagattcagaaagagaaagaacttcaagaagaagagaatcgtgaccaccccccagaccgtgctgagaatcaacagcatcgagatcgccccctgcctgctgtag

SEQ ID NO: 89104 - DNA, 381 bp, Artificial Sequence
  Description of Artificial Sequence: Synthetic coding sequence
atgtggtacctggccaagctgatcagaggcatgagcatcgaccaggccctggcccagctggagttcaacgacaagaagggcgccaagatcatcaaggaggtgctgctggaggcccaggacatggccgtgagagaccacaacgtggagttcagaagcaacctgtacatcgccgagagcaccagcggcagaggccagtgcctgaagagaatcagataccacggcagaggcagattcggcatcatggagaaggtgtactgccactacttcgtgaagctggtggagggccccccccccccccccgagccccccaagaccgccgtggcccacgccaaggagtacatccagcagctgagaagcagaaccatcgtgcacaccctgtag

SEQ ID NO: 89105 - DNA, 699 bp, Artificial Sequence
  Description of Artificial Sequence: Synthetic coding sequence
atggccgccgccgtgctgggccagctgggcaaggacttcctggtggtgaagagacagaagggcgtggagatggagagcgagctgaccgcctgcgtggacgtggccggcgccctgtggatccacaacctgagaagcagaggcaagctggccctgggcgtgctgccccagagctacatccacaccagcgccagcctggacatcagcagaaagtgggagaagaagaacaagatcgtgtaccccccccagctgcccggcgagcccagaagacccgccgagatctaccactgcagaagacagatcaagtacagcaaggacaagatgtggtacctggccaagctgatcagaggcatgagcatcgaccaggccctggcccagctggagttcaacgacaagaagggcgccaagatcatcaaggaggtgctgctggaggcccaggacatggccgtgagagaccacaacgtggagttcagaagcaacctgtacatcgccgagagcaccagcggcagaggccagtgcctgaagagaatcagataccacggcagaggcagattcggcatcatggagaaggtgtactgccactacttcgtgaagctggtggagggccccccccccccccccgagccccccaagaccgccgtggcccacgccaaggagtacatccagcagctgagaagcagaaccatcgtgcacaccctgtag

SEQ ID NO: 89106 - DNA, 639 bp, Artificial Sequence
  Description of Artificial Sequence: Synthetic coding sequence
atggccgccgccgtgctgggccagctgggcgccctgtggatccacaacctgagaagcagaggcaagctggccctgggcctgctgagcttccacagcgtgctgccccagagctacatccacaccagcgccagcctggacatcagcagaaagtgggagaagaagaacaagatcgtgtaccccccccagctgcccggcgagcccagaagacccgccgagatctaccactgcagaagacagatcaagtacagcaaggacaagatgtggtacctggccaagctgatcagaggcatgagcatcgaccaggccctggcccagctggagttcaacgacaagaagggcgccaagatcatcaaggaggtgctgctggaggcccaggacatggccgtgagagaccacaacgtggagttcagaagcaacctgtacatcgccgagagcaccagcggcagaggccagtgcctgaagagaatcagataccacggcagaggcagattcggcatcatggagaaggtgtactgccactacttcgtgaagctggtggagggccccccccccccccccgagccccccaagaccgccgtggcccacgccaaggagtacatccagcagctgagaagcagaaccatcgtgcacaccctgtag

SEQ ID NO: 89107 - DNA, 621 bp, Artificial Sequence
  Description of Artificial Sequence: Synthetic coding sequence
atggccgccgccgtgctgggccagctgggcgccctgtggatccacaacctgagaagcagaggcaagctggccctgggcgtgctgccccagagctacatccacaccagcgccagcctggacatcagcagaaagtgggagaagaagaacaagatcgtgtaccccccccagctgcccggcgagcccagaagacccgccgagatctaccactgcagaagacagatcaagtacagcaaggacaagatgtggtacctggccaagctgatcagaggcatgagcatcgaccaggccctggcccagctggagttcaacgacaagaagggcgccaagatcatcaaggaggtgctgctggaggcccaggacatggccgtgagagaccacaacgtggagttcagaagcaacctgtacatcgccgagagcaccagcggcagaggccagtgcctgaagagaatcagataccacggcagaggcagattcggcatcatggagaaggtgtactgccactacttcgtgaagctggtggagggccccccccccccccccgagccccccaagaccgccgtggcccacgccaaggagtacatccagcagctgagaagcagaaccatcgtgcacaccctgtag

SEQ ID NO: 89108 - DNA, 462 bp, Artificial Sequence
  Description of Artificial Sequence: Synthetic coding sequence
atggccagaaacgtggtgtaccccctgtacagactgggcggcccccagctgagagtgttcagaaccaacttcttcatccagctggtgagacccggcgtggcccagcccgaggacaccgtgcagttcagaatccccatggagatgaccagagtggacctgagaaactacctggagggcatctacaacgtgcccgtggccgccgtgagaaccagagtgcagcacggcagcaacaagagaagagaccacagaaacgtgagaatcaagaagcccgactacaaggtggcctacgtgcagctggcccacggccagaccttcaccttccccgacctgttccccgagaaggacgagagccccgagggcagcgccgccgacgacctgtacagcatgctggaggaggagagacagcagagacagagcagcgaccccagaagaggcggcgtgcccagctggttcggcctgtag

SEQ ID NO: 89109 - DNA, 462 bp, Artificial Sequence; identical to SEQ ID NO: 89108
  Description of Artificial Sequence: Synthetic coding sequence

SEQ ID NO: 89110 - DNA, 651 bp, Artificial Sequence
  Description of Artificial Sequence: Synthetic coding sequence
atgagactgagcgccctgctggccctggccagcaaggtgaccctgcccccccactacagatacggcatgagcccccccggcagcgtggccgacaagagaaagaaccccccctggatcagaagaagacccgtggtggtggagcccatcagcgacgaggactggtacctgttctgcggcgacaccgtggagatcctggagggcaaggacgccggcaagcagggcaaggtggtgcaggtgatcagacagagaaactgggtggtggtgggcggcctgaacacccactacagatacatcggcaagaccatggactacagaggcaccatgatccccagcgaggcccccctgctgcacagacaggtgaagctggtggaccccatggacagaaagcccaccgagatcgagtggagattcaccgaggccggcgagagagtgagagtgagcaccagaagcggcagaatcatccccaagcccgagttccccagagccgacggcatcgtgcccgagacctggatcgacggccccaaggacaccagcgtggaggacgccctggagagaacctacgtgccctgcctgaagaccctgcaggaggaggtgatggaggccatgggcatcaaggagaccagaaagtacaagaaggtgtactggtactag

SEQ ID NO: 89111 - DNA, 651 bp, Artificial Sequence; identical to SEQ ID NO: 89110
  Description of Artificial Sequence: Synthetic coding sequence

SEQ ID NO: 89112 - DNA, 300 bp, Artificial Sequence
  Description of Artificial Sequence: Synthetic coding sequence
atgagactgagcgccctgctggccctggccagcaaggtgaccctgcccccccactacagatacggcatgagcccccccggcagcgtggccgacaagagaaagaaccccccctggatcagaagaagacccgtggtggtggagcccatcagcgacgaggactggtacctgttctgcggcgacaccgtggagatcctggagggcaaggacgccggcaagcagggcaaggtggtgcaggtgatcagacagagaaactgggtggtggtgggcggcctgaacacccactacagatacatcggctag

SEQ ID NO: 89113 - DNA, 207 bp, Artificial Sequence
  Description of Artificial Sequence: Synthetic coding sequence
atgagactgagcgccctgctggccctggccagcaaggtgaccctgcccccccactacagatacggcatgagcccccccggcagcgtggccgacaagagaaagaaccccccctggatcagaagaagacccgtggtggtggagcccatcagcgacgaggactggtacctgttctgcggcgacaccgtggagatcctggagggcaagtag

SEQ ID NO: 89114 - DNA, 522 bp, Artificial Sequence
  Description of Artificial Sequence: Synthetic coding sequence
atgagactgagcgccctgctggccctggccagcaaggtgaccctgcccccccactacagatacggcatgagcccccccggcagcgtggccgacaagagaaagaaccccccctggatcagaagaagacccgtggtggtggagcccatcagcgacgaggactggtacctgttctgcggcgacaccgtggagatcctggagggcaaggacgccggcaagcagggcaaggtggtgcaggtgatcagacagagaaactgggtggtggtgggcggcctgaacacccactacagatacatcggcaagaccatggactacagaggcaccatgatccccagcgaggcccccctgctgcacagacaggtgaagctggtggaccccatggacagaaagcccaccgagatcgagtggagattcaccgaggccggcgagagagtgagagtgagcaccagaagcggcagaatcatccccaagcccgagttccccagagccgacggcatcgtgcccgagacctggatcgacggctag

SEQ ID NO: 89115 - DNA, 4395 bp, Artificial Sequence
  Description of Artificial Sequence: Synthetic coding sequence
atgttcagcttcgtggacctgagactgctgctgctgctggccgccaccgccctgctgacccacggccaggaggagggccaggtggagggccaggacgaggacatcccccccatcacctgcgtgcagaacggcctgagataccacgacagagacgtgtggaagcccgagccctgcagaatctgcgtgtgcgacaacggcaaggtgctgtgcgacgacgtgatctgcgacgagaccaagaactgccccggcgccgaggtgcccgagggcgagtgctgccccgtgtgccccgacggcagcgagagccccaccgaccaggagaccaccggcgtggagggccccaagggcgacaccggccccagaggccccagaggccccgccggcccccccggcagagacggcatccccggccagcccggcctgcccggcccccccggcccccccggcccccccggcccccccggcctgggcggcaacttcgccccccagctgagctacggctacgacgagaagagcaccggcggcatcagcgtgcccggccccatgggccccagcggccccagaggcctgcccggcccccccggcgcccccggcccccagggcttccagggcccccccggcgagcccggcgagcccggcgccagcggccccatgggccccagaggcccccccggcccccccggcaagaacggcgacgacggcgaggccggcaagcccggcagacccggcgagagaggcccccccggcccccagggcgccagaggcctgcccggcaccgccggcctgcccggcatgaagggccacagaggcttcagcggcctggacggcgccaagggcgacgccggccccgccggccccaagggcgagcccggcagccccggcgagaacggcgcccccggccagatgggccccagaggcctgcccggcgagagaggcagacccggcgcccccggccccgccggcgccagaggcaacgacggcgccaccggcgccgccggcccccccggccccaccggccccgccggcccccccggcttccccggcgccgtgggcgccaagggcgaggccggcccccagggccccagaggcagcgagggcccccagggcgtgagaggcgagcccggcccccccggccccgccggcgccgccggccccgccggcaaccccggcgccgacggccagcccggcgccaagggcgccaacggcgcccccggcatcgccggcgcccccggcttccccggcgccagaggccccagcggcccccagggccccggcggcccccccggccccaagggcaacagcggcgagcccggcgcccccggcagcaagggcgacaccggcgccaagggcgagcccggccccgtgggcgtgcagggcccccccggccccgccggcgaggagggcaagagaggcgccagaggcgagcccggccccaccggcctgcccggcccccccggcgagagaggcggccccggcagcagaggcttccccggcgccgacggcgtggccggccccaagggccccgccggcgagagaggcagccccggccccgccggccccaagggcagccccggcgaggccggcagacccggcgaggccggcctgcccggcgccaagggcctgaccggcagccccggcagccccggccccgacggcaagaccggcccccccggccccgccggccaggacggcagacccggcccccccggcccccccggcgccagaggccaggccggcgtgatgggcttccccggccccaagggcgccgccggcgagcccggcaaggccggcgagagaggcgtgcccggcccccccggcgccgtgggccccgccggcaaggacggcgaggccggcgcccagggcccccccggccccgccggccccgccggcgagagaggcgagcagggccccgccggcagccccggcttccagggcctgcccggccccgccggcccccccggcgaggccggcaagcccggcgagcagggcgtgcccggcgacctgggcgcccccggccccagcggcgccagaggcgagagaggcttccccggcgagagaggcgtgcagggcccccccggccccgccggccccagaggcgccaacggcgcccccggcaacgacggcgccaagggcgacgccggcgcccccggcgcccccggcagccagggcgcccccggcctgcagggcatgcccggcgagagaggcgccgccggcctgcccggccccaagggcgacagaggcgacgccggccccaagggcgccgacggcagccccggcaaggacggcgtgagaggcctgaccggccccatcggcccccccggccccgccggcgcccccggcgacaagggcgagagcggccccagcggccccgccggccccaccggcgccagaggcgcccccggcgacagaggcgagcccggcccccccggccccgccggcttcgccggcccccccggcgccgacggccagcccggcgccaagggcgagcccggcgacgccggcgccaagggcgacgccggcccccccggccccgccggccccgccggcccccccggccccatcggcaacgtgggcgcccccggcgccaagggcgccagaggcagcgccggcccccccggcgccaccggcttccccggcgccgccggcagagtgggcccccccggccccagcggcaacgccggcccccccggcccccccggccccgccggcaaggagggcggcaagggccccagaggcgagaccggccccgccggcagacccggcgaggtgggcccccccggcccccccggccccgccggcgagaagggcagccccggcgccgacggccccgccggcgcccccggcacccccggcccccagggcatcgccggccagagaggcgtggtgggcctgcccggccagagaggcgagagaggcttccccggcctgcccggccccagcggcgagcccggcaagcagggccccagcggcgccagcggcgagagaggcccccccggccccatgggcccccccggcctggccggcccccccggcgagagcggcagagagggcgcccccggcgccgagggcagccccggcagagacggcagccccggcgccaagggcgacagaggcgagaccggccccgccggcccccccggcgcccccggcgcccccggcgcccccggccccgtgggccccgccggcaagagcggcgacagaggcgagaccggccccgccggccccaccggccccgtgggccccgtgggcgccagaggccccgccggcccccagggccccagaggcgacaagggcgagaccggcgagcagggcgacagaggcatcaagggccacagaggcttcagcggcctgcagggcccccccggcccccccggcagccccggcgagcagggccccagcggcgccagcggccccgccggccccagaggcccccccggcagcgccggcgcccccggcaaggacggcctgaacggcctgcccggccccatcggcccccccggccccagaggcagaaccggcgacgccggccccgtgggcccccccggcccccccggcccccccggcccccccggcccccccagcgccggcttcgacttcagcttcctgccccagcccccccaggagaaggcccacgacggcggcagatactacagagccgacgacgccaacgtggtgagagacagagacctggaggtggacaccaccctgaagagcctgagccagcagatcgagaacatcagaagccccgagggcagcagaaagaaccccgccagaacctgcagagacctgaagatgtgccacagcgactggaagagcggcgagtactggatcgaccccaaccagggctgcaacctggacgccatcaaggtgttctgcaacatggagaccggcgagacctgcgtgtaccccacccagcccagcgtggcccagaagaactggtacatcagcaagaaccccaaggacaagagacacgtgtggttcggcgagagcatgaccgacggcttccagttcgagtacggcggccagggcagcgaccccgccgacgtggccatccagctgaccttcctgagactgatgagcaccgaggccagccagaacatcacctaccactgcaagaacagcgtggcctacatggaccagcagaccggcaacctgaagaaggccctgctgctgcagggcagcaacgagatcgagatcagagccgagggcaacagcagattcacctacagcgtgaccgtggacggctgcaccagccacaccggcgcctggggcaagaccgtgatcgagtacaagaccaccaagaccagcagactgcccatcatcgacgtggcccccctggacgtgggcgcccccgaccaggagttcggcttcgacgtgggccccgtgtgcttcctgtag

SEQ ID NO: 89116 - DNA, 285 bp, Artificial Sequence
  Description of Artificial Sequence: Synthetic coding sequence
atggccagcgtggtgctggccctgagaaccagaaccgccgtgaccagcctgctgagccccacccccgccaccgccctggccgtgagatacgccagcaagaagagcggcggcagcagcaagaacctgggcggcaagagcagcggcagaagacagggcatcaagaagatggagggccactacgtgcacgccggcaacatcatcgccacccagagacacttcagatggcaccccggcgcccacgtgagctgcagcgtggccgcccccctgttccccttcctgggctag

SEQ ID NO: 89117 - DNA, 282 bp, Artificial Sequence
  Description of Artificial Sequence: Synthetic coding sequence
atggagggccactacgtgcacgccggcaacatcatcgccacccagagacacttcagatggcaccccggcgcccacgtgggcgtgggcaagaacaagtgcctgtacgccctggaggagggcatcgtgagatacaccaaggaggtgtacgtgccccaccccagaaacaccgaggccgtggacctgatcaccagactgcccaagggcgccgtgctgtacaagaccttcgtgcacgtggtgcccgccaagcccgagggcaccttcaagctggtggccatgctgtag

SEQ ID NO: 89118 - DNA, 282 bp, Artificial Sequence; identical to SEQ ID NO: 89117
  Description of Artificial Sequence: Synthetic coding sequence

SEQ ID NO: 89119 - DNA, 771 bp, Artificial Sequence
  Description of Artificial Sequence: Synthetic coding sequence
atgcccctgcacaagtaccccgtgtggctgtggaagagactgcagctgagagagggcatctgcagcagactgcccggccactacctgagaagcctggaggaggagagaacccccacccccgtgcactacagaccccacggcgccaagttcaagatcaaccccaagaacggccagagagagagagtggaggacgtgcccatccccatctacttcccccccgagagccagagaggcctgtggggcggcgagggctggatcctgggccagatctacgccaacaacgacaagctgagcaagagactgaagaaggtgtggaagccccagctgttcgagagagagttctacagcgagatcctggacaagaagttcaccgtgaccgtgaccatgagaaccctggacctgatcgacgaggcctacggcctggacttctacatcctgaagacccccaaggaggacctgtgcagcaagttcggcatggacctgaagagaggcatgctgctgagactggccagacaggacccccagctgcaccccgaggaccccgagagaagagccgccatctacgacaagtacaaggagttcgccatccccgaggaggaggccgagtgggtgggcctgaccctggaggaggccatcgagaagcagagactgctggaggagaaggaccccgtgcccctgttcaagatctacgtggccgagctgatccagcagctgcagcagcaggccctgagcgagcccgccgtggtgcagaagagagccagcggccagtag

SEQ ID NO: 89120 - DNA, 771 bp, Artificial Sequence; identical to SEQ ID NO: 89119
  Description of Artificial Sequence: Synthetic coding sequence

SEQ ID NO: 89121 - DNA, 771 bp, Artificial Sequence
  Description of Artificial Sequence: Synthetic coding sequence
atgcccctgcacaagtaccccgtgtggctgtggaagagactgcagctgagagagggcatctgcagcagactgcccggccactacctgagaagcctggaggaggagagaacccccacccccgtgcactacagaccccacggcgccaagttcaagatcaaccccaagaacggccagagagagagagtggaggacgtgcccatccccatctacttcccccccgagagccagagaggcctgtggggcggcgagggctggatcctgggccagatctacgccaacaacgacaagctgagcaagagactgaagaaggtgtggaagccccagctgttcgagagagagttctacagcgagatcctggacaagaagttcaccgtgaccgtgaccatgagaaccctggacctgatcgacgaggcctacggcctggacttctacatcctgaaggccagcggcgaggacctgtgcagcaagttcggcatggacctgaagagaggcatgctgctgagactggccagacaggacccccagctgcaccccgaggaccccgagagaagagccgccatctacgacaagtacaaggagttcgccatccccgaggaggaggccgagtgggtgggcctgaccctggaggaggccatcgagaagcagagactgctggaggagaaggaccccgtgcccctgttcaagatctacgtggccgagctgatccagcagctgcagcagcaggccctgagcgagcccgccgtggtgcagaagagagccagcggccagtag

SEQ ID NO: 89122 - DNA, 771 bp, Artificial Sequence; identical to SEQ ID NO: 89121
  Description of Artificial Sequence: Synthetic coding sequence

SEQ ID NO: 89123 - DNA, 147 bp, Artificial Sequence
  Description of Artificial Sequence: Synthetic coding sequence
atgagcagagccggcggcagaggcgagcagagcagatggggcagaagagccgagctgagaggcctgggcagacccgaggcccccctgagactgggccccgacgtgtgcggcagcgtgccctgcgccagaggcgccggcagcgagtag

SEQ ID NO: 89124 - DNA, 723 bp, Artificial Sequence
  Description of Artificial Sequence: Synthetic coding sequence
atgcccctgcacaagtaccccgtgtggctgtggaagagactgcagctgagagagggcatctgcagcagactgcccggccactacctgagaagcctggaggaggagagaacccccacccccgtgcactacagaccccacggcgccaagttcaagatcaaccccaagaacggccagagagagagagtggaggacgtgcccatccccatctacttcccccccgagagccagagaggcctgtggggcggcgagggctggatcctgggccagatctacgccaacaacgacaagctgagcaagagactgaagaaggtgtggaagccccagctgttcgagagagagttctacagcgagatcctggacaagaagttcaccgtgaccgtgaccatgagaaccctggacctgatcgacgaggcctacggcctggacttctacatcctgaagacccccaaggaggacctgtgcagcaagttcggcatggacctgaagagaggcatgctgctgagactggccagacaggacccccagctgcaccccgaggaccccgagagaagagccgccatctacgacaagtacaaggagttcgccatccccgaggaggaggccgagtgggtgggcctgaccctggaggaggccatcgagaagcagagactgctggaggagaaggaccccgtgcccctgttcaagatctacgtggccgagctgatccagcagctgcagcagtag

SEQ ID NO: 89125 - DNA, 657 bp, Artificial Sequence
  Description of Artificial Sequence: Synthetic coding sequence
atgcccctgcacaagtaccccgtgtggctgtggaagagactgcagctgagagagggcatctgcagcagactgcccggccactacctgagaagcctggaggaggagagaacccccacccccgtgcactacagaccccacggcgccaagttcaagatcaaccccaagaacggccagagagagagagtggaggacgtgcccatccccatctacttcccccccgagagccagagaggcctgtggggcggcgagggctggatcctgggccagatctacgccaacaacgacaagctgagcaagagactgaagaaggtgtggaagccccagctgttcgagagagagttctacagcgagatcctggacaagaagttcaccgtgaccgtgaccatgagaaccctggacctgatcgacgaggcctacggcctggacttctacatcctgaagacccccaaggaggacctgtgcagcaagttcggcatggacctgaagagaggcatgctgctgagactggccagacaggacccccagctgcaccccgaggaccccgagagaagagccgccatctacgacaagtacaaggagttcgccatccccgaggaggaggccgagtgggtgggcctgaccctggaggaggccatcgagaagcagagactgctgtag

SEQ ID NO: 89126 - DNA, 585 bp, Artificial Sequence
  Description of Artificial Sequence: Synthetic coding sequence
atgcccctgcacaagtaccccgtgtggctgtggaagagactgcagctgagagagggcatctgcagcagactgcccggccactacctgagaagcctggaggaggagagaacccccacccccgtgcactacagaccccacggcgccaagttcaagatcaaccccaagaacggccagagagagagagtggaggacgtgcccatccccatctacttcccccccgagagccagagaggcctgtggggcggcgagggctggatcctgggccagatctacgccaacaacgacaagctgagcaagagactgaagaaggtgtggaagccccagctgttcgagagagagttctacagcgagatcctggacaagaagttcaccgtgaccgtgaccatgagaaccctggacctgatcgacgaggcctacggcctggacttctacatcctgaagacccccaaggaggacctgtgcagcaagttcggcatggacctgaagagaggcatgctgctgagactggccagacaggacccccagctgcaccccgaggaccccgagagaagagccgccatctacgacaagtacaaggagttctag

SEQ ID NO: 89127 - DNA, 1047 bp, Artificial Sequence
  Description of Artificial Sequence: Synthetic coding sequence
atgcccggctggagactgctgacccaggtgggcgcccaggtgctgggcagactgggcgacggcctgggcgccgccctgggccccggcaacagaacccacatctggctgttcgtgagaggcctgcacggcaagagcggcacctggtgggacgagcacctgagcgaggagaacgtgcccttcatcaagcagctggtgagcgacgaggacaaggcccagctggccagcaagctgtgccccctgaaggacgagccctggcccatccacccctgggagcccggcagcttcagagtgggcctgatcgccctgaagctgggcatgatgcccctgtggaccaaggacggccagaagcacgtggtgaccctgctgcaggtgcaggactgccacgtgctgaagtacaccagcaaggagaactgcaacggcaagatggccaccctgagcgtgggcggcaagaccgtgagcagattcagaaaggccaccagcatcctggagttctacagagagctgggcctgccccccaagcagaccgtgaagatcttcaacatcaccgacaacgccgccatcaagcccggcacccccctgtacgccgcccacttcagacccggccagtacgtggacgtgaccgccaagaccatcggcaagggcttccagggcgtgatgaagagatggggcttcaagggccagcccgccacccacggccagaccaagacccacagaagacccggcgccgtggccaccggcgacatcggcagagtgtggcccggcaccaagatgcccggcaagatgggcaacatctacagaaccgagtacggcctgaaggtgtggagaatcaacaccaagcacaacatcatctacgtgaacggcagcgtgcccggccacaagaactgcctggtgaaggtgaaggacagcaagctgcccgcctacaaggacctgggcaagaacctgcccttccccacctacttccccgacggcgacgaggaggagctgcccgaggacctgtacgacgagaacgtgtgccagcccggcgcccccagcatcaccttcgcctag

SEQ ID NO: 89128 - DNA, 1128 bp, Artificial Sequence
  Description of Artificial Sequence: Synthetic coding sequence
atgcccggctggagactgctgacccaggtgggcgcccaggtgctgggcagactgggcgacggcctgggcgccgccctgggccccggcaacagagtgaccaccaacagcctgaacgtgagcctgatcagaagaaacgtgggcagcgaggagaaggtgggcgacctgaagaagagaacccacatctggctgttcgtgagaggcctgcacggcaagagcggcacctggtgggacgagcacctgagcgaggagaacgtgcccttcatcaagcagctggtgagcgacgaggacaaggcccagctggccagcaagctgtgccccctgaaggacgagccctggcccatccacccctgggagcccggcagcttcagagtgggcctgatcgccctgaagctgggcatgatgcccctgtggaccaaggacggccagaagcacgtggtgaccctgctgcaggtgcaggactgccacgtgctgaagtacaccagcaaggagaactgcaacggcaagatggccaccctgagcgtgggcggcaagaccgtgagcagattcagaaaggccaccagcatcctggagttctacagagagctgggcctgccccccaagcagaccgtgaagatcttcaacatcaccgacaacgccgccatcaagcccggcacccccctgtacgccgcccacttcagacccggccagtacgtggacgtgaccgccaagaccatcggcaagggcttccagggcgtgatgaagagatggggcttcaagggccagcccgccacccacggccagaccaagacccacagaagacccggcgccgtggccaccggcgacatcggcagagtgtggcccggcaccaagatgcccggcaagatgggcaacatctacagaaccgagtacggcctgaaggtgtggagaatcaacaccaagcacaacatcatctacgtgaacggcagcgtgcccggccacaagaactgcctggtgaaggtgaaggacagcaagctgcccgcctacaaggacctgggcaagaacctgcccttccccacctacttccccgacggcgacgaggaggagctgcccgaggacctgtacgacgagaacgtgtgccagcccggcgcccccagcatcaccttcgcctag

SEQ ID NO: 89129 - DNA, 1092 bp, Artificial Sequence
  Description of Artificial Sequence: Synthetic coding sequence
tgattcttccccagccagagagccagcgccggcgacagaagcggcggccactgcgagaacttccccaccgccaccgccagcacctggagatggagaggcgacagcctgaaggccgagagacagggcgccagaaagagcacccacatctggctgttcgtgagaggcctgcacggcaagagcggcacctggtgggacgagcacctgagcgaggagaacgtgcccttcatcaagcagctggtgagcgacgaggacaaggcccagctggccagcaagctgtgccccctgaaggacgagccctggcccatccacccctgggagcccggcagcttcagagtgggcctgatcgccctgaagctgggcatgatgcccctgtggaccaaggacggccagaagcacgtggtgaccctgctgcaggtgcaggactgccacgtgctgaagtacaccagcaaggagaactgcaacggcaagatggccaccctgagcgtgggcggcaagaccgtgagcagattcagaaaggccaccagcatcctggagttctacagagagctgggcctgccccccaagcagaccgtgaagatcttcaacatcaccgacaacgccgccatcaagcccggcacccccctgtacgccgcccacttcagacccggccagtacgtggacgtgaccgccaagaccatcggcaagggcttccagggcgtgatgaagagatggggcttcaagggccagcccgccacccacggccagaccaagacccacagaagacccggcgccgtggccaccggcgacatcggcagagtgtggcccggcaccaagatgcccggcaagatgggcaacatctacagaaccgagtacggcctgaaggtgtggagaatcaacaccaagcacaacatcatctacgtgaacggcagcgtgcccggccacaagaactgcctggtgaaggtgaaggacagcaagctgcccgcctacaaggacctgggcaagaacctgcccttccccacctacttccccgacggcgacgaggaggagctgcccgaggacctgtacgacgagaacgtgtgccagcccggcgcccccagcatcaccttcgcctag

SEQ ID NO: 89130 - DNA, 486 bp, Artificial Sequence
  Description of Artificial Sequence: Synthetic coding sequence
atggccggcatcctgagactggtggtgcagtggccccccggcagactgcagaccgtgaccaagggcgtggagagcctgatctgcaccgactggatcagacacaagttcaccagaagcagaatccccgagaaggtgttccaggccagccccgaggaccacgagaagtacggcggcgacccccagaacccccacaagctgcacatcgtgaccagaatcaagagcaccagaagaagaccctactgggagaaggacatcatcaagatgctgggcctggagaaggcccacaccccccaggtgcacaagaacatccccagcgtgaacgccaagctgaaggtggtgaagcacctgatcagaatcaagcccctgaagctgccccagggcctgcccgccgaggagaacatgagcaacacctgcctgaagagcaccggcgagctggtggtgcagtggcacctgaagcccgtggagcagaaggcccacgagagctag

SEQ ID NO: 89131 - DNA, 486 bp, Artificial Sequence; identical to SEQ ID NO: 89130
  Description of Artificial Sequence: Synthetic coding sequence

SEQ ID NO: 89132 - DNA, 705 bp, Artificial Sequence
  Description of Artificial Sequence: Synthetic coding sequence
atggccgagagaggctacagcttcagcctgaccaccttcagccccagcggcaagctggtgcagatcgagtacgccctggccgccgtggccggcggcgcccccagcgtgggcatcaaggccgccaacggcgtggtgctggccaccgagaagaagcagaagagcatcctgtacgacgagagaagcgtgcacaaggtggagcccatcaccaagcacatcggcctggtgtacagcggcatgggccccgactacagagtgctggtgcacagagccagaaagctggcccagcagtactacctggtgtaccaggagcccatccccaccgcccagctggtgcagagagtggccagcgtgatgcaggagtacacccagagcggcggcgtgagacccttcggcgtgagcctgctgatctgcggctggaacgagggcagaccctacctgttccagagcgaccccagcggcgcctacttcgcctggaaggccaccgccatgggcaagaactacgtgaacggcaagaccttcctggagaagagatacaacgaggacctggagctggaggacgccatccacaccgccatcctgaccctgaaggagagcttcgagggccagatgaccgaggacaacatcgaggtgggcatctgcaacgaggccggcttcagaagactgacccccaccgaggtgaaggactacctggccgccatcgcctag

SEQ ID NO: 89133 - DNA, 324 bp, Artificial Sequence
  Description of Artificial Sequence: Synthetic coding sequence
atggccctggccatgctggtgctggtggtgagcccctggagcgccgccagaggcgtgctgagaaactactgggagagactgctgagaaagctgccccagagcagacccggcttccccagccccccctggggccccgccctggccgtgcagggccccgccatgttcaccgagcccgccaacgacaccagcggcagcaaggagaacagcagcctgctggacagcatcttctggatggccgcccccaagaacagaagaaccatcgaggtgaacagatgcagaagaagaaacccccagaagctgatcaaggtgaaggtgatgcactag

SEQ ID NO: 89134 - DNA, 279 bp, Artificial Sequence
  Description of Artificial Sequence: Synthetic coding sequence
atggccgtgctggccggcagcctgctgggccccaccagcagaagcgccgccctgctgggcggcagatggctgcagcccagagcctggctgggcttccccgacgcctggggcctgcccaccccccagcaggccagaggcaaggccagaggcaacgagtaccagcccagcaacatcaagagaaagaacaagcacggctgggtgagaagactgagcacccccgccggcgtgcaggtgatcctgagaagaatgctgaagggcagaaagagcctgagccactag

SEQ ID NO: 89135 - DNA, 513 bp, Artificial Sequence
  Description of Artificial Sequence: Synthetic coding sequence
atggccgccagcgccttcgccggcgccgtgagagccgccagcggcatcctgagacccctgaacatcctggccagcagcacctacagaaactgcgtgaagaacgccagcctgatcagcgccctgagcaccggcagattcagccacatccagacccccgtggtgagcagcacccccagactgaccaccagcgagagaaacctgacctgcggccacaccagcgtgatcctgaacagaatggcccccgtgctgcccagcgtgctgaagctgcccgtgagaagcctgacctacttcagcgccagaaagggcaagagaaagaccgtgaaggccgtgatcgacagattcctgagactgcactgcggcctgtgggtgagaagaaaggccggctacaagaagaagctgtggaagaagacccccgccagaaagaagagactgagagagttcgtgttctgcaacaagacccagagcaagctgctggacaagatgaccaccagcttctggaagagaagaaactag

SEQ ID NO: 89136 - DNA, 567 bp, Artificial Sequence
  Description of Artificial Sequence: Synthetic coding sequence
atggccgccagcgccttcgccggcgccgtgagagccgccagcggcatcctgagacccctgaacatcctggccagcagcacctacagaaactgcgtgaagaacgccagcctgatcagcgccctgagcaccggcagattcagccacatccagacccccgtggtgagcagcacccccagactgaccaccagcgagagaaacctgacctgcggccacaccagcgtgatcctgaacagaatggcccccgtgctgcccagcgtgctgaagctgcccgtgagaagcctgacctacttcagcgccagaaagggcaagagaaagaccgtgaaggccgtgatcgacagattcctgagactgcactgcggcctgtgggtgagaagaaaggccggctacaagaagaagctgtggaagaagacccccgccagaaagaagagactgagagagttcgtgttctgcaacaagacccagagcaagctgctggacaagatgaccaccagcttctggaagagaagaaactggtacgtggacgacccctaccagaagtaccacgacagaaccaacctgaaggtgtag

SEQ ID NO: 89137 - DNA, 312 bp, Artificial Sequence
  Description of Artificial Sequence: Synthetic coding sequence
atggccaacctgttcatcagaaagatggtgaaccccctgctgtacctgagcagacacaccgtgaagcccagagccctgagcaccttcctgttcggcagcatcagaggcgccgcccccgtggccgtggagcccggcgccgccgtgagaagcctgctgagccccggcctgctgccccacctgctgcccgccctgggcttcaagaacaagaccgtgctgaagaagagatgcaaggactgctacctggtgaagagaagaggcagatggtacgtgtactgcaagacccaccccagacacaagcagagacagatgtag

SEQ ID NO: 89138 - DNA, 312 bp, Artificial Sequence; identical to SEQ ID NO: 89137
  Description of Artificial Sequence: Synthetic coding sequence

SEQ ID NO: 89139 - DNA, 312 bp, Artificial Sequence; identical to SEQ ID NO: 89137
  Description of Artificial Sequence: Synthetic coding sequence

SEQ ID NO: 89140 - DNA, 312 bp, Artificial Sequence; identical to SEQ ID NO: 89137
  Description of Artificial Sequence: Synthetic coding sequence

SEQ ID NO: 89141 - DNA, 1251 bp, Artificial Sequence
  Description of Artificial Sequence: Synthetic coding sequence
atgcacttcgtgccctggctggccagacccatcttccccccctgggacagaggctacaaggaccccagattctacagaagcccccccctgcacgagcaccccctgtacaaggaccaggcctgctacatcttccaccacagatgcagactgctggagggcgtgaagcaggccctgtggctgaccaagaccaagctgatcgagggcctgcccgagaaggtgctgagcctggtggacgaccccagaaaccacatcgagaaccaggacgagtgcgtgctgaacgtgatcagccacgccagactgtggcagaccaccgaggagatccccaagagagagacctactgccccgtgatcgtggacaacctgatccagctgtgcaagagccagatcctgaagcaccccagcctggccagaagaatctgcgtgcagaacagcaccttcagcgccacctggaacagagagagcctgctgctgcaggtgagaggcagcggcggcgccagactgagcaccaaggaccccctgcccaccatcgccagcagagaggagatcgaggccaccaagaaccacgtgctggagaccttctaccccatcagccccatcatcgacctgcacgagtgcaacatctacgacgtgaagaacgacaccggcttccaggagggctacccctacccctacccccacaccctgtacctgctggacaaggccaacctgagaccccacagactgcagcccgaccagctgagagccaagatgatcctgttcgccttcggcagcgccctggcccaggccagactgctgtacggcaacgacgccaaggtgctggagcagcccgtggtggtgcagagcgtgggcaccgacggcagagtgttccacttcctggtgttccagctgaacaccaccgacctggactgcaacgagggcgtgaagaacctggcctgggtggacagcgaccagctgctgtaccagcacttctggtgcctgcccgtgatcaagaagagagtggtggtgaccggcccctgcttcagcaagagccagatgagcaccagcttcgtgctgacccccagcttcaacgccggcgaggaggtgatgcagagaaacctgagagccagcgccagcctgccccccagcaccggcagccccgccagcgagctggtgaaggagcaggagcacgccgccggcagagtgctgagaagagtgatgctggacagcgagacccccagagaggagctgcccgccgccgacttctggaagtag

SEQ ID NO: 89142 - DNA, 879 bp, Artificial Sequence
  Description of Artificial Sequence: Synthetic coding sequence
atgagcggcgcctgcgcccccagaggcagcagaagcctgctgccctggatcggctgcaccagaagcctggactggagccccagccccctgagaggcagatgcaccagctgccccggctggagaggcagaagcttcagacccggcaccgccgccaccagaacccagggcagcaccgccagacccctgttcaccagcatcagatgcaccaagaccagacccgccatcagcttcaccaccgtggccgccttcagcagaagcctgctgctgcaggtgagaggcagcggcggcgccagactgagcaccaaggaccccctgcccaccatcgccagcagagaggagatcgaggccaccaagaaccacgtgctggagaccttctaccccatcagccccatcatcgacctgcacgagtgcaacatctacgacgtgaagaacgacaccggcttccaggagggctacccctacccctacccccacaccctgtacctgctggacaaggccaacctgagaccccacagactgcagcccgaccagctgagagccaagatgatcctgttcgccttcggcagcgccctggcccaggccagactgctgtacggcaacgacgccaaggtgctggagcagcccgtggtggtgcagagcgtgggcaccgacggcagagtgttccacttcctggtgttccagctgaacaccaccgacctggactgcaacgagggcgtgaagaacctggcctgggtggacagcgaccagctgctgtaccagcacttctggtgcctgcccgtgatcaagaagagagtggtggtggagcccgtgggccccgtgggcttcaagcccgagaccttcagaaagttcctggccctgtacctgcacggcgccgcctag

SEQ ID NO: 89143 - DNA, 1272 bp, Artificial Sequence
  Description of Artificial Sequence: Synthetic coding sequence
atggccctggccagcggccccgccagaagagccctggccggcagcggccagctgggcctgggcggcttcggcgcccccagaagaggcgcctacgagtggggcgtgagaagcaccagaaagagcgagcccccccccctggacagagtgtacgagatccccggcctggagcccatcaccttcgccggcaagatgcacttcgtgccctggctggccagacccatcttccccccctgggacagaggctacaaggaccccagattctacagaagcccccccctgcacgagcaccccctgtacaaggaccaggcctgctacatcttccaccacagatgcagactgctggagggcgtgaagcaggccctgtggctgaccaagaccaagctgatcgagggcctgcccgagaaggtgctgagcctggtggacgaccccagaaaccacatcgagaaccaggacgagtgcgtgctgaacgtgatcagccacgccagactgtggcagaccaccgaggagatccccaagagagagacctactgccccgtgatcgtggacaacctgatccagctgtgcaagagccagatcctgaagcaccccagcctggccagaagaatctgcgtgcagaacagcaccttcagcgccacctggaacagagagagcctgctgctgcaggtgagaggcagcggcggcgccagactgagcaccaaggaccccctgcccaccatcgccagcagagaggagatcgaggccaccaagaaccacgtgctggagaccttctaccccatcagccccatcatcgacctgcacgagtgcaacatctacgacgtgaagaacgacaccggcttccaggagggctacccctacccctacccccacaccctgtacctgctggacaaggccaacctgagaccccacagactgcagcccgaccagctgagagccaagatgatcctgttcgccttcggcagcgccctggcccaggccagactgctgtacggcaacgacgccaaggtgctggagcagcccgtggtggtgcagagcgtgggcaccgacggcagagtgttccacttcctggtgttccagctgaacaccaccgacctggactgcaacgagggcgtgaagaacctggcctgggtggacagcgaccagctgctgtaccagcacttctggtgcctgcccgtgatcaagaagagagtggtggtggagcccgtgggccccgtgggcttcaagcccgagaccttcagaaagttcctggccctgtacctgcacggcgccgcctag

SEQ ID NO: 89144 - DNA, 795 bp, Artificial Sequence
  Description of Artificial Sequence: Synthetic coding sequence
tgaagcctgctgctgcaggtgagaggcagcggcggcgccagactgagcaccaaggaccccctgcccaccatcgccagcagagaggagatcgaggccaccaagaaccacgtgctggagaccttctaccccatcagccccatcatcgacctgcacgagtgcaacatctacgacgtgaagaacgacaccggcttccaggagggctacccctacccctacccccacaccctgtacctgctggacaaggccaacctgagaccccacagactgcagcccgaccagctgagagccaagatgatcctgttcgccttcggcagcgccctggcccaggccagactgctgtacggcaacgacgccaaggtgctggagcagcccgtggtggtgcagagcgtgggcaccgacggcagagtgttccacttcctggtgttccagctgaacaccaccgacctggactgcaacgagggcgtgaagaacctggcctgggtggacagcgaccagctgctgtaccagcacttctggtgcctgcccgtgatcaagaagagagtggtggtgaccggcccctgcttcagcaagagccagatgagcaccagcttcgtgctgacccccagcttcaacgccggcgaggaggtgatgcagagaaacctgagagccagcgccagcctgccccccagcaccggcagccccgccagcgagctggtgaaggagcaggagcacgccgccggcagagtgctgagaagagtgatgctggacagcgagacccccagagaggagctgcccgccgccgacttctggaagtag

SEQ ID NO: 89145 - DNA, 1143 bp, Artificial Sequence
  Description of Artificial Sequence: Synthetic coding sequence
atggccgccccctggtggagagccgccctgtgcgagtgcagaagatggagaggcttcagcaccagcgccgtgctgggcagaagaaccccccccctgggccccatgcccaacagcgacatcgacctgagcaacctggagagactggagaagtacagaagcttcgacagatacagaagaagagccgagcaggaggcccaggccccccactggtggagaacctacagagagtacttcggcgagaagaccgaccccaaggagaagatcgacatcggcctgcccccccccaaggtgagcagaacccagcagctgctggagagaaagcaggccatccaggagctgagagccaacgtggaggaggagagagccgccagactgagaaccgccagcgtgcccctggacgccgtgagagccgagtgggagagaacctgcggcccctaccacaagcagagactggccgagtactacggcctgtacagagacctgttccacggcgccaccttcgtgcccagagtgcccctgcacgtggcctacgccgtgggcgaggacgacctgatgcccgtgtactgcggcaacgaggtgacccccaccgaggccgcccaggcccccgaggtgacctacgaggccgaggagggcagcctgtggaccctgctgctgaccagcctggacggccacctgctggagcccgacgccgagtacctgcactggctgctgaccaacatccccggcaacagagtggccgagggccaggtgacctgcccctacctgccccccttccccgccagaggcagcggcatccacagactggccttcctgctgttcaagcaggaccagcccatcgacttcagcgaggacgccagacccagcccctgctaccagctggcccagagaaccttcagaaccttcgacttctacaagaagcaccaggagaccatgacccccgccggcctgagcttcttccagtgcagatgggacgacagcgtgacctacatcttccaccagctgctggacatgagagagcccgtgttcgagttcgtgagaccccccccctaccaccccaagcagaagagattcccccacagacagcccctgagatacctggacagatacagagacagccacgagcccacctacggcatctactag

SEQ ID NO: 89146 - DNA, 591 bp, Artificial Sequence
  Description of Artificial Sequence: Synthetic coding sequence
atgcccgtgtactgcggcaacgaggtgacccccaccgaggccgcccaggcccccgaggtgacctacgaggccgaggagggcagcctgtggaccctgctgctgaccagcctggacggccacctgctggagcccgacgccgagtacctgcactggctgctgaccaacatccccggcaacagagtggccgagggccaggtgacctgcccctacctgccccccttccccgccagaggcagcggcatccacagactggccttcctgctgttcaagcaggaccagcccatcgacttcagcgaggacgccagacccagcccctgctaccagctggcccagagaaccttcagaaccttcgacttctacaagaagcaccaggagaccatgacccccgccggcctgagcttcttccagtgcagatgggacgacagcgtgacctacatcttccaccagctgctggacatgagagagcccgtgttcgagttcgtgagaccccccccctaccaccccaagcagaagagattcccccacagacagcccctgagatacctggacagatacagagacagccacgagcccacctacggcatctactag

SEQ ID NO: 89147 - DNA, 1062 bp, Artificial Sequence
  Description of Artificial Sequence: Synthetic coding sequence
atggaggccctggccatgggcagcagagccctgagactgtggctggtggcccccggcggcggcatcaagtggagattcatcgccaccagcagcgccagccagctgagccccaccgagctgaccgagatgagaaacgacctgttcaacaaggagaaggccagacagctgagcctgacccccagaaccgagaagatcgaggtgaagcacgtgggcaagaccgaccccggcaccgtgttcgtgatgaacaagaacatcagcaccccctacagctgcgccatgcacctgagcgagtggtactgcagaaagagcatcctggccctggtggacggccagccctgggacatgtacaagcccctgaccaagagctgcgagatcaagttcctgaccttcaaggactgcgaccccggcgaggtgaacaaggcctactggagaagctgcgccatgatgatgggctgcgtgatcgagagagccttcaaggacgagtacatggtgaacctggtgagagcccccgaggtgcccgtgatcagcggcgccttctgctacgacgtggtgctggacagcaagctggacgagtggatgcccaccaaggagaacctgagaagcttcaccaaggacgcccacgccctgatctacaaggacctgcccttcgagaccctggaggtggaggccaaggtggccctggagatcttccagcacagcaagtacaaggtggacttcatcgaggagaaggccagccagaaccccgagagaatcgtgaagctgcacagaatcggcgacttcatcgacgtgagcgagggccccctgatccccagaaccagcatctgcttccagtacgaggtgagcgccgtgcacaacctgcagcccacccagcccagcctgatcagaagattccagggcgtgagcctgcccgtgcacctgagagcccacttcaccatctgggacaagctgctggagagaagcagaaagatgacccccttccccatcctgctgctgttcaccacccagagcttcttcaccaccagccccgagagctacctgctgcacggcaccgtgagcgagtag

SEQ ID NO: 89148 - DNA, 1017 bp, Artificial Sequence
  Description of Artificial Sequence: Synthetic coding sequence
atggaggccctggccatgggcagcagagccctgagactgtggctggtggcccccggcggcggcatcaagtggagattcatcgccaccagcagcgccagccagctgagccccaccgagctgaccgagatgagaaacgacctgttcaacaaggagaaggccagacagctgagcctgacccccagaaccgagaagatcgaggtgaagcacgtgggcaagaccgaccccggcaccgtgttcgtgatgaacaagaacatcagcaccccctacagctgcgccatgcacctgagcgagtggtactgcagaaagagcatcctggccctggtggacggccagccctgggacatgtacaagcccctgaccaagagctgcgagatcaagttcctgaccttcaaggactgcgaccccggcgaggtgaacaaggcctactggagaagctgcgccatgatgatgggctgcgtgatcgagagagccttcaaggacgagtacatggtgaacctggtgagagcccccgaggtgcccgtgatcagcggcgccttctgctacgacgtggtgctggacagcaagctggacgagtggatgcccaccaaggagaacctgagaagcttcaccaaggacgcccacgccctgatctacaaggacctgcccttcgagaccctggaggtggaggccaaggtggccctggagatcttccagcacagcaagtacaaggtggacttcatcgaggagaaggccagccagaaccccgagagaatcgtgaagctgcacagaatcggcgacttcatcgacgtgagcgagggccccctgatccccagaaccagcatctgcttccagtacgaggtgagcgccgtgcacaacctgcagcccacccagcccagcctgatcagaagattccagggcgtgagcctgcccgtgcacctgagagcccacttcaccatctgggacaagctgctggagagaagcagaaagatggtgaccgaggaccagagcaaggccaccgaggagtgcaccagcacctag

SEQ ID NO: 89149 - DNA, 936 bp, Artificial Sequence
  Description of Artificial Sequence: Synthetic coding sequence
atgctgcagttcgtgagagccggcgccagagcctggctgagacccaccggcagccagggcctgagcagcctggccgaggaggccgccagagccaccgagaaccccgagcaggtggccagcgagggcctgcccgagcccgtgctgagaaaggtggagctgcccgtgcccacccacagaagacccgtgcaggcctgggtggagagcctgagaggcttcgagcaggagagagtgggcctggccgacctgcaccccgacgtgttcgccaccgcccccagactggacatcctgcaccaggtggccatgtggcagaagaacttcaagagaatcagctacgccaagaccaagaccagagccgaggtgagaggcggcggcagaaagccctggccccagaagggcaccggcagagccagacacggcagcatcagaagccccctgtggagaggcggcggcgtggcccacggccccagaggccccaccagctactactacatgctgcccatgaaggtgagagccctgggcctgaaggtggccctgaccgtgaagctggcccaggacgacctgcacatcatggacagcctggagctgcccaccggcgacccccagtacctgaccgagctggcccactacagaagatggggcgacagcgtgctgctggtggacctgacccacgaggagatgccccagagcatcgtggaggccaccagcagactgaagaccttcaacctgatccccgccgtgggcctgaacgtgcacagcatgctgaagcaccagaccctggtgctgaccctgcccaccgtggccttcctggaggacaagctgctgtggcaggacagcagatacagacccctgtaccccttcagcctgccctacagcgacttccccagacccctgccccacgccacccagggccccgccgccaccccctaccactgctag

SEQ ID NO: 89150 - DNA, 936 bp, Artificial Sequence; identical to SEQ ID NO: 89149
  Description of Artificial Sequence: Synthetic coding sequence

SEQ ID NO: 89151 - DNA, 792 bp, Artificial Sequence
  Description of Artificial Sequence: Synthetic coding sequence
atgctgcagttcgtgagagccggcgccagagcctggctgagacccaccggcagccagggcctgagcagcctggccgaggaggccgccagagccaccgagaaccccgagcaggtggccagcgagggcctgcccgagcccgtgctgagaaaggtggagctgcccgtgcccacccacagaagacccgtgcaggcctgggtggagagcctgagaggcttcgagcaggagagagtgggcctggccgacctgcaccccgacgtgttcgccaccgcccccagactggacatcctgcaccaggtggccatgtggcagaagaacttcaagagaatcagctacgccaagaccaagaccagagccgaggtgagaggcggcggcagaaagccctggccccagaagggcaccggcagagccagacacggcagcatcagaagccccctgtggagaggcggcggcgtggcccacggccccagaggccccaccagctactactacatgctgcccatgaaggtgagagccctgggcctgaaggtggccctgaccgtgaagctggcccaggacgacctgcacatcatggacagcctggagctgcccaccggcgacccccagtacctgaccgagctggcccactacagaagatggggcgacagcgtgctgctggtggacctgacccacgaggagatgccccagagcatcgtggaggccaccagcagactgaagaccttcaacctgatccccgccgtgggcgagcagagagcccaggcccccagagtgagaatgtgcagactgagatgctag

SEQ ID NO: 89152 - DNA, 792 bp, Artificial Sequence; identical to SEQ ID NO: 89151
  Description of Artificial Sequence: Synthetic coding sequence

SEQ ID NO: 89153 - DNA, 414 bp, Artificial Sequence
  Description of Artificial Sequence: Synthetic coding sequence
atgggcgtgctggccgccgccgccagatgcctggtgagaggcgccgacagaatgagcaagtggaccagcaagagaggccccagaagcttcagaggcagaaagggcagaggcgccaagggcatcggcttcctgaccagcggctggagattcgtgcagatcaaggagatggtgcccgagttcgtggtgcccgacctgaccggcttcaagctgaagccctacgtgagctacctggcccccgagagcgaggagacccccctgaccgccgcccagctgttcagcgaggccgtggcccccgccatcgagaaggacttcaaggacggcaccttcgaccccgacaacctggagaagtacggcttcgagcccacccaggagggcaagctgttccagctgtaccccagaaacttcctgagatag

SEQ ID NO: 89154 - DNA, 429 bp, Artificial Sequence
  Description of Artificial Sequence: Synthetic coding sequence
atgggcgacgtgaaggagaactacctggagaccttcatcagcagccccaagttcggcagaacctgcgccgacggcgccctgtactgcgtgtgccacaagagcacctacagccccctgcccgacgactacaactgcaacgtggagctggccctgaccagcgacggcagaaccatcgtgtgctaccaccccagcgtggacatcccctacgagcacaccaagcccatccccagacccgaccccgtgcacaacaacgaggagacccacgaccaggtgctgaagaccagactggaggagaaggtggagcacctggaggagggccccatgatcgagcagctgagcaagatgttcttcaccaccaagcacagatggtacccccacggcagataccacagatgcagaaagaacctgaacccccccaaggacagatag

SEQ ID NO: 89155 - DNA, 429 bp, Artificial Sequence
  Description of Artificial Sequence: Synthetic coding sequence
atggccgtggccgccgtgaagtgggtgatgagcaagagaaccatcctgaagcacctgttccccgtgcagaacggcgccctgtactgcgtgtgccacaagagcacctacagccccctgcccgacgactacaactgcaacgtggagctggccctgaccagcgacggcagaaccatcgtgtgctaccaccccagcgtggacatcccctacgagcacaccaagcccatccccagacccgaccccgtgcacaacaacgaggagacccacgaccaggtgctgaagaccagactggaggagaaggtggagcacctggaggagggccccatgatcgagcagctgagcaagatgttcttcaccaccaagcacagatggtacccccacggcagataccacagatgcagaaagaacctgaacccccccaaggacagatag

SEQ ID NO: 89156 - DNA, 429 bp, Artificial Sequence; identical to SEQ ID NO: 89155
  Description of Artificial Sequence: Synthetic coding sequence

SEQ ID NO: 89157 - DNA, 429 bp, Artificial Sequence; identical to SEQ ID NO: 89155
  Description of Artificial Sequence: Synthetic coding sequence

SEQ ID NO: 89158 - DNA, 609 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggacaccggcctgagactgagcgccgtggccccccagatcctgctgcccggctggcccgaccccatcagcgtgcagagcagcgacctgccctggggcaacacccactacagacccgagcccctgagcagcaccacctggctgtag

SEQ ID NO: 89159 - DNA, 648 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggacaccggcctgagactgagcgccgtggccccccagatcctgctgcccggctggcccgacccccccgacctgcccaccgtggaccccatcagcagcagcctgaccagcgcccccgcccccatgctgagcgccgtgagctgcctgcccatcgtgcccgccctgaccaccgtgtgcagcgcctag

SEQ ID NO: 89160 - DNA, 480 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggtgcaggcccagtag

SEQ ID NO: 89161 - DNA, 708 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggacgccgccgagttcctgggcgagggcgccggcccctgctggtacagcatcgtggccctgccccagaagcacatcgccatcgccatccaccccccccagcccgccggccagtgccaccaggccatcggccactggcccgagaccgtgtgcagctgcaccgccgacccccccgccagactggccagacccaacatcagcagcgtgatcagaagcagcctgggcaagtaccccctgcccagctag

SEQ ID NO: 89162 - DNA, 495 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccagtgcctgctgctgggcgccgtgaccctgtag

SEQ ID NO: 89163 - DNA, 480 bp, Artificial Sequence; identical to SEQ ID NO: 89160
  Description of Artificial Sequence: Synthetic coding sequence

SEQ ID NO: 89164 - DNA, 555 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggacaccggcctgagactgagcgccgtggccccccagatcctgctgcccggctggcccgaccccaccagagccaccagagccaccagatag

SEQ ID NO: 89165 - DNA, 786 bp, Artificial Sequence
  Description of Artificial Sequence: Synthetic coding sequence
atgaccgccagaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggacgccgccgagttcctgggcgagggcgccggcccctgctggtacagcatcgtggccctgccccagaagcacatcgccatcgccatccaccccccccagcccgccggccagtgccaccaggccatcggccactggcccgagaccgtgtgcagctgcaccgccgacccccccgccagactggccagacccaccagacccccccacagcggcagctacctgatcctgatcgacctgtgcagcagcccctacgccgtgagaagcttcctgccccccgactgcccctgcaccgaccactgcgtgctgagcgtgaaggccgcctag

SEQ ID NO: 89166 - DNA, 510 bp, Artificial Sequence
  Description of Artificial Sequence: Synthetic coding sequence
tgaggcacccccagcagattcctggccagcgtgctgcacaacggcctgggcagatacgtgcagcagctgcagagactgagcttcagcgtgagcagagacggcgccagcagcagaggcgccagagagttcgtggagagagaggtgatcgacttcgccagaagaaaccccggcgtggtgatctacgtgaacagcagaccctgctgcgtgcccagagtggtggccgagtacctgaacggcgccgtgagagaggagagcatccactgcaagagcgtggaggagatcagcaccctggtgcagaagctggccgaccagagcggcctggacgtgatcagaatcagaaagcccttccacaccgacaaccccagcatccagggccagtggcaccccttcaccaacaagcccaccaccttcagaggcctgagacccagagaggtgcaggaccccgcccccgcccaggacgccgccgagttcctgggcgagggcgccggcccctgctggaccctggcctag

SEQ ID NO: 89167 - DNA, 999 bp, Artificial Sequence
  Description of Artificial Sequence: Synthetic coding sequence
atggccagcggcctggtgagactgctgcagcagggccacagatgcctgctggcccccgtggcccccaagctggtgccccccgtgagaggcgtgaagaagggcttcagagccgccttcagattccagaaggagctggagagacagagactgctgagatgcccccccccccccgtgagaagaagcgagaagcccaactgggactaccacgccgagatccaggccttcggccacagactgcaggagaacttcagcctggacctgctgaagaccgccttcgtgaacagctgctacatcaagagcgaggaggccaagagacagcagctgggcatcgagaaggaggccgtgctgctgaacctgaagagcaaccaggagctgagcgagcagggcaccagcttcagccagacctgcctgacccagttcctggaggacgagtaccccgacatgcccaccgagggcatcaagaacctggtggacttcctgaccggcgaggaggtggtgtgccacgtggccagaaacctggccgtggagcagctgaccctgagcgaggagttccccgtgccccccgccgtgctgcagcagaccttcttcgccgtgatcggcgccctgctgcagagcagcggccccgagagaaccgccctgttcatcagagacttcctgatcacccagatgaccggcaaggagctgttcgagatgtggaagatcatcaaccccatgggcctgctggtggaggagctgaagaagagaaacgtgagcgcccccgagagcagactgaccagacagagcggcggcaccaccgccctgcccctgtacttcgtgggcctgtactgcgacaagaagctgatcgccgagggccccggcgagaccgtgctggtggccgaggaggaggccgccagagtggccctgagaaagctgtacggcttcaccgagaacagaagaccctggaactacagcaagcccaaggagaccctgagagccgagaagagcatcaccgccagctag

SEQ ID NO: 89168 - DNA, 921 bp, Artificial Sequence
  Description of Artificial Sequence: Synthetic coding sequence
atggccgcccccatcccccagggcttcagctgcctgagcagattcctgggctggtggttcagacagcccgtgctggtgacccagagcgccgccatcgtgcccgtgagaaccaagaagagattcaccccccccatctaccagcccaagttcaagaccgagaaggagttcatgcagcacgccagaaaggccggcctggtgatcccccccgagaagagcgacagaagcatccacctggcctgcaccgccggcatcttcgacgcctacgtgccccccgagggcgacgccagaatcagcagcctgagcaaggagggcctgatcgagagaaccgagagaatgaagaagaccatggccagccaggtgagcatcagaagaatcaaggactacgacgccaacttcaagatcaaggacttccccgagaaggccaaggacatcttcatcgaggcccacctgtgcctgaacaacagcgaccacgacagactgcacaccctggtgaccgagcactgcttccccgacatgacctgggacatcaagtacaagaccgtgagatggagcttcgtggagagcctggagcccagccacgtggtgcaggtgagatgcagcagcatgatgaaccagggcaacgtgtacggccagatcaccgtgagaatgcacaccagacagaccctggccatctacgacagattcggcagactgatgtacggccaggaggacgtgcccaaggacgtgctggagtacgtggtgttcgagaagcagctgaccaacccctacggcagctggagaatgcacaccaagatcgtgcccccctgggccccccccaagcagcccatcctgaagaccgtgatgatccccggcccccagctgaagcccgaggaggagtacgaggaggcccagggcgaggcccagaagccccagctggcctag

SEQ ID NO: 89169 - DNA, 693 bp, Artificial Sequence
  Description of Artificial Sequence: Synthetic coding sequence
atggccgccgccggcctggccctgctgtgcagaagagtgagcagcgccctgaagagcagcagaagcctgatcaccccccaggtgcccgcctgcaccggcctgctgcacaccaccctgagcagaaagggcctggaggagttcttcgacgaccccaagaactggggccaggagaaggtgaagagcggcgccgcctggacctgccagcagctgagaaacaagagcaacgaggacctgcacaagctgtggtacgtgctgctgaaggagagaaacatgctgctgaccctggagcaggaggccaagagacagagactgcccatgcccagccccgagagactggacaaggtggtggacagcatggacgccctggacaaggtggtgcaggagagagaggacgccctgagactgctgcagaccggccaggagagagccagacccggcgcctggagaagagacatcttcggcagaatcatctggcacaagttcaagcagtgggtgatcccctggcacctgaacaagagatacaacagaaagagattcttcgccctgccctacgtggaccacttcctgagactggagagagagaagagagccagaatcaaggccagaaaggagaacctggagagaaagaaggccaagatcctgctgaagaagttcccccacctggccgaggcccagaagagcagcctggtgtag

SEQ ID NO: 89170 - DNA, 423 bp, Artificial Sequence
  Description of Artificial Sequence: Synthetic coding sequence
atgctgctgaccctggagcaggaggccaagagacagagactgcccatgcccagccccgagagactggacaaggtggtggacagcatggacgccctggacaaggtggtgcaggagagagaggacgccctgagactgctgcagaccggccaggagagagccagacccggcgcctggagaagagacatcttcggcagaatcatctggcacaagttcaagcagtgggtgatcccctggcacctgaacaagagatacaacagaaagagattcttcgccctgccctacgtggaccacttcctgagactggagagagagaagagagccagaatcaaggccagaaaggagaacctggagagaaagaaggccaagatcctgctgaagaagttcccccacctggccgaggcccagaagagcagcctggtgtag

SEQ ID NO: 89171 - DNA, 753 bp, Artificial Sequence
  Description of Artificial Sequence: Synthetic coding sequence
atggccgccgccggcctggccctgctgtgcagaagagtgagcagcgccctgaagagcagcagaagcctgatcaccccccaggtgcccgcctgcaccggcttcttcctgagcctgctgcccaagagcacccccaacgtgaccagcttccaccagtacagactgctgcacaccaccctgagcagaaagggcctggaggagttcttcgacgaccccaagaactggggccaggagaaggtgaagagcggcgccgcctggacctgccagcagctgagaaacaagagcaacgaggacctgcacaagctgtggtacgtgctgctgaaggagagaaacatgctgctgaccctggagcaggaggccaagagacagagactgcccatgcccagccccgagagactggacaaggtggtggacagcatggacgccctggacaaggtggtgcaggagagagaggacgccctgagactgctgcagaccggccaggagagagccagacccggcgcctggagaagagacatcttcggcagaatcatctggcacaagttcaagcagtgggtgatcccctggcacctgaacaagagatacaacagaaagagattcttcgccctgccctacgtggaccacttcctgagactggagagagagaagagagccagaatcaaggccagaaaggagaacctggagagaaagaaggccaagatcctgctgaagaagttcccccacctggccgaggcccagaagagcagcctggtgtag

SEQ ID NO: 89172 - DNA, 639 bp, Artificial Sequence
  Description of Artificial Sequence: Synthetic coding sequence
atgagcggcaccctggagaaggtgctgtgcctgagaaacaacaccatcttcaagcaggccttcagcctgctgagattcagaaccagcggcgagaagcccatctacagcgtgggcggcatcctgctgagcatcagcagaccctacaagaccaagcccacccacggcatcggcaagtacaagcacctgatcaaggccgaggagcccaagaagaagaagggcaaggtggaggtgagagccatcaacctgggcaccgactacgagtacggcgtgctgaacatccacctgaccgcctacgacatgaccctggccgagagctacgcccagtacgtgcacaacctgtgcaacagcctgagcatcaaggtggaggagagctacgccatgcccaccaagaccatcgaggtgctgcagctgcaggaccagggcagcaagatgctgctggacagcgtgctgaccacccacgagagagtggtgcagatcagcggcctgagcgccaccttcgccgagatcttcctggagatcatccagagcagcctgcccgagggcgtgagactgagcgtgaaggagcacaccgaggaggacttcaagggcagattcaaggccagacccgagctggaggagctgctggccaagctgaagtag

SEQ ID NO: 89173 - DNA, 585 bp, Artificial Sequence
  Description of Artificial Sequence: Synthetic coding sequence
atgggcctgagcagctgcagaaagaccagcagcggcctgcccctgatcctgcactacggcggcatcctgctgagcatcagcagaccctacaagaccaagcccacccacggcatcggcaagtacaagcacctgatcaaggccgaggagcccaagaagaagaagggcaaggtggaggtgagagccatcaacctgggcaccgactacgagtacggcgtgctgaacatccacctgaccgcctacgacatgaccctggccgagagctacgcccagtacgtgcacaacctgtgcaacagcctgagcatcaaggtggaggagagctacgccatgcccaccaagaccatcgaggtgctgcagctgcaggaccagggcagcaagatgctgctggacagcgtgctgaccacccacgagagagtggtgcagatcagcggcctgagcgccaccttcgccgagatcttcctggagatcatccagagcagcctgcccgagggcgtgagactgagcgtgaaggagcacaccgaggaggacttcaagggcagattcaaggccagacccgagctggaggagctgctggccaagctgaagtag

SEQ ID NO: 89174 - DNA, 501 bp, Artificial Sequence
  Description of Artificial Sequence: Synthetic coding sequence
atggccgccaccatgttcagagccaccctgagaggctggagaaccggcgtgcagagaggctgcggcctgagactgctgagccagacccagggcccccccgactaccccagattcgtggagagcgtggacgagtaccagttcgtggagagactgctgcccgccaccagaatccccgacccccccaagcacgagcactaccccacccccagcggctggcagccccccagagaccccccccccaacctgccctacttcgtgagaagaagcagaatgcacaacatccccgtgtacaaggacatcacccacggcaacagacagatgaccgtgatcagaaaggtggagggcgacatctgggccctgcagaaggacgtggaggacttcctgagccccctgctgggcaagacccccgtgacccaggtgaacgaggtgaccggcaccctgagaatcaagggctacttcgaccaggagctgaaggcctggctgctggagaagggcttctag

SEQ ID NO: 89175 - DNA, 501 bp, Artificial Sequence; identical to SEQ ID NO: 89174
  Description of Artificial Sequence: Synthetic coding sequence

SEQ ID NO: 89176 - DNA, 477 bp, Artificial Sequence
  Description of Artificial Sequence: Synthetic coding sequence
atggccgccagaagcgtgagcggcatcaccagaagagtgttcatgtggaccgtgagcggcaccccctgcagagagttctggagcagattcagaaaggagaaggagcccgtggtggtggagaccgtggaggagaagaaggagcccatcctggtgtgcccccccctgagaagcagagcctacaccccccccgaggacctgcagagcagactggagagctacgtgaaggaggtgttcggcagcagcctgcccagcaactggcaggacatcagcctggaggacagcagactgaagttcaacctgctggcccacctggccgacgacctgggccacgtggtgcccaacagcagactgcaccagatgtgcagagtgagagacgtgctggacttctacaacgtgcccatccaggacagaagcaagttcgacgagctgagcgccagcaacctgccccccaacctgaagatcacctggagctactag

SEQ ID NO: 89177 - DNA, 408 bp, Artificial Sequence
  Description of Artificial Sequence: Synthetic coding sequence
atggccgccagaagcgtgagcggcatcaccagaagagtgttcatgtggaccgtgagcggcaccccctgcagagagttctggagcagattcagaaaggagaaggagcccgtggtggtggagaccgtggaggagaagaaggagcccatcctggtgtgcccccccctgagaagcagagcctacaccccccccgaggacctgcagagcagactggagagctacgtgaaggaggtgttcggcagcagcctgcccagcaactggcaggacatcagcctggaggacagcagactgaagttcaacctgctggcccacctggccgacgacctgggccacgtggtgcccaacagcagactgcaccagatgtgcagaggctacagcttcgaggagggcaagatccagctgggcatctag

SEQ ID NO: 89178 - DNA, 1146 bp, Artificial Sequence
  Description of Artificial Sequence: Synthetic coding sequence
atggccagccccagcctggagagacccgagaagggcgccggcaagagcgagttcagaaaccagaagcccaagcccgagaaccaggacgagagcgagctgctgaccgtgcccgacggctggaaggagcccgccttcagcaaggaggacaaccccagaggcctgctggaggagagcagcttcgccaccctgttccccaagtacagagaggcctacctgaaggagtgctggcccctggtgcagaaggccctgaacgagcaccacgtgaacgccaccctggacctgatcgagggcagcatgaccgtgtgcaccaccaagaagaccttcgacccctacatcatcatcagagccagagacctgatcaagctgctggccagaagcgtgagcttcgagcaggccgtgagaatcctgcaggacgacgtggcctgcgacatcatcaagatcggcagcctggtgagaaacaaggagagattcgtgaagagaagacagagactgatcggccccaagggcagcaccctgaaggccctggagctgctgaccaactgctacatcatggtgcagggcaacaccgtgagcgccatcggccccttcagcggcctgaaggaggtgagaaaggtggtgctggacaccatgaagaacatccaccccatctacaacatcaagagcctgatgatcaagagagagctggccaaggacagcgagctgagaagccagagctgggagagattcctgccccagttcaagcacaagaacgtgaacaagagaaaggagcccaagaagaagaccgtgaagaaggagtacacccccttcccccccccccagcccgagagccagatcgacaaggagctggccagcggcgagtacttcctgaaggccaaccagaagaagagacagaagatggaggccatcaaggccaagcaggccgaggccatcagcaagagacaggaggagagaaacaaggccttcatcccccccaaggagaagcccatcgtgaagcccaaggaggccagcaccgagaccaagatcgacgtggccagcatcaaggagaaggtgaagaaggccaagaacaagaagctgggcgccctgaccgccgaggagatcgccctgaagatggaggccgacgagaagaagaagaagaagaagaagtag

SEQ ID NO: 89179 - DNA, 372 bp, Artificial Sequence
  Description of Artificial Sequence: Synthetic coding sequence
atggccgccctgggcaccgtgctgttcaccggcgtgagaagactgcactgcagcgtggccgcctgggccggcggccagtggagactgcagcagggcctggccgccaaccccagcggctacggccccctgaccgagctgcccgactggagctacgccgacggcagacccgccccccccatgaagggccagctgagaagaaaggccgagagagagaccttcgccagaagagtggtgctgctgagccaggagatggacgccggcctgcaggcctggcagctgagacagcagaagctgcaggaggagcagagaaagcaggagaacgccctgaagcccaagggcgccagcctgaagagccccctgcccagccagtag

SEQ ID NO: 89180 - DNA, 369 bp, Artificial Sequence
  Description of Artificial Sequence: Synthetic coding sequence
atggccgccctgggcaccgtgctgttcagcgtgagaagactgcactgcagcgtggccgcctgggccggcggccagtggagactgcagcagggcctggccgccaaccccagcggctacggccccctgaccgagctgcccgactggagctacgccgacggcagacccgccccccccatgaagggccagctgagaagaaaggccgagagagagaccttcgccagaagagtggtgctgctgagccaggagatggacgccggcctgcaggcctggcagctgagacagcagaagctgcaggaggagcagagaaagcaggagaacgccctgaagcccaagggcgccagcctgaagagccccctgcccagccagtag

SEQ ID NO: 89181 - DNA, 264 bp, Artificial Sequence
  Description of Artificial Sequence: Synthetic coding sequence
atggccgccctgggcaccgtgctgttcaccggcgtgagaagactgcactgcagcgtggccgcctgggccggcggccagtggagactgcagcagggcctggccgccaaccccagcggctacggccccctgaccgagctgcccgactggagctacgccgagaccagctgcaccgccgtgaccggcaacggcagatggatcaccagcatggccgcccaggccgccgaggtggccggcagaaccaaggaggccggcaagtgcagctag

SEQ ID NO: 89182 - DNA, 195 bp, Artificial Sequence
  Description of Artificial Sequence: Synthetic coding sequence
atgaagggccagctgagaagaaaggccgagagagagaccttcgccagaagagtggtgctgctgagccaggagatggacgccggcctgcaggcctggcagctgagacagcagaagctgcaggaggagcagagaaagcaggagaacgccctgaagcccaagggcgccagcctgaagagccccctgcccagccagtag

SEQ ID NO: 89183 - DNA, 195 bp, Artificial Sequence; identical to SEQ ID NO: 89182
  Description of Artificial Sequence: Synthetic coding sequence

SEQ ID NO: 89184 - DNA, 195 bp, Artificial Sequence; identical to SEQ ID NO: 89182
  Description of Artificial Sequence: Synthetic coding sequence

SEQ ID NO: 89185 - DNA, 339 bp, Artificial Sequence
  Description of Artificial Sequence: Synthetic coding sequence
atggccgccgccctggccagactgggcctgagacccgtgaagcaggtgagagtgcagttctgccccttcgagaagaacgtggagagcaccagaaccttcctgcagaccgtgagcagcgagaaggtgagaagcaccaacctgaactgcagcgtgatcgccgacgtgagacacgacggcagcgagccctgcgtggacgtgctgttcggcgacggccacagactgatcatgagaggcgcccacctgaccgccctggagatgctgaccgccttcgccagccacatcagagccagagacgccgccggcagcggcgacaagcccggcgccgacaccggcagatag

SEQ ID NO: 89186 - DNA, 417 bp, Artificial Sequence
  Description of Artificial Sequence: Synthetic coding sequence
atggccaccaagagactgttcggcgccaccagaacctgggccggctggggcgcctgggagctgctgaaccccgccaccagcggcagactgctggccagagactacgccaagaagcccgtgatgaagggcgccaagagcggcaagggcgccgtgaccagcgaggccctgaaggaccccgacgtgtgcaccgaccccgtgcagctgaccacctacgccatgggcgtgaacatctacaaggagggccaggacgtgcccctgaagcccgacgccgagtaccccgagtggctgttcgagatgaacctgggcccccccaagaccctggaggagctggaccccgagagcagagagtactggagaagactgagaaagcagaacatctggagacacaacagactgagcaagaacaagagactgtag

SEQ ID NO: 89187 - DNA, 387 bp, Artificial Sequence
  Description of Artificial Sequence: Synthetic coding sequence
atggccgccgtgggcagcctgctgggcagactgagacagagcaccgtgaaggccaccggccccgccctgagaagactgcacaccagcagctggagagccgacagcagcagagccagcctgaccagagtgcacagacaggcctacgccagactgtaccccgtgctgctggtgaagcaggacggcagcaccatccacatcagatacagagagcccagaagaatgctggccatgcccatcgacctggacaccctgagccccgaggagagaagagccagactgagaaagagagaggcccagctgcagagcagaaaggagtacgagcaggagctgagcgacgacctgcacgtggagagatacagacagttctggaccagaaccaagaagtag

SEQ ID NO: 89188 - DNA, 387 bp, Artificial Sequence; identical to SEQ ID NO: 89187
  Description of Artificial Sequence: Synthetic coding sequence

SEQ ID NO: 89189 - DNA, 387 bp, Artificial Sequence; identical to SEQ ID NO: 89187
  Description of Artificial Sequence: Synthetic coding sequence

SEQ ID NO: 89190 - DNA, 387 bp, Artificial Sequence; identical to SEQ ID NO: 89187
  Description of Artificial Sequence: Synthetic coding sequence

SEQ ID NO: 89191 - DNA, 495 bp, Artificial Sequence
  Description of Artificial Sequence: Synthetic coding sequence
atggccgccgtgggcagcctgctgggcctggccgccagcagctggctgggcggccagaacgccagcgaccacagcctgtggctgctgagaaagcccagaggcagcagctgccccggcaccggccaccagctgtgcagactgagacagagcaccgtgaaggccaccggccccgccctgagaagactgcacaccagcagctggagagccgacagcagcagagccagcctgaccagagtgcacagacaggcctacgccagactgtaccccgtgctgctggtgaagcaggacggcagcaccatccacatcagatacagagagcccagaagaatgctggccatgcccatcgacctggacaccctgagccccgaggagagaagagccagactgagaaagagagaggcccagctgcagagcagaaaggagtacgagcaggagctgagcgacgacctgcacgtggagagatacagacagttctggaccagaaccaagaagtag

SEQ ID NO: 89192 - DNA, 378 bp, Artificial Sequence
  Description of Artificial Sequence: Synthetic coding sequence
atggccgccgtgggcagcctgctgggccagagcaccgtgaaggccaccggccccgccctgagaagactgcacaccagcagctggagagccgacagcagcagagccagcctgaccagagtgcacagacaggcctacgccagactgtaccccgtgctgctggtgaagcaggacggcagcaccatccacatcagatacagagagcccagaagaatgctggccatgcccatcgacctggacaccctgagccccgaggagagaagagccagactgagaaagagagaggcccagctgcagagcagaaaggagtacgagcaggagctgagcgacgacctgcacgtggagagatacagacagttctggaccagaaccaagaagtag

SEQ ID NO: 89193 - DNA, 387 bp, Artificial Sequence; identical to SEQ ID NO: 89187
  Description of Artificial Sequence: Synthetic coding sequence

SEQ ID NO: 89194 - DNA, 387 bp, Artificial Sequence; identical to SEQ ID NO: 89187
  Description of Artificial Sequence: Synthetic coding sequence

SEQ ID NO: 89195 - DNA, 387 bp, Artificial Sequence; identical to SEQ ID NO: 89187
  Description of Artificial Sequence: Synthetic coding sequence

SEQ ID NO: 89196 - DNA, 387 bp, Artificial Sequence; identical to SEQ ID NO: 89187
  Description of Artificial Sequence: Synthetic coding sequence

SEQ ID NO: 89197 - DNA, 495 bp, Artificial Sequence; identical to SEQ ID NO: 89191
  Description of Artificial Sequence: Synthetic coding sequence

SEQ ID NO: 89198 - DNA, 387 bp, Artificial Sequence; identical to SEQ ID NO: 89187
  Description of Artificial Sequence: Synthetic coding sequence

SEQ ID NO: 89199 - DNA, 387 bp, Artificial Sequence; identical to SEQ ID NO: 89187
  Description of Artificial Sequence: Synthetic coding sequence

SEQ ID NO: 89200 - DNA, 387 bp, Artificial Sequence; identical to SEQ ID NO: 89187
  Description of Artificial Sequence: Synthetic coding sequence

SEQ ID NO: 89201 - DNA, 387 bp, Artificial Sequence; identical to SEQ ID NO: 89187
  Description of Artificial Sequence: Synthetic coding sequence

SEQ ID NO: 89202 - DNA, 387 bp, Artificial Sequence; identical to SEQ ID NO: 89187
  Description of Artificial Sequence: Synthetic coding sequence

SEQ ID NO: 89203 - DNA, 387 bp, Artificial Sequence; identical to SEQ ID NO: 89187
  Description of Artificial Sequence: Synthetic coding sequence

SEQ ID NO: 89204 - DNA, 387 bp, Artificial Sequence; identical to SEQ ID NO: 89187
  Description of Artificial Sequence: Synthetic coding sequence

SEQ ID NO: 89205 - DNA, 387 bp, Artificial Sequence; identical to SEQ ID NO: 89187
  Description of Artificial Sequence: Synthetic coding sequence

SEQ ID NO: 89206 - DNA, 387 bp, Artificial Sequence; identical to SEQ ID NO: 89187
  Description of Artificial Sequence: Synthetic coding sequence

SEQ ID NO: 89207 - DNA, 495 bp, Artificial Sequence; identical to SEQ ID NO: 89191
  Description of Artificial Sequence: Synthetic coding sequence

SEQ ID NO: 89208 - DNA, 231 bp, Artificial Sequence
  Description of Artificial Sequence: Synthetic coding sequence
atggccgccgtgggcagcctgctgggcagactgagacagagcaccgtgaaggccaccggccccgccctgagaagactgcacaccagcagctggagagccgacagcagcagagccagcctgaccagagtgcacagacaggcctacgccagactgtaccccgtgctgctggtgaagcaggacggcagcaccatccacatcagatacagagagcccagaagaatgctggcctag

SEQ ID NO: 89209 - DNA, 702 bp, Artificial Sequence
  Description of Artificial Sequence: Synthetic coding sequence
atggccgcccccgtggtgaccgcccccggcagagccctgctgagagccggcgccggcagactgctgagaggcggcgtgcaggagctgctgagacccagacacgagggcaacgcccccgacctggcctgcaacttcagcctgagccagaacagaggcaccgtgatcgtggagagatggtggaaggtgcccctggccggcgagggcagaaagcccagactgcacagaagacacagagtgtacaagctggtggaggacaccaagcacagacccaaggagaacctggagctgatcctgacccagagcgtggagaacgtgggcgtgagaggcgacctggtgagcgtgaagaagagcctgggcagaaacagactgctgccccagggcctggccgtgtacgccagccccgagaacaagaagctgttcgaggaggagaagctgctgagacaggagggcaagctggagaagatccagaccaaggccggcgaggccctgggcgtggtggtggccccccacaccctgaagctgcccgaggagcccatcaccagatggggcgagtactggtgcgaggtgaccgtgaacggcctggacaccgtgagagtgcccatgagcgtggtgaacttcgagaagcccaagaccaagagatacaagtactggctggcccagcaggccgccaaggccatggcccccaccagcccccagatctag

SEQ ID NO: 89210 - DNA, 804 bp, Artificial Sequence
  Description of Artificial Sequence: Synthetic coding sequence
atggccgcccccgtggtgaccgcccccggcagagccctgctgagagccggcgccggcagactgctgagaggcggcgtgcaggagctgctgagacccagacacgagggcaacgcccccgacctggcctgcaacttcagcctgagccagaacagaggcaccgtgatcgtggagagatggtggaaggtgcccctggccggcgagggcagaaagcccagactgcacagaagacacagagtgtacaagctggtggaggacaccaagcacagacccaaggagaacctggagctgatcctgacccagagcgtggagaacgtgggcgtgagaggcgacctggtgagcgtgaagaagagcctgggcagaaacagactgctgccccagggcctggccgtgtacgccagccccgagaacaagaagctgttcgaggaggagaagctgctgagacaggagggcaagctggagaagatccagaccaaggccggcgaggccaccgtgaagttcctgaagagctgcagactggaggtgggcatgaagaacaacgtgaagtgggagctgaaccccgagatcgtggccagacacttcttcaagaacctgggcgtggtggtggccccccacaccctgaagctgcccgaggagcccatcaccagatggggcgagtactggtgcgaggtgaccgtgaacggcctggacaccgtgagagtgcccatgagcgtggtgaacttcgagaagcccaagaccaagagatacaagtactggctggcccagcaggccgccaaggccatggcccccaccagcccccagatctag

SEQ ID NO: 89211 - DNA, 606 bp, Artificial Sequence
  Description of Artificial Sequence: Synthetic coding sequence
atggccgccagaaccgccttcggcgccgtgtgcagaagactgtggcagggcctgggcaacttcagcgtgaacaccagcaagggcaacaccgccaagaacggcggcctgctgctgagcaccaacatgaagtgggtgcagttcagcaacctgcacgtggacgtgcccaaggacctgaccaagcccgtggtgaccatcagcgacgagcccgacatcctgtacaagagactgagcgtgctggtgaagggccacgacaaggccgtgctggacagctacgagtacttcgccgtgctggccgccaaggagctgggcatcagcatcaaggtgcacgagccccccagaaagatcgagagattcaccctgctgcagagcgtgcacatctacaagaagcacagagtgcagtacgagatgagaaccctgtacagatgcctggagctggagcacctgaccggcagcaccgccgacgtgtacctggagtacatccagagaaacctgcccgagggcgtggccatggaggtgaccaagacccagctggagcagctgcccgagcacatcaaggagcccatctgggagaccctgagcgaggagaaggaggagagcaagagctag

SEQ ID NO: 89212 - DNA, 585 bp, Artificial Sequence
  Description of Artificial Sequence: Synthetic coding sequence
atgcaggccgtgagaaacgccggcagcagattcctgagaagctggacctggccccagaccgccggcagagtggtggccagaacccccgccggcaccatctgcaccggcgccagacagctgcaggacgccgccgccaagcagaaggtggagcagaacgccgcccccagccacaccaagttcagcatctacccccccatccccggcgaggagagcagcctgagatgggccggcaagaagttcgaggagatccccatcgcccacatcaaggccagccacaacaacacccagatccaggtggtgagcgccagcaacgagcccctggccttcgccagctgcggcaccgagggcttcagaaacgccaagaagggcaccggcatcgccgcccagaccgccggcatcgccgccgccgccagagccaagcagaagggcgtgatccacatcagagtggtggtgaagggcctgggccccggcagactgagcgccatgcacggcctgatcatgggcggcctggaggtgatcagcatcaccgacaacacccccatcccccacaacggctgcagacccagaaaggccagaaagctgtag

SEQ ID NO: 89213 - DNA, 486 bp, Artificial Sequence
  Description of Artificial Sequence: Synthetic coding sequence
atgcaggccgtgagaaacgccggcagcagattcctgagaagctggacctggccccagaccgccggcagagtggtggccagaacccccgccggcaccatctgcaccggcgccagacagctgcaggacgccgccgccaagcagaaggtggagcagaacgccgcccccagccacaccaagttcagcacccagatccaggtggtgagcgccagcaacgagcccctggccttcgccagctgcggcaccgagggcttcagaaacgccaagaagggcaccggcatcgccgcccagaccgccggcatcgccgccgccgccagagccaagcagaagggcgtgatccacatcagagtggtggtgaagggcctgggccccggcagactgagcgccatgcacggcctgatcatgggcggcctggaggtgatcagcatcaccgacaacacccccatcccccacaacggctgcagacccagaaaggccagaaagctgtag

SEQ ID NO: 89214 - DNA, 417 bp, Artificial Sequence
  Description of Artificial Sequence: Synthetic coding sequence
atgagctggagcggcctgctgcacggcctgaacaccagcctgacctgcggccccgccctggtgcccagactgtgggccacctgcagcatggccaccctgaaccagatgcacagactgggcccccccaagagaccccccagaaagctgggccccaccgagggcagaccccagctgaagggcgtggtgctgtgcaccttcaccagaaagcccaagaagcccaacagcgccaacagaaagtgctgcagagtgagactgagcaccggcagagaggccgtgtgcttcatccccggcgagggccacaccctgcaggagcaccagatcgtgctggtggagggcggcagaacccaggacctgcccggcgtgaagctgaccgtggtgagaggcaagtacgactgcggccacgtgcagaagaagtag

SEQ ID NO: 89215 - DNA, 417 bp, Artificial Sequence; identical to SEQ ID NO: 89214
  Description of Artificial Sequence: Synthetic coding sequence

SEQ ID NO: 89216 - DNA, 417 bp, Artificial Sequence; identical to SEQ ID NO: 89214
  Description of Artificial Sequence: Synthetic coding sequence

SEQ ID NO: 89217 - DNA, 387 bp, Artificial Sequence
  Description of Artificial Sequence: Synthetic coding sequence
atggccgccttcatgctgggcagcctgctgagaaccttcaagcagatggtgcccagcagcgccagcggccaggtgagaagccactacgtggactggagaatgtggagagacgtgaagagaagaaagatggcctacgagtacgccgacgagagactgagaatcaacagcctgagaaagaacaccatcctgcccaagatcctgcaggacgtggccgacgaggagatcgccgccctgcccagagacagctgccccgtgagaatcagaaacagatgcgtgatgaccagcagacccagaggcgtgaagagaagatggagactgagcagaatcgtgttcagacacctggccgaccacggccagctgagcggcatccagagagccacctggtag

SEQ ID NO: 89218 - DNA, 774 bp, Artificial Sequence
  Description of Artificial Sequence: Synthetic coding sequence
atgctgagagtggcctggagaaccctgagcctgatcagaaccagagccgtgacccaggtgctggtgcccggcctgcccggcggcggcagcgccaagttccccttcaaccagtggggcctgcagcccagaagcctgctgctgcaggccgccagaggctacgtggtgagaaagcccgcccagagcagactggacgacgaccccccccccagcaccctgctgaaggactaccagaacgtgcccggcatcgagaaggtggacgacgtggtgaagagactgctgagcctggagatggccaacaagaaggagatgctgaagatcaagcaggagcagttcatgaagaagatcgtggccaaccccgaggacaccagaagcctggaggccagaatcatcgccctgagcgtgaagatcagaagctacgaggagcacctggagaagcacagaaaggacaaggcccacaagagatacctgctgatgagcatcgaccagagaaagaagatgctgaagaacctgagaaacaccaactacgacgtgttcgagaagatctgctggggcctgggcatcgagtacaccttcccccccctgtactacagaagagcccacagaagattcgtgaccaagaaggccctgtgcatcagagtgttccaggagacccagaagctgaagaagagaagaagagccctgaaggccgccgccgccgcccagaagcaggccaagagaagaaaccccgacagccccgccaaggccatccccaagaccctgaaggacagccagtag

SEQ ID NO: 89219 - DNA, 300 bp, Artificial Sequence
  Description of Artificial Sequence: Synthetic coding sequence
atggtgcacctgaccaccctgctgtgcaaggcctacagaggcggccacctgaccatcagactggccctgggcggctgcaccaacagacccttctacagaatcgtggccgcccacaacaagtgccccagagacggcagattcgtggagcagctgggcagctacgaccccctgcccaacagccacggcgagaagctggtggccctgaacctggacagaatcagacactggatcggctgcggcgcccacctgagcaagcccatggagaagctgctgggcctgaagtacagccacgtgttctag

SEQ ID NO: 89220 - DNA, 414 bp, Artificial Sequence
  Description of Artificial Sequence: Synthetic coding sequence
atggtgcacctgaccaccctgctgtgcaaggcctacagaggcggccacctgaccatcagactggccctgggcggctgcaccaacagacccttctacagaatcgtggccgcccacaacaagtgccccagagacggcagattcgtggagcagctgggcagctacgaccccctgcccaacagccacggcgagaagctggtggccctgaacctggacagaatcagacactggatcggctgcggcgcccacctgagcaagcccatggagaagctgctgggcctggccggcttcttccccctgcaccccatgatgatcaccaacgccgagagactgagaagaaagagagccagagaggtgctgctggccagccagaagaccgacgccgaggccaccgacaccgaggccaccgagacctag

SEQ ID NO: 89221 - DNA, 372 bp, Artificial Sequence
  Description of Artificial Sequence: Synthetic coding sequence
atggtgcacctgaccaccctgctgtgcaaggcctacagaggcggccacctgaccatcagactggccctgggcggctgcaccaacagacccttctacagaatcgtggccgcccacaacaagtgccccagagacggcagattcgtggagcagctgggcagctacgaccccctgcccaacagccacggcgagaagctggtggccctgaacctggacagaatcagacactggatcggctgcggcgcccacctgagcaagcccatggagaagctgctgggcaagaccgacgccagattccccgagcagggcgaggagagacccgagcagcaccacttccccgaggacctggcccccgccagaggcagaggcctgtag

SEQ ID NO: 89222 - DNA, 393 bp, Artificial Sequence
  Description of Artificial Sequence: Synthetic coding sequence
atgagcgtggtgagaagcagcgtgcacgccagatggatcgtgggcaaggtgatcggcaccaagatgcagaagaccgccaaggtgagagtgaccagactggtgctggacccctacctgctgaagtacttcaacaagagaaagacctacttcgcccacgacgccctgcagcagtgcaccgtgggcgacatcgtgctgctgagagccctgcccgtgcccagagccaagcacgtgaagcacgagctggccgagatcgtgttcaaggtgggcaaggtgatcgaccccgtgaccggcaagccctgcgccggcaccacctacctggagagccccctgagcagcgagaccacccagctgagcaagaacctggaggagctgaacatcagcagcgcccagtag

SEQ ID NO: 89223 - DNA, 390 bp, Artificial Sequence
  Description of Artificial Sequence: Synthetic coding sequence
atgagcgtggtgagaagcagcgtgcacgccagatggatcgtgggcaaggtgatcggcaccaagatgcagaagaccgccaaggtgagagtgaccagactggtgctggacccctacctgctgaagtacttcaacaagagaaagacctacttcgcccacgacgccctgcagcagtgcaccgtgggcgacatcgtgctgctgagagccctgcccgtgcccagagccaagcacgtgaagcacgagctggccgagatcgtgttcaaggtgggcaaggtgatcgaccccgtgaccggcaagccctgcgccggcaccacctacctggagagccccctgagcagcgagaccacccagctgagcaagaacctggaggagctgaacatcagcagcgcctag

SEQ ID NO: 89224 - DNA, 384 bp, Artificial Sequence
  Description of Artificial Sequence: Synthetic coding sequence
atggccgccctgaaggccctggtgagcggctgcggcagactgctgagaggcctgctggccggccccgccgccaccagctggagcagactgcccgccagaggcttcagagaggtggtggagacccaggagggcaagaccaccatcatcgagggcagaatcaccgccacccccaaggagagccccaacccccccaaccccagcggccagtgccccatctgcagatggaacctgaagcacaagtacaactacgacgacgtgctgctgctgagccagttcatcagaccccacggcggcatgctgcccagaaagatcaccggcctgtgccaggaggagcacagaaagatcgaggagtgcgtgaagatggcccacagagccggcacctag

SEQ ID NO: 89225 - DNA, 813 bp, Artificial Sequence
  Description of Artificial Sequence: Synthetic coding sequence
atggccgccctgaaggccctggtgagcggctgcggcagactgctgagaggcctgctggccggccccgccgccaccagctggagcagactgcccgccagaggcttcagagaggtggtggagacccaggagggcaagaccaccatcatcgagggcagaatcaccgccacccccaaggagagccccaacccccccaaccccagcggccagtgccccatctgcagatggaacctgaagcacaagtacaactacgacgacgtgctgctgctgagccagttcatcagaccccacggcggcatgctgcccagaaagatcaccggcctgtgccaggaggagcacagaaagatcgaggagtgcgtgaagatggcccacagagccggcagaagaccctggggccccagaggcgccgagggctgcagacacagcctgcccacccagctgccccacgtgagcgccccccccggcagaaaggtggacatcagaagcgtgaactacacccaccaccccatgcccaccttccccctgccctgggccttccccctggcccccagcgagctgcagagagagctgcagagactgagccccctgcccagacacagcggcctgctgcccaaccacagacccagactgcccgagggcgtggtgcccaagagcaagccccagctgaacagatacctgaccagatgggcccccggcagcgtgaagcccatctacaagaagggccccagatggaacagagtgagaatgcccgtgggcagccccctgctgagagacaacgtgtgctacagcagaaccccctggaagctgtaccactag

SEQ ID NO: 89226 - DNA, 591 bp, Artificial Sequence
  Description of Artificial Sequence: Synthetic coding sequence
atggccgccctgaaggccctggtgagcggctgcggcagactgctgagaggcctgctggccggccccgccgccaccagctggagcagactgcccgccagaggcttcagagaggtggtggagacccaggagggcaagaccaccatcatcgagggcagaatcaccgccacccccaaggagagccccaacccccccaaccccagcggccagtgccccatctgcagatggaacctgaagcacaagtacaactacgacgacgtgctgctgctgagccagttcatcagaccccacggcggcatgctgcccagaaagatcaccggcctgtgccaggaggagcacagaaagatcgaggagtgcgtgaagatggcccacagagccggcctgctgcccaaccacagacccagactgcccgagggcgtggtgcccaagagcaagccccagctgaacagatacctgaccagatgggcccccggcagcgtgaagcccatctacaagaagggccccagatggaacagagtgagaatgcccgtgggcagccccctgctgagagacaacgtgtgctacagcagaaccccctggaagctgtaccactag

SEQ ID NO: 89227 - DNA, 795 bp, Artificial Sequence
  Description of Artificial Sequence: Synthetic coding sequence
atggccgccctgaaggccctggtgagcggctgcggcagactgctgagaggcctgctggccggccccgccgccaccagctggagcagactgcccgccagaggcttcagagaggtggtggagacccaggagggcaagaccaccatcatcgagggcagaatcaccgccacccccaaggagagccccaacccccccaaccccagcggccagtgccccatctgcagatggaacctgaagcacaagtacaactacgacgacgtgctgctgctgagccagttcatcagaccccacggcggcatgctgcccagaaagatcaccggcctgtgccaggaggagcacagaaagatcgaggagtgcgtgaagatggcccacagagccggcagaagaccctggggccccagaggcgccgagggctgcagacacagcctgcccacccagctgccccacgtgagcgccccccccggcagaaaggtggacatcagaagcgtgaactacacccaccaccccatgcccaccttccccctgccctgggccttccccctggcccccagcgagctgcagagagagctgcagagactgagccccctgcccagacacagcggcctgctgcccaaccacagacccagactgcccgagggcgtggtgcccaagagcaagccccagctgaacagatacctgaccagatgggcccccggcagcgtgaagcccatctacaagaagggccccagatggaacagagtgagaatgcccgtgggcagccccctgctgagagacaacgtgtgctacagcagaacctag

SEQ ID NO: 89228 - DNA, 777 bp, Artificial Sequence
  Description of Artificial Sequence: Synthetic coding sequence
atggccgccagcgtgctgaacaccgtgctgagaagactgcccatgctgagcctgttcagaggcagccacagagtgcaggtgcccctgcagaccctgtgcaccaaggcccccagcgaggaggacagcctgagcagcgtgcccatcagcccctacaaggacgagccctggaagtacctggagagcgaggagtaccaggagagatacggcagcagacccgtgtgggccgactacagaagaaaccacaagggcggcgtgcccccccagagaaccagaaagacctgcatcagaagaaacaaggtggtgggcaacccctgccccatctgcagagaccacaagctgcacgtggacttcagaaacgtgaagctgctggagcagttcgtgtgcgcccacaccggcatcatcttctacgccccctacaccggcgtgtgcgtgaagcagcacaagagactgacccaggccatccagaaggccagagaccacggcctgctgatctaccacatcccccaggtggagcccagagacctggacttcagcaccagccacggcgccgtgagcgccaccccccccgcccccaccctggtgagcggcgacccctggtacccctggtacaactggaagcagccccccgagagagagctgagcagactgagaagactgtaccagggccacctgcaggaggagagcggccccccccccgagagcatgcccaagatgccccccagaacccccgccgaggccagcagcaccggccagaccggcccccagagcgccctgtag

SEQ ID NO: 89229 - DNA, 777 bp, Artificial Sequence; identical to SEQ ID NO: 89228
  Description of Artificial Sequence: Synthetic coding sequence

SEQ ID NO: 89230 - DNA, 648 bp, Artificial Sequence
  Description of Artificial Sequence: Synthetic coding sequence
atggccgccagcgtgctgaacaccgtgctgagaagactgcccatgctgagcctgttcagaggcagccacagagtgcaggtgcccctgcagaccctgtgcaccaaggcccccagcgaggaggacagcctgagcagcgtgcccatcagcccctacaaggacgagccctggaagtacctggagagcgaggagtaccaggagagatacggcagcagacccgtgtgggccgactacagaagaaaccacaagggcggcgtgcccccccagagaaccagaaagacctgcatcaacgtgaagctgctggagcagttcgtgtgcgcccacaccggcatcatcttctacgccccctacaccggcctgctgatctaccacatcccccaggtggagcccagagacctggacttcagcaccagccacggcgccgtgagcgccaccccccccgcccccaccctggtgagcggcgacccctggtacccctggtacaactggaagcagccccccgagagagagctgagcagactgagaagactgtaccagggccacctgcaggaggagagcggccccccccccgagagcatgcccaagatgccccccagaacccccgccgaggccagcagcaccggccagaccggcccccagagcgccctgtag

SEQ ID NO: 89231 - DNA, 648 bp, Artificial Sequence; identical to SEQ ID NO: 89230
  Description of Artificial Sequence: Synthetic coding sequence

SEQ ID NO: 89232 - DNA, 777 bp, Artificial Sequence; identical to SEQ ID NO: 89228
  Description of Artificial Sequence: Synthetic coding sequence

SEQ ID NO: 89233 - DNA, 648 bp, Artificial Sequence; identical to SEQ ID NO: 89230
  Description of Artificial Sequence: Synthetic coding sequence

SEQ ID NO: 89234 - DNA, 648 bp, Artificial Sequence; identical to SEQ ID NO: 89230
  Description of Artificial Sequence: Synthetic coding sequence

SEQ ID NO: 89235 - DNA, 777 bp, Artificial Sequence; identical to SEQ ID NO: 89228
  Description of Artificial Sequence: Synthetic coding sequence

SEQ ID NO: 89236 - DNA, 648 bp, Artificial Sequence; identical to SEQ ID NO: 89230
  Description of Artificial Sequence: Synthetic coding sequence

SEQ ID NO: 89237 - DNA, 777 bp, Artificial Sequence; identical to SEQ ID NO: 89228
  Description of Artificial Sequence: Synthetic coding sequence

SEQ ID NO: 89238 - DNA, 648 bp, Artificial Sequence; identical to SEQ ID NO: 89230
  Description of Artificial Sequence: Synthetic coding sequence

SEQ ID NO: 89239 - DNA, 648 bp, Artificial Sequence; identical to SEQ ID NO: 89230
  Description of Artificial Sequence: Synthetic coding sequence

SEQ ID NO: 89240 - DNA, 777 bp, Artificial Sequence; identical to SEQ ID NO: 89228
  Description of Artificial Sequence: Synthetic coding sequence

SEQ ID NO: 89241 - DNA, 777 bp, Artificial Sequence; identical to SEQ ID NO: 89228
  Description of Artificial Sequence: Synthetic coding sequence

SEQ ID NO: 89242 - DNA, 366 bp, Artificial Sequence
  Description of Artificial Sequence: Synthetic coding sequence
atggccgccagcgtgctgaacaccgtgctgagaagactgcccatgctgagcctgttcagaggcagccacagagtgcaggtgcccctgcagaccctgtgcaccaaggcccccagcgaggaggacagcctgagcagcgtgcccatcagcccctacaaggacgagccctggaagtacctggagagcgaggagtaccaggagagatacggcagcagacccgtgtgggccgactacagaagaaaccacaagggcggcgtgcccccccagagaaccagaaagacctgcatcagaagaaacaaggtggtgggcaacccctgccccatctgcagagaccacaagctgcacgtggacttcagagagagcgtgtag

SEQ ID NO: 89243 - DNA, 366 bp, Artificial Sequence; identical to SEQ ID NO: 89242
  Description of Artificial Sequence: Synthetic coding sequence

SEQ ID NO: 89244 - DNA, 366 bp, Artificial Sequence; identical to SEQ ID NO: 89242
  Description of Artificial Sequence: Synthetic coding sequence

SEQ ID NO: 89245 - DNA, 366 bp, Artificial Sequence; identical to SEQ ID NO: 89242
  Description of Artificial Sequence: Synthetic coding sequence

SEQ ID NO: 89246 - DNA, 366 bp, Artificial Sequence; identical to SEQ ID NO: 89242
  Description of Artificial Sequence: Synthetic coding sequence

SEQ ID NO: 89247 - DNA, 366 bp, Artificial Sequence; identical to SEQ ID NO: 89242
  Description of Artificial Sequence: Synthetic coding sequence

SEQ ID NO: 89248 - DNA, 366 bp, Artificial Sequence; identical to SEQ ID NO: 89242
  Description of Artificial Sequence: Synthetic coding sequence

SEQ ID NO: 89249 - DNA, 429 bp, Artificial Sequence
  Description of Artificial Sequence: Synthetic coding sequence
atggccgccgtggtggccgtgtgcggcggcctgggcagaaagaagctgacccacctggtgaccgccgccgtgagcctgacccaccccggcacccacaccgtgctgtggagaagaggctgcagccagcaggtgagcagcaacgaggacctgcccatcagcatggagaacccctacaaggagcccctgaagaagtgcatcctgtgcggcaagcacgtggactacaagaacgtgcagctgctgagccagttcgtgagccccttcaccggctgcatctacggcagacacatcaccggcctgtgcggcaagaagcagaaggagatcaccaaggccatcaagagagcccagatcatgggcttcatgcccgtgacctacaaggaccccgcctacctgaaggaccccaaggtgtgcaacatcagatacagagagtag

SEQ ID NO: 89250 - DNA, 345 bp, Artificial Sequence
  Description of Artificial Sequence: Synthetic coding sequence
atggccgccgtggtggccgtgtgcggcggcctgggcagaaagaagctgacccacctggtgaccgccgccgtgagcctgacccaccccggcacccacaccgtgctgtggagaagaggctgcagccagcaggtgagcagcaacgaggacctgctgctgagccagttcgtgagccccttcaccggctgcatctacggcagacacatcaccggcctgtgcggcaagaagcagaaggagatcaccaaggccatcaagagagcccagatcatgggcttcatgcccgtgacctacaaggaccccgcctacctgaaggaccccaaggtgtgcaacatcagatacagagagtag

SEQ ID NO: 89251 - DNA, 891 bp, Artificial Sequence
  Description of Artificial Sequence: Synthetic coding sequence
atggccaccagcagcgccgccctgcccagaatcctgggcgccggcgccagagcccccagcagatggctgggcttcctgggcaaggccacccccagacccgccagacccagcagaagaaccctgggcagcgccaccgccctgatgatcagagagagcgaggacagcaccgacttcaacgacaagatcctgaacgagcccctgaagcacagcgacttcttcaacgtgaaggagctgttcagcgtgagaagcctgttcgacgccagagtgcacctgggccacaaggccggctgcagacacagattcatggagccctacatcttcggcagcagactggaccacgacatcatcgacctggagcagaccgccacccacctgcagctggccctgaacttcaccgcccacatggcctacagaaagggcatcatcctgttcatcagcagaaacagacagttcagctacctgatcgagaacatggccagagactgcggcgagtacgcccacaccagatacttcagaggcggcatgctgaccaacgccagactgctgttcggccccaccgtgagactgcccgacctgatcatcttcctgcacaccctgaacaacatcttcgagccccacgtggccgtgagagacgccgccaagatgaacatccccaccgtgggcatcgtggacaccaactgcaacccctgcctgatcacctaccccgtgcccggcaacgacgacagccccctggccgtgcacctgtactgcagactgttccagaccgccatcaccagagccaaggagaagagacagcaggtggaggccctgtacagactgcagggccagaaggagcccggcgaccagggccccgcccacccccccggcgccgacatgagccacagcctgtag

SEQ ID NO: 89252 - DNA, 891 bp, Artificial Sequence; identical to SEQ ID NO: 89251
  Description of Artificial Sequence: Synthetic coding sequence

SEQ ID NO: 89253 - DNA, 813 bp, Artificial Sequence
  Description of Artificial Sequence: Synthetic coding sequence
agaagaggccccctgggcatgagatggggcgccggcgtggtgcacagcggcctgggcgccagaaccagcatctacttcccccccggcgccagagcccccagcagatggctgggcttcctgggcaaggccacccccagacccgccagacccagcagaagaaccctgggcagcgccaccgccctgatgatcagagagagcgaggacagcaccgacttcaacgacaagatcctgaacgagcccctgaagcacagcgacttcttcaacgtgaaggagctgttcagcgtgagaagcctgttcgacgccagagtgcacctgggccacaaggccggctgcagacacagattcatggagccctacatcttcggcagcagactggaccacgacatcatcgacctggagcagaccgccacccacctgcagctggccctgaacttcaccgcccacatggcctacagaaagggcatcatcctgttcatcagcagaaacagacagttcagctacctgatcgagaacatggccagagactgcggcgagtacgcccacaccagatacttcagaggcggcatgctgaccaacgccagactgctgttcggccccaccgtgagactgcccgacctgatcatcttcctgcacaccctgaacaacatcttcgagccccacgtggccgtgagagacgccgccaagatgaacatccccaccgtgggcatcgtggacaccaactgcaacccctgcctgatcacctaccccgtgcccggcaacgacgacagccccctggccgtgcacctgtactgcagactgttccagaccgcctag

SEQ ID NO: 89254 - DNA, 264 bp, Artificial Sequence
  Description of Artificial Sequence: Synthetic coding sequence
atggccaagcacctgaagttcatcgccagaaccgtgatggtgcaggagggcaacgtggagagcgcctacagaaccctgaacagaatcctgaccatggacggcctgatcgaggacatcaagcacagaagatactacgagaagccctgcagaagaagacagagagagagctacgagagatgcagaagaatctacaacatggagatggccagaaagatcaacttcctgatgagaaagaacagagccgacccctggcagggctgctag

SEQ ID NO: 89255 - DNA, 264 bp, Artificial Sequence; identical to SEQ ID NO: 89254
  Description of Artificial Sequence: Synthetic coding sequence

SEQ ID NO: 89256 - DNA, 1083 bp, Artificial Sequence
  Description of Artificial Sequence: Synthetic coding sequence
atggcccccctgggcaccaccgtgctgctgtggagcctgctgagaagcagccccggcgtggagagagtgtgcttcagagccagaatccagccctggcacggcggcctgctgcagcccctgccctgcagcttcgagatgggcctgcccagaagaagattcagcagcgaggccgccgagagcggcagccccgagaccaagaagcccaccttcatggacgaggaggtgcagagcatcctgaccaagatgaccggcctgaacctgcagaagaccttcaagcccgccatccaggagctgaagccccccacctacaagctgatgacccaggcccagctggaggaggccaccagacaggccgtggaggccgccaaggtgagactgaagatgccccccgtgctggaggagagagtgcccatcaacgacgtgctggccgaggacaagatcctggagggcaccgagaccaccaagtacgtgttcaccgacatcagctacagcatcccccacagagagagattcatcgtggtgagagagcccagcggcaccctgagaaaggccagctgggaggagagagacagaatgatccaggtgtacttccccaaggagggcagaaagatcctgacccccatcatcttcaaggaggagaacctgagaaccatgtacagccaggacagacacgtggacgtgctgaacctgtgcttcgcccagttcgagcccgacagcaccgagtacatcaaggtgcaccacaagacctacgaggacatcgacaagagaggcaagtacgacctgctgagaagcaccagatacttcggcggcatggtgtggtacttcgtgaacaacaagaagatcgacggcctgctgatcgaccagatccagagagacctgatcgacgacgccaccaacctggtgcagctgtaccacgtgctgcaccccgacggccagagcgcccagggcgccaaggaccaggccgccgagggcatcaacctgatcaaggtgttcgccaagaccgaggcccagaagggcgcctacatcgagctgaccctgcagacctaccaggaggccctgagcagacacagcgccgccagctag

SEQ ID NO: 89257 - DNA, 1080 bp, Artificial Sequence
  Description of Artificial Sequence: Synthetic coding sequence
atggcccccctgggcaccaccgtgctgctgtggagcctgctgagaagcagccccggcgtggagagagtgtgcttcagagccagaatccagccctggcacggcggcctgctgcagcccctgccctgcagcttcgagatgggcctgcccagaagaagattcagcagcgaggccgagagcggcagccccgagaccaagaagcccaccttcatggacgaggaggtgcagagcatcctgaccaagatgaccggcctgaacctgcagaagaccttcaagcccgccatccaggagctgaagccccccacctacaagctgatgacccaggcccagctggaggaggccaccagacaggccgtggaggccgccaaggtgagactgaagatgccccccgtgctggaggagagagtgcccatcaacgacgtgctggccgaggacaagatcctggagggcaccgagaccaccaagtacgtgttcaccgacatcagctacagcatcccccacagagagagattcatcgtggtgagagagcccagcggcaccctgagaaaggccagctgggaggagagagacagaatgatccaggtgtacttccccaaggagggcagaaagatcctgacccccatcatcttcaaggaggagaacctgagaaccatgtacagccaggacagacacgtggacgtgctgaacctgtgcttcgcccagttcgagcccgacagcaccgagtacatcaaggtgcaccacaagacctacgaggacatcgacaagagaggcaagtacgacctgctgagaagcaccagatacttcggcggcatggtgtggtacttcgtgaacaacaagaagatcgacggcctgctgatcgaccagatccagagagacctgatcgacgacgccaccaacctggtgcagctgtaccacgtgctgcaccccgacggccagagcgcccagggcgccaaggaccaggccgccgagggcatcaacctgatcaaggtgttcgccaagaccgaggcccagaagggcgcctacatcgagctgaccctgcagacctaccaggaggccctgagcagacacagcgccgccagctag

SEQ ID NO: 89258 - DNA, 960 bp, Artificial Sequence
  Description of Artificial Sequence: Synthetic coding sequence
atgagcagaaacgagaccgagcacagatacctgggcacccacttcggcgccgagagcggcagccccgagaccaagaagcccaccttcatggacgaggaggtgcagagcatcctgaccaagatgaccggcctgaacctgcagaagaccttcaagcccgccatccaggagctgaagccccccacctacaagctgatgacccaggcccagctggaggaggccaccagacaggccgtggaggccgccaaggtgagactgaagatgccccccgtgctggaggagagagtgcccatcaacgacgtgctggccgaggacaagatcctggagggcaccgagaccaccaagtacgtgttcaccgacatcagctacagcatcccccacagagagagattcatcgtggtgagagagcccagcggcaccctgagaaaggccagctgggaggagagagacagaatgatccaggtgtacttccccaaggagggcagaaagatcctgacccccatcatcttcaaggaggagaacctgagaaccatgtacagccaggacagacacgtggacgtgctgaacctgtgcttcgcccagttcgagcccgacagcaccgagtacatcaaggtgcaccacaagacctacgaggacatcgacaagagaggcaagtacgacctgctgagaagcaccagatacttcggcggcatggtgtggtacttcgtgaacaacaagaagatcgacggcctgctgatcgaccagatccagagagacctgatcgacgacgccaccaacctggtgcagctgtaccacgtgctgcaccccgacggccagagcgcccagggcgccaaggaccaggccgccgagggcatcaacctgatcaaggtgttcgccaagaccgaggcccagaagggcgcctacatcgagctgaccctgcagacctaccaggaggccctgagcagacacagcgccgccagctag

SEQ ID NO: 89259 - DNA, 1083 bp, Artificial Sequence; identical to SEQ ID NO: 89256
  Description of Artificial Sequence: Synthetic coding sequence

SEQ ID NO: 89260 - DNA, 507 bp, Artificial Sequence
  Description of Artificial Sequence: Synthetic coding sequence
atggcccccctgggcaccaccgtgctgctgtggagcctgctgagaagcagccccggcgtggagagagtgtgcttcagagccagaatccagccctggcacggcggcctgctgcagcccctgccctgcagcttcgagatgggcctgcccagaagaagattcagcagcgaggccgagagcggcagccccgagaccaagaagcccaccttcatggacgaggaggtgcagagcatcctgaccaagatgaccggcctgaacctgcagaagaccttcaagcccgccatccaggagctgaagccccccacctacaagctgatgacccaggcccagctggaggaggccaccagacaggccgtggaggccgccaaggtgagactgaagatgccccccgtgctggaggagagagtgcccatcaacgacgtgctggccgaggacaagatcctggagggcaccgagaccaccaagtacgtgttcaccgacatcagctacagcatcccccacagatgctag

SEQ ID NO: 89261 - DNA, 573 bp, Artificial Sequence
  Description of Artificial Sequence: Synthetic coding sequence
atggccggcagcagactggagaccgtgggcagcatcttcagcagaaccagagacctggtgagagccggcgtgctgaaggagaagcccctgtggttcgacgtgtacgacgccttcccccccctgagagagcccgtgttccagagacccagagtgagatacggcaaggccaaggcccccatccaggacatctggtaccacgaggacagaatcagagccaagttctacagcgtgtacggcagcggccagagagccttcgacctgttcaaccccaacttcaagagcacctgccagagattcgtggagaagtacaccgagctgcagaagctgggcgagaccgacgaggagaagctgttcgtggagaccggcaaggccctgctggccgagggcgtgatcctgagaagagtgggcgaggccagaacccagcacggcggcagccacgtgagcagaaagagcgagcacctgagcgtgagaccccagaccgccctggaggagaacgagacccagaaggaggtgccccaggaccagcacctggaggcccccgccgaccagagcaagggcctgctgcccccctag

SEQ ID NO: 89262 - DNA, 504 bp, Artificial Sequence
  Description of Artificial Sequence: Synthetic coding sequence
atggccgccagcgtgtgcagcggcctgctgggccccagagtgctgagctggagcagagagctgccctgcgcctggagagccctgcacaccagccccgtgtgcgccaagaacagagccgccagagtgagagtgagcaagggcgacaagcccgtgacctacgaggaggcccacgccccccactacatcgcccacagaaagggctggctgagcctgcacaccggcaacctggacggcgaggaccacgccgccgagagaaccgtggaggacgtgttcctgagaaagttcatgtggggcaccttccccggctgcctggccgaccagctggtgctgaagagaagaggcaaccagctggagatctgcgccgtggtgctgagacagctgagcccccacaagtactacttcctggtgggctacagcgagaccctgctgagctacttctacaagtgccccgtgagactgcacctgcagaccgtgcccagcaaggtggtgtacaagtacctgtag

SEQ ID NO: 89263 - DNA, 522 bp, Artificial Sequence
  Description of Artificial Sequence: Synthetic coding sequence
atgcccatgaagggcagattccccatcagaagaaccctgcagtacctgagccagggcaacgtggtgttcaaggacagcgtgaaggtgatgaccgtgaactacaacacccacggcgagctgggcgagggcgccagaaagttcgtgttcttcaacatcccccagatccagtacaagaacccctgggtgcagatcatgatgttcaagaacatgacccccagccccttcctgagattctacctggacagcggcgagcaggtgctggtggacgtggagaccaagagcaacaaggagatcatggagcacatcagaaagatcctgggcaagaacgaggagaccctgagagaggaggaggaggagaagaagcagctgagccaccccgccaacttcggccccagaaagtactgcctgagagagtgcatctgcgaggtggagggccaggtgccctgccccagcctggtgcccctgcccaaggagatgagaggcaagtacaaggccgccctgaaggccgacgcccaggactag

SEQ ID NO: 89264 - DNA, 333 bp, Artificial Sequence
  Description of Artificial Sequence: Synthetic coding sequence
atgcccatgaagggcagattccccatcagaagaaccctgcagtacctgagccagggcaacgtggtgttcaaggacagcgtgaaggtgatgaccgtgaactacaacacccacggcgagctgggcgagggcgccagaaagttcgtgttcttcaacatcccccagatccagtacaagaacccctgggtgcagatcatgatgttcaagaacatgacccccagccccttcctgagattctacctggacagcggcgagcaggtgctggtggacgtggagaccaagagcaacaaggagatcatggagcacatcagaaagatcctgggcaagaacgagtag

SEQ ID NO: 89265 - DNA, 390 bp, Artificial Sequence
  Description of Artificial Sequence: Synthetic coding sequence
atgcccatgaagggcagattccccatcagaagaaccctgcagtacctgagccagggcaacgtggtgttcaaggacagcgtgaaggtgatgaccgtgaactacaacacccacggcgagctgggcgagggcgccagaaagttcgtgttcttcaacatcccccagatccagtacaagaacccctgggtgcagatcatgatgttcaagaacatgacccccagccccttcctgagattctacctgggcaagcccagcggcaagagaagaagaagaaagagcagcttcctgacccagcccaccagcgccctggagagcaccgcctgcggcagcgccagcgtgaagtggaagggcagatgccccgcccccgcctggtgccactaccccagaagatag

SEQ ID NO: 89266 - DNA, 333 bp, Artificial Sequence; identical to SEQ ID NO: 89264
  Description of Artificial Sequence: Synthetic coding sequence

SEQ ID NO: 89267 - DNA, 438 bp, Artificial Sequence
  Description of Artificial Sequence: Synthetic coding sequence
atgcccatgaagggcagattccccatcagaagaaccctgcagtacctgagccagggcaacgtggtgttcaaggacagcgtgaaggtgatgaccgtgaactacaacacccacggcgagctgggcgagggcgccagaaagttcgtgttcttcaacatcccccagatccagtacaagaacccctgggtgcagatcatgatgttcaagaacatgacccccagccccttcctgagattctacctggacagcggcgagcaggtgctggtggacgtggagaccaagagcaacaaggagatcatggagcacatcagaaagatcctgggcaagaacgagcactacctggccgcccccagcaagcccgtgagcagcgccgtggtgcccgtgacccaggaggccgaggccggcggcagcctggagcccagaagactgagactggagtag

SEQ ID NO: 89268 - DNA, 618 bp, Artificial Sequence
  Description of Artificial Sequence: Synthetic coding sequence
atgctgagagccctgagcagactgggcgccggcaccccctgcagacccagagcccccctggtgctgcccgccagaggcagaaagaccagacacgaccccctggccaagagcaagatcgagagagtgaacatgccccccgccgtggaccccgccgagttcttcgtgctgatggagagataccagcactacagacagaccgtgagagccctgagaatggagttcgtgagcgaggtgcagagaaaggtgcacgaggccagagccggcgtgctggccgagagaaaggccctgaaggacgccgccgagcacagagagctgatggcctggaaccaggccgagaacagaagactgcacgagctgagaatcgccagactgagacaggaggagagagagcaggagcagagacaggccctggagcaggccagaaaggccgaggaggtgcaggcctgggcccagagaaaggagagagaggtgctgcagctgcaggaggaggtgaagaacttcatcaccagagagaacctggaggccagagtggaggccgccctggacagcagaaagaactacaactgggccatcaccagagagggcctggtggtgagaccccagagaagagacagctag

SEQ ID NO: 89269 - DNA, 1245 bp, Artificial Sequence
  Description of Artificial Sequence: Synthetic coding sequence
atggccgccagcatcgtgagaagaggcatgctgctggccagacaggtggtgctgccccagctgagccccgccggcaagagatacctgctgagcagcgcctacgtggacagccacaagtgggaggccagagagaaggagcactactgcctggccgacctggccagcctgatggacaagaccttcgagagaaagctgcccgtgagcagcctgaccatcagcagactgatcgacaacatcagcagcagagaggagatcgaccacgccgagtactacctgtacaagttcagacacagccccaactgctggtacctgagaaactggaccatccacacctggatcagacagtgcctgaagtacgacgcccaggacaaggccctgtacaccctggtgaacaaggtgcagtacggcatcttccccgacaacttcaccttcaacctgctgatggacagcttcatcaagaaggagaactacaaggacgccctgagcgtggtgttcgaggtgatgatgcaggaggccttcgaggtgcccagcacccagctgctgagcctgtacgtgctgttccactgcctggccaagaagaccgacttcagctgggaggaggagagaaacttcggcgccagcctgctgctgcccggcctgaagcagaagaacagcgtgggcttcagcagccagctgtacggctacgccctgctgggcaaggtggagctgcagcagggcctgagagccgtgtaccacaacatgcccctgatctggaagcccggctacctggacagagccctgcaggtgatggagaaggtggccgccagccccgaggacatcaagctgtgcagagaggccctggacgtgctgggcgccgtgctgaaggccctgaccagcgccgacggcgccagcgaggagcagagccagaacgacgaggacaaccagggcagcgagaagctggtggagcagctggacatcgaggagaccgagcagagcaagctgccccagtacctggagagattcaaggccctgcacagcaagctgcaggccctgggcaagatcgagagcgagggcctgctgagcctgaccacccagctggtgaaggagaagctgagcacctgcgaggccgaggacatcgccacctacgagcagaacctgcagcagtggcacctggacctggtgcagctgatccagagagagcagcagcagagagagcaggccaagcaggagtaccaggcccagaaggccgccaaggccagcgcctag

SEQ ID NO: 89270 - DNA, 1077 bp, Artificial Sequence
  Description of Artificial Sequence: Synthetic coding sequence
atggacaagaccttcgagagaaagctgcccgtgagcagcctgaccatcagcagactgatcgacaacatcagcagcagagaggagatcgaccacgccgagtactacctgtacaagttcagacacagccccaactgctggtacctgagaaactggaccatccacacctggatcagacagtgcctgaagtacgacgcccaggacaaggccctgtacaccctggtgaacaaggtgcagtacggcatcttccccgacaacttcaccttcaacctgctgatggacagcttcatcaagaaggagaactacaaggacgccctgagcgtggtgttcgaggtgatgatgcaggaggccttcgaggtgcccagcacccagctgctgagcctgtacgtgctgttccactgcctggccaagaagaccgacttcagctgggaggaggagagaaacttcggcgccagcctgctgctgcccggcctgaagcagaagaacagcgtgggcttcagcagccagctgtacggctacgccctgctgggcaaggtggagctgcagcagggcctgagagccgtgtaccacaacatgcccctgatctggaagcccggctacctggacagagccctgcaggtgatggagaaggtggccgccagccccgaggacatcaagctgtgcagagaggccctggacgtgctgggcgccgtgctgaaggccctgaccagcgccgacggcgccagcgaggagcagagccagaacgacgaggacaaccagggcagcgagaagctggtggagcagctggacatcgaggagaccgagcagagcaagctgccccagtacctggagagattcaaggccctgcacagcaagctgcaggccctgggcaagatcgagagcgagggcctgctgagcctgaccacccagctggtgaaggagaagctgagcacctgcgaggccgaggacatcgccacctacgagcagaacctgcagcagtggcacctggacctggtgcagctgatccagagagagcagcagcagagagagcaggccaagcaggagtaccaggcccagaaggccgccaaggccagcgcctag

SEQ ID NO: 89271 - DNA, 1287 bp, Artificial Sequence
  Description of Artificial Sequence: Synthetic coding sequence
atggccgccagcatcgtgagaagaggcatgctgctggccagacaggtggtgctgccccagctgagccccgccggcaagagatacctgctgagcagcgcctacgtggacagccacaagtgggaggccagagagaaggagcactactgcctggccgacctggccagcctgatggacaagaccttcgagagaaagctgcccgtgagcagcctgaccatcagcagactgatcgacaacatcagcagcagagaggagatcgaccacgccgagtactacctgtacaagaagggcgagtgcagcagcagcaacccccagaactacagcagattcagacacagccccaactgctggtacctgagaaactggaccatccacacctggatcagacagtgcctgaagtacgacgcccaggacaaggccctgtacaccctggtgaacaaggtgcagtacggcatcttccccgacaacttcaccttcaacctgctgatggacagcttcatcaagaaggagaactacaaggacgccctgagcgtggtgttcgaggtgatgatgcaggaggccttcgaggtgcccagcacccagctgctgagcctgtacgtgctgttccactgcctggccaagaagaccgacttcagctgggaggaggagagaaacttcggcgccagcctgctgctgcccggcctgaagcagaagaacagcgtgggcttcagcagccagctgtacggctacgccctgctgggcaaggtggagctgcagcagggcctgagagccgtgtaccacaacatgcccctgatctggaagcccggctacctggacagagccctgcaggtgatggagaaggtggccgccagccccgaggacatcaagctgtgcagagaggccctggacgtgctgggcgccgtgctgaaggccctgaccagcgccgacggcgccagcgaggagcagagccagaacgacgaggacaaccagggcagcgagaagctggtggagcagctggacatcgaggagaccgagcagagcaagctgccccagtacctggagagattcaaggccctgcacagcaagctgcaggccctgggcaagatcgagagcgagggcctgctgagcctgaccacccagctggtgaaggagaagctgagcacctgcgaggccgaggacatcgccacctacgagcagaacctgcagcagtggcacctggacctggtgcagctgatccagagagagcagcagcagagagagcaggccaagcaggagtaccaggcccagaaggccgccaaggccagcgcctag

SEQ ID NO: 89272 - DNA, 564 bp, Artificial Sequence
  Description of Artificial Sequence: Synthetic coding sequence
atggccgccctgtgcagaaccagagccgtggccgccgagagccacttcctgagagtgttcctgttcttcagacccttcagaggcgtgggcaccgagagcggcagcgagagcggcagcagcaacgccaaggagcccaagaccagagccggcggcttcgccagcgccctggagagacacagcgagctgctgcagaaggtggagcccctgcagaagggcagccccaagaacgtggagagcttcgccagcatgctgagacacagccccctgacccagatgggccccgccaaggacaagctggtgatcggcagaatcttccacatcgtggagaacgacctgtacatcgacttcggcggcaagttccactgcgtgtgcagaagacccgaggtggacggcgagaagtaccagaagggcaccagagtgagactgagactgctggacctggagctgaccagcagattcctgggcgccaccaccgacaccaccgtgctggaggccaacgccgtgctgctgggcatccaggagagcaaggacagcagaagcaaggaggagcaccacgagaagtag

SEQ ID NO: 89273 - DNA, 1320 bp, Artificial Sequence
  Description of Artificial Sequence: Synthetic coding sequence
atggccgccgccagatgctggagacccctgctgagaggccccagactgagcctgcacaccgccgccaacgccgccgccaccgccaccgagaccacctgccaggacgtggccgccacccccgtggccagatacccccccatcgtggccagcatgaccgccgacagcaaggccgccagactgagaagaatcgagagatggcaggccaccgtgcacgccgccgagagcgtggacgagaagctgagaatcctgaccaagatgcagttcatgaagtacatggtgtacccccagaccttcgccctgaacgccgacagatggtaccagtacttcaccaagaccgtgttcctgagcggcctgccccccccccccgccgagcccgagcccgagcccgagcccgagcccgagcccgccctggacctggccgccctgagagccgtggcctgcgactgcctgctgcaggagcacttctacctgagaagaagaagaagagtgcacagatacgaggagagcgaggtgatcagcctgcccttcctggaccagctggtgagcaccctggtgggcctgctgagcccccacaaccccgccctggccgccgccgccctggactacagatgccccgtgcacttctactgggtgagaggcgaggagatcatccccagaggccacagaagaggcagaatcgacgacctgagataccagatcgacgacaagcccaacaaccagatcagaatcagcaagcagctggccgagttcgtgcccctggactacagcgtgcccatcgagatccccaccatcaagtgcaagcccgacaagctgcccctgttcaagagacagtacgagaaccacatcttcgtgggcagcaagaccgccgacccctgctgctacggccacacccagttccacctgctgcccgacaagctgagaagagagagactgctgagacagaactgcgccgaccagatcgaggtggtgttcagagccaacgccatcgccagcctgttcgcctggaccggcgcccaggccatgtaccagggcttctggagcgaggccgacgtgaccagacccttcgtgagccaggccgtgatcaccgacggcaagtacttcagcttcttctgctaccagctgaacaccctggccctgaccacccaggccgaccagaacaaccccagaaagaacatctgctggggcacccagagcaagcccctgtacgagaccatcgaggacaacgacgtgaagggcttcaacgacgacgtgctgctgcagatcgtgcacttcctgctgaacagacccaaggaggagaagagccagctgctggagaactag

SEQ ID NO: 89274 - DNA, 1188 bp, Artificial Sequence
  Description of Artificial Sequence: Synthetic coding sequence
atgttccccagagtgagcaccttcctgcccctgagacccctgagcagacaccccctgagcagcggcagccccgagaccagcgccgccgccatcatgctgctgaccgtgagacacggcaccgtgagatacagaagcagcgccctgctggccagaaccaagaacaacatccagagatacttcggcaccaacagcgtgatctgcagcaagaaggacaagcagagcgtgagaaccgaggagaccagcaaggagaccagcgagagccaggacagcgagaaggagaacaccaagaaggacctgctgggcatcatcaagggcatgaaggtggagctgagcaccgtgaacgtgagaaccaccaagccccccaagagaagacccctgaagagcctggaggccaccctgggcagactgagaagagccaccgagtacgcccccaagaagagaatcgagcccctgagccccgagctggtggccgccgccagcgccgtggccgacagcctgcccttcgacaagcagaccaccaagagcgagctgctgagccagctgcagcagcacgaggaggagagcagagcccagagagacgccaagagacccaagatcagcttcagcaacatcatcagcgacatgaaggtggccagaagcgccaccgccagagtgagaagcagacccgagctgagaatccagttcgacgagggctacgacaactaccccggccaggagaagaccgacgacctgaagaagagaaagaacatcttcaccggcaagagactgaacatcttcgacatgatggccgtgaccaaggaggcccccgagaccgacaccagccccagcctgtgggacgtggagttcgccaagcagctggccaccgtgaacgagcagcccctgcagaacggcttcgaggagctgatccagtggaccaaggagggcaagctgtgggagttccccatcaacaacgaggccggcttcgacgacgacggcagcgagttccacgagcacatcttcctggagaagcacctggagagcttccccaagcagggccccatcagacacttcatggagctggtgacctgcggcctgagcaagaacccctacctgagcgtgaagcagaaggtggagcacatcgagtggttcagaaactacttcaacgagaagaaggacatcctgaaggagagcaacatccagttcaactag

SEQ ID NO: 89275 - DNA, 321 bp, Artificial Sequence
  Description of Artificial Sequence: Synthetic coding sequence
atgagcagcctgagcgagtacgccttcagaatgagcagactgagcgccagactgttcggcgaggtgaccagacccaccaacagcaagagcatgaaggtggtgaagctgttcagcgagctgcccctggccaagaagaaggagacctacgactggtaccccaaccaccacacctacgccgagctgatgcagaccctgagattcctgggcctgtacagagacgagcaccaggacttcatggacgagcagaagagactgaagaagctgagaggcaaggagaagcccaagaagggcgagggcaagagagccgccaagagaaagtag

SEQ ID NO: 89276 - DNA, 321 bp, Artificial Sequence; identical to SEQ ID NO: 89275
  Description of Artificial Sequence: Synthetic coding sequence

SEQ ID NO: 89277 - DNA, 321 bp, Artificial Sequence; identical to SEQ ID NO: 89275
  Description of Artificial Sequence: Synthetic coding sequence

SEQ ID NO: 89278 - DNA, 321 bp, Artificial Sequence; identical to SEQ ID NO: 89275
  Description of Artificial Sequence: Synthetic coding sequence

SEQ ID NO: 89279 - DNA, 339 bp, Artificial Sequence
  Description of Artificial Sequence: Synthetic coding sequence
atgagcagcctgagcgagtacgccttcagaatgagcagactgagcgccagactgttcggcgaggtgaccagacccaccaacagcaagagcatgaaggtggtgaagctgttcagcgagctgcccctggccaagaagaaggagacctacgactggtaccccaaccaccacacctacgccgagctgatgcagaccctgagattcctgggcctgtacagagacgagcaccaggacttcatggacgagcagaagagactgaagaagctgagaggcaaggagaagcccaagaagggcgagggcaagagagccgccaagagaaagaagaagaagaagaagagatag

SEQ ID NO: 89280 - DNA, 678 bp, Artificial Sequence
  Description of Artificial Sequence: Synthetic coding sequence
atggccagaaagaaggtgagacccagactgatcgccgagctggccagaagagtgagagccctgagagagcagctgaacagacccagagacagccagctgtacgccgtggactacgagaccctgaccagacccttcagcggcagaagactgcccgtgagagcctgggccgacgtgagaagagagagcagactgctgcagctgctgggcagactgcccctgttcggcctgggcagactggtgaccagaaagagctggctgtggcagcacgacgagccctgctactggagactgaccagagtgagacccgactacaccgcccagaacctggaccacggcaaggcctggggcatcctgaccttcaaggacgccagcttcagcagcagcggcaagaccgagagcgaggccagagagatcgagcacgtgatgtaccacgactggagactggtgcccaagcacgaggaggaggccttcaccgccttcacccccgcccccgaggacagcctggccagcgtgccctacccccccctgctgagagccatgatcatcgccgagagacagaagaacggcgacaccagcaccgaggagcccatgctgaacgtgcagagaatcagaatggagccctgggactaccccgccaagcaggaggacaagggcagagccaagggcacccccgtgtag

SEQ ID NO: 89281 - DNA, 657 bp, Artificial Sequence
  Description of Artificial Sequence: Synthetic coding sequence
atggccagaaagaaggtgagacccagactgatcgccgagctggccagaagagtgagagccctgagagagcagctgaacagacccagagacagccagctgtacgccgtggactacgagaccctgaccagacccttcagcggcagaagactgcccgtgagagcctgggccgacgtgagaagagagagcagactgctgcagctgctgggcagactgcccctgttcggcctgggcagactggtgaccagaaagagctggctgtggcagcacgacgagccctgctactggagactgaccagagtgagacccgactacaccgcccagaacctggaccacggcaaggcctggggcatcctgaccttcaagggcaagaccgagagcgaggccagagagatcgagcacgtgatgtaccacgactggagactggtgcccaagcacgaggaggaggccttcaccgccttcacccccgcccccgaggacagcctggccagcgtgccctacccccccctgctgagagccatgatcatcgccgagagacagaagaacggcgacaccagcaccgaggagcccatgctgaacgtgcagagaatcagaatggagccctgggactaccccgccaagcaggaggacaagggcagagccaagggcacccccgtgtag

SEQ ID NO: 89282 - DNA, 972 bp, Artificial Sequence
  Description of Artificial Sequence: Synthetic coding sequence
atggccgccgccgccctgcccgcctggctgagcctgcagagcagagccagaaccctgagagccttcagcaccgccgtgtacagcgccacccccgtgcccacccccagcctgcccgagagaacccccggcaacgagagaccccccagaagaaaggccctgccccccagaaccgagaagatggccgtggaccaggactggcccagcgtgtaccccgtggccgcccccttcaagcccagcgccgtgcccctgcccgtgagaatgggctaccccgtgaagaagggcgtgcccatggccaaggagggcaacctggagctgctgaagatccccaacttcctgcacctgacccccgtggccatcaagaagcactgcgaggccctgaaggacttctgcaccgagtggcccgccgccctggacagcgacgagaagtgcgagaagcacttccccatcgagatcgacagcaccgactacgtgagcagcggccccagcgtgagaaaccccagagccagagtggtggtgctgagagtgaagctgagcagcctgaacctggacgaccacgccaagaagaagctgatcaagctggtgggcgagagatactgcaagaccaccgacgtgctgaccatcaagaccgacagatgccccctgagaagacagaactacgactacgccgtgtacctgctgaccgtgctgtaccacgagagctggaacaccgaggagtgggagaagagcaagaccgaggccgacatggaggagtacatctgggagaacagcagcagcgagagaaacatcctggagaccctgctgcagatgaaggccgccgagaagaacatggagatcaacaaggaggagctgctgggcaccaaggagatcgaggagtacaagaagagcgtggtgagcctgaagaacgaggaggagaacgagaacagcatcagccagtacaaggagagcgtgaagagactgctgaacgtgacctag

SEQ ID NO: 89283 - DNA, 864 bp, Artificial Sequence
  Description of Artificial Sequence: Synthetic coding sequence
atggccgccgccgccctgcccgcctggctgagcctgcagagcagagccagaaccctgagagccttcagcaccgccgtgtacagcgccacccccgtgcccacccccagcctgcccgagagaacccccggcaacgagagaccccccagaagaaaggccctgccccccagaaccgagaagatggccgtggaccaggactggcccagcgtgtaccccgtggccgcccccttcaagcccagcgccgtgcccctgcccgtgagaatgggctaccccgtgaagaagggcgtgcccatggccaaggagggcaacctggagctgctgaagatccccaacttcctgcacctgacccccgtggccatcaagaagcactgcgaggccctgaaggacttctgcaccgagtggcccgccgccctggacagcgacgagaagtgcgagaagcacttccccatcgagatcgacagcaccgactacgtgagcagcggccccagcgtgagaaaccccagagccagagtggtggtgctgagaagatgccccctgagaagacagaactacgactacgccgtgtacctgctgaccgtgctgtaccacgagagctggaacaccgaggagtgggagaagagcaagaccgaggccgacatggaggagtacatctgggagaacagcagcagcgagagaaacatcctggagaccctgctgcagatgaaggccgccgagaagaacatggagatcaacaaggaggagctgctgggcaccaaggagatcgaggagtacaagaagagcgtggtgagcctgaagaacgaggaggagaacgagaacagcatcagccagtacaaggagagcgtgaagagactgctgaacgtgacctag

SEQ ID NO: 89284 - DNA, 585 bp, Artificial Sequence
  Description of Artificial Sequence: Synthetic coding sequence
atggccgccgccgccctgcccgcctggctgagcctgcagagcagagccagaaccctgagagccttcagcaccgccgtgtacagcgccacccccgtgcccacccccagcctgcccgagagaacccccggcaacgagagaccccccagaagaaaggccctgccccccagaaccgagaagatggccgtggaccaggactggcccagcgtgtaccccgtggccgcccccttcaagcccagcgccgtgcccctgcccgtgagaatgggctaccccgtgaagaagggcgtgcccatggccaaggagggcaacctggagctgctgaagatccccaacttcctgcacctgacccccgtggccatcaagaagcactgcgaggccctgaaggacttctgcaccgagtggcccgccgccctggacagcgacgagaagtgcgagaagcacttccccatcgagatcgacagcaccgactacgtgagcagcggccccagcgtgagaaaccccagagccagagtggtggtgctgagagtgcccttcaaggaggccgagctgagactgtgcagcgtgagcaccaacagcgtgatcccctag

SEQ ID NO: 89285 - DNA, 312 bp, Artificial Sequence
  Description of Artificial Sequence: Synthetic coding sequence
atgatgggcagcaagatggccagcgccagcagagtggtgcaggtggtgaagccccacacccccctgatcagattccccgacagaagagacaaccccaagcccaacgtgagcgaggccctgagaagcgccggcctgcccagccacagcagcgtgatcagccagcacagcaagggcagcaagagccccgacctgctgatgtaccagggcccccccgacaccgccgagatcatcaagaccctgccccagaagtacagaagaaagctggtgagccaggaggagatggagttcatccagagaggcggccccgagtag

SEQ ID NO: 89286 - DNA, 1293 bp, Artificial Sequence
  Description of Artificial Sequence: Synthetic coding sequence
atggccaccgccgtgagagccgtgggctgcctgcccgtgctgtgcagcggcaccgccggccacctgctgggcagacagtgcagcctgaacaccctgcccgccgccagcatcctggcctggaagagcgtgctgggcaacggccacctgagcagcctgggcaccagagacacccacccctacgccagcctgagcagagccctgcagacccagtgctgcatcagcagccccagccacctgatgagccagcagtacagaccctacagcttcttcaccaagctgaccgccgacgagctgtggaagggcgccctggccgagaccggcgccggcgccaagaagggcagaggcaagagaaccaagaagaagaagagaaaggacctgaacagaggccagatcatcggcgagggcagatacggcttcctgtggcccggcctgaacgtgcccctgatgaagaacggcgccgtgcagaccatcgcccagagaagcaaggaggagcaggagaaggtggaggccgacatgatccagcagagagaggagtgggacagaaagaagaagatgaaggtgaagagagagagaggctggagcggcaacagctggggcggcatcagcctgggcccccccgaccccggcccctgcggcgagacctacgaggacttcgacaccagaatcctggaggtgagaaacgtgttcaccatgaccgccaaggagggcagaaagaagagcatcagagtgctggtggccgtgggcaacggcaagggcgccgccggcttcagcatcggcaaggccaccgacagaatggacgccttcagaaaggccaagaacagagccgtgcaccacctgcactacatcgagagatacgaggaccacaccatcttccacgacatcagcctgagattcaagagaacccacatcaagatgaagaagcagcccaagggctacggcctgagatgccacagagccatcatcaccatctgcagactgatcggcatcaaggacatgtacgccaaggtgagcggcagcatcaacatgctgagcctgacccagggcctgttcagaggcctgagcagacaggagacccaccagcagctggccgacaagaagggcctgcacgtggtggagatcagagaggagtgcggccccctgcccatcgtggtggccagccccagaggccccctgagaaaggaccccgagcccgaggacgaggtgcccgacgtgaagctggactgggaggacgtgaagaccgcccagggcatgaagagaagcgtgtggagcaacctgaagagagccgccacctag

SEQ ID NO: 89287 - DNA, 378 bp, Artificial Sequence
  Description of Artificial Sequence: Synthetic coding sequence
atgcccagatacgagctggccctgatcctgaaggccatgcagagacccgagaccgccgccaccctgaagagaaccatcgaggccctgatggacagaggcgccatcgtgagagacctggagaacctgggcgagagagccctgccctacagaatcagcgcccacagccagcagcacaacagaggcggctacttcctggtggacttctacgcccccaccgccgccgtggagagcatggtggagcacctgagcagagacatcgacgtgatcagaggcaacatcgtgaagcaccccctgacccaggagctgaaggagtgcgagggcatcgtgcccgtgcccctggccgagaagctgtacagcaccaagaagagaaagaagtag

SEQ ID NO: 89288 - DNA, 729 bp, Artificial Sequence
  Description of Artificial Sequence: Synthetic coding sequence
atggccgcccccgccgtgaaggtggccagaggctggagcggcctggccctgggcgtgagaagagccgtgctgcagctgcccggcctgacccaggtgagatggagcagatacagccccgagttcaaggaccccctgatcgacaaggagtactacagaaagcccgtggaggagctgaccgaggaggagaagtacgtgagagagctgaagaagacccagctgatcaaggccgcccccgccggcaagaccagcagcgtgttcgaggaccccgtgatcagcaagttcaccaacatgatgatgatcggcggcaacaaggtgctggccagaagcctgatgatccagaccctggaggccgtgaagagaaagcagttcgagaagtaccacgccgccagcgccgaggagcaggccaccatcgagagaaacccctacaccatcttccaccaggccctgaagaactgcgagcccatgatcggcctggtgcccatcctgaagggcggcagattctaccaggtgcccgtgcccctgcccgacagaagaagaagattcctggccatgaagtggatgatcaccgagtgcagagacaagaagcaccagagaaccctgatgcccgagaagctgagccacaagctgctggaggccttccacaaccagggccccgtgatcaagagaaagcacgacctgcacaagatggccgaggccaacagagccctggcccactacagatggtggtag

SEQ ID NO: 89289 - DNA, 1191 bp, Artificial Sequence
  Description of Artificial Sequence: Synthetic coding sequence
atggccgccccctgcgtgagctacggcggcgccgtgagctacagactgctgctgtggggcagaggcagcctggccagaaagcagggcctgtggaagaccgccgcccccgagctgcagaccaacgtgagaagccagatcctgagactgagacacaccgccttcgtgatccccaagaagaacgtgcccaccagcaagagagagacctacaccgaggacttcatcaagaagcagatcgaggagttcaacatcggcaagagacacctggccaacatgatgggcgaggaccccgagaccttcacccaggaggacatcgacagagccatcgcctacctgttccccagcggcctgttcgagaagagagccagacccgtgatgaagcaccccgagcagatcttccccagacagagagccatccagtggggcgaggacggcagacccttccactacctgttctacaccggcaagcagagctactacagcctgatgcacgacgtgtacggcatgctgctgaacctggagaagcaccagagccacctgcaggccaagagcctgctgcccgagaagaccgtgaccagagacgtgatcggcagcagatggctgatcaaggaggagctggaggagatgctggtggagaagctgagcgacctggactacatgcagttcatcagactgctggagaagctgctgaccagccagtgcggcgccgccgaggaggagttcgtgcagagattcagaagaagcgtgaccctggagagcaagaagcagctgatcgagcccgtgcagtacgacgagcagggcatggccttcagcaagagcgagggcaagagaaagaccgccaaggccgaggccatcgtgtacaagcacggcagcggcagaatcaaggtgaacggcatcgactaccagctgtacttccccatcacccaggacagagagcagctgatgttccccttccacttcgtggacagactgggcaagcacgacgtgacctgcaccgtgagcggcggcggcagaagcgcccaggccggcgccatcagactggccatggccaaggccctgtgcagcttcgtgaccgaggacgaggtggagtggatgagacaggccggcctgctgaccaccgaccccagagtgagagagagaaagaagcccggccaggagggcgccagaagaaagttcacctggaagaagagatag

SEQ ID NO: 89290 - DNA, 1122 bp, Artificial Sequence
  Description of Artificial Sequence: Synthetic coding sequence
atgtgggtgtgcagcaccctgtggagagtgagaacccccgccagacagtggagaggcctgctgcccgccagcggctgccacggccccgccgccagcagctacagcgccagcgccgagcccgccagagtgagagccctggtgtacggccaccacggcgaccccgccaaggtggtggagctgaagaacctggagctggccgccgtgagaggcagcgacgtgagagtgaagatgctggccgcccccatcaaccccagcgacatcaacatgatccagggcaactacggcttcctgcccgagctgcccgccgtgggcggcaacgagggcgtggcccaggtggtggccgtgggcagcaacgtgaccggcctgaagcccggcgactgggtgatccccgccaacgccggcctgggcacctggagaaccgaggccgtgttcagcgaggaggccctgatccaggtgcccagcgacatccccctgcagagcgccgccaccctgggcgtgaacccctgcaccgcctacagaatgctgatggacttcgagcagctgcagcccggcgacagcgtgatccagaacgccagcaacagcggcgtgggccaggccgtgatccagatcgccgccgccctgggcctgagaaccatcaacgtggtgagagacagacccgacatccagaagctgagcgacagactgaagagcctgggcgccgagcacgtgatcaccgaggaggagctgagaagacccgagatgaagaacttcttcaaggacatgccccagcccagactggccctgaactgcgtgggcggcaagagcagcaccgagctgctgagacagctggccagaggcggcaccatggtgacctacggcggcatggccaagcagcccgtggtggccagcgtgagcctgctgatcttcaaggacctgaagctgagaggcttctggctgagccagtggaagaaggaccacagccccgaccagttcaaggagctgatcctgaccctgtgcgacctgatcagaagaggccagctgaccgcccccgcctgcagccaggtgcccctgcaggactaccagagcgccctggaggccagcatgaagcccttcatcagcagcaagcagatcctgaccatgtag

SEQ ID NO: 89291 - DNA, 894 bp, Artificial Sequence
  Description of Artificial Sequence: Synthetic coding sequence
atgctggccgcccccatcaaccccagcgacatcaacatgatccagggcaactacggcttcctgcccgagctgcccgccgtgggcggcaacgagggcgtggcccaggtggtggccgtgggcagcaacgtgaccggcctgaagcccggcgactgggtgatccccgccaacgccggcctgggcacctggagaaccgaggccgtgttcagcgaggaggccctgatccaggtgcccagcgacatccccctgcagagcgccgccaccctgggcgtgaacccctgcaccgcctacagaatgctgatggacttcgagcagctgcagcccggcgacagcgtgatccagaacgccagcaacagcggcgtgggccaggccgtgatccagatcgccgccgccctgggcctgagaaccatcaacgtggtgagagacagacccgacatccagaagctgagcgacagactgaagagcctgggcgccgagcacgtgatcaccgaggaggagctgagaagacccgagatgaagaacttcttcaaggacatgccccagcccagactggccctgaactgcgtgggcggcaagagcagcaccgagctgctgagacagctggccagaggcggcaccatggtgacctacggcggcatggccaagcagcccgtggtggccagcgtgagcctgctgatcttcaaggacctgaagctgagaggcttctggctgagccagtggaagaaggaccacagccccgaccagttcaaggagctgatcctgaccctgtgcgacctgatcagaagaggccagctgaccgcccccgcctgcagccaggtgcccctgcaggactaccagagcgccctggaggccagcatgaagcccttcatcagcagcaagcagatcctgaccatgtag

SEQ ID NO: 89292 - DNA, 789 bp, Artificial Sequence
  Description of Artificial Sequence: Synthetic coding sequence
atgatccagggcaactacggcttcctgcccgagctgcccgccgtgggcggcaacgagggcgtggcccaggtggtggccgtgggcagcaacgtgaccggcctgaagcccggcgactgggtgatccccgccaacgccggcctgggcacctggagaaccgaggccgtgttcagcgaggaggccctgatccaggtgcccagcgacatccccctgcagagcgccgccaccctgggcgtgaacccctgcaccgcctacagaatgctgatggacttcgagcagctgcagcccggcgacagcgtgatccagaacgccagcaacagcggcgtgggccaggccgtgatccagatcgccgccgccctgggcctgagaaccatcaacgtggtgagagacagacccgacatccagaagctgagcgacagactgaagagcctgggcgccgagcacgtgatcaccgaggaggagctgagaagacccgagatgaagaacttcttcaagatcagaaagctgagactgagaaaggaggagatgctgaaccagaaccacatcgtgtacaagggcagcagagagagcgagctggccagcgtgagccccaacagcaagcccctgaacctgcccgagccccccccccacaacatgcccagacacgcccccgccaccgcctgcagccagctgtgctggtgggagaagctgcacagagccgccgccgccgtgagcgcctggagaaaccacggcaacctgtggggcgacggccaggccgccagaagaagcctgtgcgagcccgcccacttctag

SEQ ID NO: 89293 - DNA, 570 bp, Artificial Sequence
  Description of Artificial Sequence: Synthetic coding sequence
gccaccctgggcgtgaacccctgcaccgcctacagaatgctgatggacttcgagcagctgcagcccggcgacagcgtgatccagaacgccagcaacagcggcgtgggccaggccgtgatccagatcgccgccgccctgggcctgagaaccatcaacgtggtgagagacagacccgacatccagaagctgagcgacagactgaagagcctgggcgccgagcacgtgatcaccgaggaggagctgagaagacccgagatgaagaacttcttcaagatcagaaagctgagactgagaaaggaggagatgctgaaccagaaccacatcgtgtacaagggcagcagagagagcgagctggccagcgtgagccccaacagcaagcccctgaacctgcccgagccccccccccacaacatgcccagacacgcccccgccaccgcctgcagccagctgtgctggtgggagaagctgcacagagccgccgccgccgtgagcgcctggagaaaccacggcaacctgtggggcgacggccaggccgccagaagaagcctgtgcgagcccgcccacttctag

SEQ ID NO: 89294 - DNA, 1200 bp, Artificial Sequence
  Description of Artificial Sequence: Synthetic coding sequence
atgcagagcctgagcctgggccagaccagcatcagcaagggcctgaactacctgaccatcatggcccccggcaacctgtggcacatgagaaacaacttcctgttcggcagcagatgctggatgaccagattcagcgccgagaacatcttcaagagcgtgagcttcagactgttcggcgtgaagtgccacaacaccgacagcgagcccctgaagaacgaggacctgctgaagaacctgctgaccatgggcgtggacatcgacatggccagaaagagacagcccggcgtgttccacagaatgatcaccaacgagcaggacctgaagatgttcctgctgagcaagggcgccagcaaggaggtgatcgccagcatcatcagcagataccccagagccatcaccagaacccccgagaacctgagcaagagatgggacctgtggagaaagatcgtgaccagcgacctggagatcgtgaacatcctggagagaagccccgagagcttcttcagaagcaacaacaacctgaacctggagaacaacatcaagttcctgtacagcgtgggcctgaccagaaagtgcctgtgcagactgctgaccaacgcccccagaaccttcagcaacagcctggacctgaacaagcagatggtggagttcctgcaggccgccggcctgagcctgggccacaacgaccccgccgacttcgtgagaaagatcatcttcaagaaccccttcatcctgatccagagcaccaagagagtgaaggccaacatcgagttcctgagaagcaccttcaacctgaacagcgaggagctgctggtgctgatctgcggccccggcgccgagatcctggacctgagcaacgactacgccagaagaagctacgccaacatcaaggagaagctgttcagcctgggctgcaccgaggaggaggtgcagaagttcgtgctgagctaccccgacgtgatcttcctggccgagaagaagttcaacgacaagatcgactgcctgatggaggagaacatcagcatcagccagatcatcgagaaccccagagtgctggacagcagcatcagcaccctgaagagcagaatcaaggagctggtgaacgccggctgcaacctgagcaccctgaacatcaccctgctgagctggagcaagaagagatacgaggccaagctgaagaagctgagcagattcgcctag

SEQ ID NO: 89295 - DNA, 477 bp, Artificial Sequence
  Description of Artificial Sequence: Synthetic coding sequence
atgcagagcctgagcctgggccagaccagcatcagcaagggcctgaactacctgaccatcatggcccccggcaacctgtggcacatgagaaacaacttcctgttcggcagcagatgctggatgaccagattcagcgccgagaacatcttcaagagcgtgagcttcagactgttcggcgtgaagtgccacaacaccgacagcgagcccctgaagaacgaggacctgctgaagaacctgctgaccatgggcgtggacatcgacatggccagaaagagacagcccggcgtgttccacagaatgatcaccaacgagcaggacctgaagatgttcctgctgagcaagggcgccagcaaggaggtgatcgccagcatcatcagcagataccccagagccatcaccagaacccccgagaacctgagcaagagatgggacctgtggagaaagatcgtgaccagcgacctggagatcgtgaactag

SEQ ID NO: 89296 - DNA, 2184 bp, Artificial Sequence
  Description of Artificial Sequence: Synthetic coding sequence
atgaaccagaagctgctgaagctggagaacctgctgagattccacaccatctacagacagctgcacagcctgtgccagagaagagccctgagacagtggagacacggcttcagcagcgcctaccccgtgtggaccgcccagctgtgcgcctggccctggcccaccgacgtgctgaccggcgccgccctgagccagtacagactgctggtgaccaagaaggaggagggcccctggaagagccagctgagcagcaccaagagcaagaaggtggtggaggtgtggatcggcatgaccatcgaggagctggccagagccatggagaagaacaccgactacgtgtacgaggccctgctgaacaccgacatcgacatcgacagcctggaggccgacagccacctggacgaggtgtggatcaaggaggtgatcaccaaggccggcatgaagctgaagtggagcaagctgaagcaggacaaggtgagaaagaacaaggacgccgtgagaagaccccaggccgaccccgccctgctgacccccagaagccccgtggtgaccatcatgggccacgtggaccacggcaagaccaccctgctggacaagttcagaaagacccaggtggccgccgtggagaccggcggcatcacccagcacatcggcgccttcctggtgagcctgcccagcggcgagaagatcaccttcctggacacccccggccacgccgccttcagcgccatgagagccagaggcgcccaggtgaccgacatcgtggtgctggtggtggccgccgacgacggcgtgatgaagcagaccgtggagagcatccagcacgccaaggacgcccaggtgcccatcatcctggccgtgaacaagtgcgacaaggccgaggccgaccccgagaaggtgaagaaggagctgctggcctacgacgtggtgtgcgaggactacggcggcgacgtgcaggccgtgcccgtgagcgccctgaccggcgacaacctgatggccctggccgaggccaccgtggccctggccgagatgctggagctgaaggccgaccccaacggccccgtggagggcaccgtgatcgagagcttcaccgacaagggcagaggcctggtgaccaccgccatcatccagagaggcaccctgagaaagggcagcgtgctggtggccggcaagtgctgggccaaggtgagactgatgttcgacgagaacggcaagaccatcgacgaggcctaccccagcatgcccgtgggcatcaccggctggagagacctgcccagcgccggcgaggagatcctggaggtggagagcgagcccagagccagagaggtggtggactggagaaagtacgagcaggagcaggagaagggccaggaggacctgaagatcatcgaggagaagagaaaggagcacaaggaggcccaccagaaggccagagagaagtacggccacctgctgtggaagaagagaagcatcctgagattcctggagagaaaggagcagatccccctgaagcccaaggagaagagagagagagacagcaacgtgctgagcgtgatcatcaagggcgacgtggacggcagcgtggaggccatcctgaacatcatcgacacctacgacgccagccacgagtgcgagctggagctggtgcacttcggcgtgggcgacgtgagcgccaacgacgtgaacctggccgagaccttcgacggcgtgatctacggcttcaacgtgaacgccggcaacgtgatccagcagagcgccgccaagaagggcgtgaagatcaagctgcacaagatcatctacagactggtggaggacctgcaggaggagctgagcagcagactgccctgcgccgtggaggagcaccccgtgggcgaggccagcatcctggccaccttcagcgtgaccgagggcaagaagaaggtgcccgtggccggctgcagagtgcagaagggccagctggagaagcagaagaagttcaagctgaccagaaacggccacgtgatctggaagggcagcctgaccagcctgaagcaccacaaggacgacatcagcatcgtgaagaccggcatggactgcggcctgagcctggacgaggacaacatggagttccaggtgggcgacagaatcgtgtgctacgaggagaagcagatccaggccaagaccagctgggaccccggcttctag

SEQ ID NO: 89297 - DNA, 219 bp, Artificial Sequence
  Description of Artificial Sequence: Synthetic coding sequence
atgaaccagaagctgctgaagctggagaacctgctgagattccacaccatctacagacagctgcacagcctgtgccagagaagagccctgagacagtggagacacggcttcagcagcgcctaccccgtgtggaccgcccagctgtgcgcctggccctggcccaccgacgtgctgaccggcgccgccctgagccagtacagactgctggtgaccaagtag

SEQ ID NO: 89298 - DNA, 2184 bp, Artificial Sequence; identical to SEQ ID NO: 89296
  Description of Artificial Sequence: Synthetic coding sequence

SEQ ID NO: 89299 - DNA, 2184 bp, Artificial Sequence; identical to SEQ ID NO: 89296
  Description of Artificial Sequence: Synthetic coding sequence

SEQ ID NO: 89300 - DNA, 213 bp, Artificial Sequence
  Description of Artificial Sequence: Synthetic coding sequence
atgaaccagaagctgctgaagctggagaacctgctgagattccacaccatctacagacagctgcacagcctgtgccagagaagagccctgagacagtggagacacggcttcagcagcgcctaccccgtgtggaccgcccagctgtgcgcctggccctggcccaccgacgtgctgaccggcgccgccctgagccagtacagactgctggtgtag

SEQ ID NO: 89301 - DNA, 24 bp, Artificial Sequence
  Description of Artificial Sequence: Synthetic coding sequence
atgaaccagaagctgctgaagtag

SEQ ID NO: 89302 - DNA, 33 bp, Artificial Sequence
  Description of Artificial Sequence: Synthetic coding sequence
atgaaccagaagctgctgaagctggagaactag

SEQ ID NO: 89303 - DNA, 81 bp, Artificial Sequence
  Description of Artificial Sequence: Synthetic coding sequence
atgaaccagaagctgctgaagctggagaacctgctgagattccacaccatctacagacagctgcacagcctgtgccagtag

SEQ ID NO: 89304 - DNA, 216 bp, Artificial Sequence
  Description of Artificial Sequence: Synthetic coding sequence
atgaaccagaagctgctgaagctggagaacctgctgagattccacaccatctacagacagctgcacagcctgtgccagagaagagccctgagacagtggagacacggcttcagcagcgcctaccccgtgtggaccgcccagctgtgcgcctggccctggcccaccgacgtgctgaccggcgccgccctgagccagtacagactgctggtgacctag

SEQ ID NO: 89305 - DNA, 1398 bp, Artificial Sequence
  Description of Artificial Sequence: Synthetic coding sequence
atgaaccagaagctgctgaagctggagaacctgctgagattccacaccatctacagacagctgcacagcctgtgccagagaagagccctgagacagtggagacacggcttcagcagcgcctaccccgtgtggaccgcccagctgtgcgcctggccctggcccaccgacgtgctgaccggcgccgccctgagccagtacagactgctggtgaccaagaaggaggagggcccctggaagagccagctgagcagcaccaagagcaagaaggtggtggaggtgtggatcggcatgaccatcgaggagctggccagagccatggagaagaacaccgactacgtgtacgaggccctgctgaacaccgacatcgacatcgacagcctggaggccgacagccacctggacgaggtgtggatcaaggaggtgatcaccaaggccggcatgaagctgaagtggagcaagctgaagcaggacaaggtgagaaagaacaaggacgccgtgagaagaccccaggccgaccccgccctgctgacccccagaagccccgtggtgaccatcatgggccacgtggaccacggcaagaccaccctgctggacaagttcagaaagacccaggtggccgccgtggagaccggcggcatcacccagcacatcggcgccttcctggtgagcctgcccagcggcgagaagatcaccttcctggacacccccggccacgccgccttcagcgccatgagagccagaggcgcccaggtgaccgacatcgtggtgctggtggtggccgccgacgacggcgtgatgaagcagaccgtggagagcatccagcacgccaaggacgcccaggtgcccatcatcctggccgtgaacaagtgcgacaaggccgaggccgaccccgagaaggtgaagaaggagctgctggcctacgacgtggtgtgcgaggactacggcggcgacgtgcaggccgtgcccgtgagcgccctgaccggcgacaacctgatggccctggccgaggccaccgtggccctggccgagatgctggagctgaaggccgaccccaacggccccgtggagggcaccgtgatcgagagcttcaccgacaagggcagaggcctggtgaccaccgccatcatccagagaggcaccctgagaaagggcagcgtgctggtggccggcaagtgctgggccaaggtgagactgatgttcgacgagaacggcaagaccatcgacgaggcctaccccagcatgcccgtgggcatcaccggctggagagacctgcccagcgccggcgaggagatcctggaggtggagagcgagcccagagccagagaggtggtggactggagaaagtacgagcaggagcaggagaagggccaggaggacctgaagaaggagaagaactag

SEQ ID NO: 89306 - DNA, 456 bp, Artificial Sequence
  Description of Artificial Sequence: Synthetic coding sequence
atgaacagacacctgtgcgtgtggctgttcagacaccccagcctgaacggctacctgcagtgccacatccagctgcacagccaccagttcagacagatccacctggacaccagactgcaggtgttcagacagaacagaaactgcatcctgcacctgctgagcaagaactggagcagaagatactgccaccaggacaccaagatgctgtggaagcacaaggccctgcagaagtacatggagaacctgagcaaggagtaccagaccctggagcagtgcctgcagcacatccccgtgaacgaggagaacagaagaagcctgaacagaagacacgccgagctggcccccctggccgccatctaccaggagatccaggagaccgagcaggccatcgaggagctggagagcatgtgcaagaagaccgagagctgcagcgtggcccaggccggcatgcagtag

SEQ ID NO: 89307 - DNA, 1338 bp, Artificial Sequence
  Description of Artificial Sequence: Synthetic coding sequence
atgaacagacacctgtgcgtgtggctgttcagacaccccagcctgaacggctacctgcagtgccacatccagctgcacagccaccagttcagacagatccacctggacaccagactgcaggtgttcagacagaacagaaactgcatcctgcacctgctgagcaagaactggagcagaagatactgccaccaggacaccaagatgctgtggaagcacaaggccctgcagaagtacatggagaacctgagcaaggagtaccagaccctggagcagtgcctgcagcacatccccgtgaacgaggagaacagaagaagcctgaacagaagacacgccgagctggcccccctggccgccatctaccaggagatccaggagaccgagcaggccatcgaggagctggagagcatgtgcaagagcctgaacaagcaggacgagaagcagctgcaggagctggccctggaggagagacagaccatcgaccagaagatcaacatgctgtacaacgagctgttccagagcctggtgcccaaggagaagtacgacaagaacgacgtgatcctggaggtgaccgccggcagaaccaccggcggcgacatctgccagcagttcaccagagagatcttcgacatgtaccagaactacagctgctacaagcactggcagttcgagctgctgaactacacccccgccgactacggcggcctgcaccacgccgccgccagaatcagcggcgacggcgtgtacaagcacctgaagtacgagggcggcatccacagagtgcagagaatccccgaggtgggcctgagcagcagaatgcagagaatccacaccggcaccatgagcgtgatcgtgctgccccagcccgacgaggtggacgtgaagctggaccccaaggacctgagaatcgacaccttcagagccaagggcgccggcggccagcacgtgaacaagaccgacagcgccgtgagactggtgcacatccccaccggcctggtggtggagtgccagcaggagagaagccagatcaagaacaaggagatcgccttcagagtgctgagagccagactgtaccagcagatcatcgagaaggacaagagacagcagcagagcgccagaaagctgcaggtgggcaccagagcccagagcgagagaatcagaacctacaacttcacccaggacagagtgagcgaccacagaatcgcctacgaggtgagagacatcaaggagttcctgtgcggcggcaagggcctggaccagctgatccagagactgctgcagagcgccgacgaggaggccatcgccgagctgctggacgagcacctgaagagcgccaagtag

SEQ ID NO: 89308 - DNA, 1338 bp, Artificial Sequence; identical to SEQ ID NO: 89307
  Description of Artificial Sequence: Synthetic coding sequence

SEQ ID NO: 89309 - DNA, 1407 bp, Artificial Sequence
  Description of Artificial Sequence: Synthetic coding sequence
atgggcaacggcgaggtggtgctgttcagcgacgccgagatgaacagacacctgtgcgtgtggctgttcagacaccccagcctgaacggctacctgcagtgccacatccagctgcacagccaccagttcagacagatccacctggacaccagactgcaggtgttcagacagaacagaaactgcatcctgcacctgctgagcaagaactggagcagaagatactgccaccaggacaccaagatgctgtggaagcacaaggccctgcagaagtacatggagaacctgagcaaggagtaccagaccctggagcagtgcctgcagcacatccccgtgaacgaggagaacagaagaagcctgaacagaagacacgccgagctggcccccctggccgccatctaccaggagatccaggagaccgagcaggccatcgaggagctggagagcatgtgcaagagcctgaacaagcaggacgagaagcagctgcaggagctggccctggaggagagacagaccatcgaccagaagatcaacatgctgtacaacgagctgttccagagcctggtgcccaaggagaagtacgacaagaacgacgtgatcctggaggtgaccgccggcagaaccaccggcggcgacatctgccagcagttcaccagagagatcttcgacatgtaccagaactacagctgctacaagcactggcagttcgagctgctgaactacacccccgccgactacggcggcctgcaccacgccgccgccagaatcagcggcgacggcgtgtacaagcacctgaagtacgagggcggcatccacagagtgcagagaatccccgaggtgggcctgagcagcagaatgcagagaatccacaccggcaccatgagcgtgatcgtgctgccccagcccgacgaggtggacgtgaagctggaccccaaggacctgagaatcgacaccttcagagccaagggcgccggcggccagcacgtgaacaagaccgacagcgccgtgagactggtgcacatccccaccggcctggtggtggagtgccagcaggagagaagccagatcaagaacaaggagatcgccttcagagtgctgagagccagactgtaccagcagatcatcgagaaggacaagagacagcagcagagcgccagaaagctgcaggtgggcaccagagcccagagcgagagaatcagaacctacaacttcacccaggacagagtgagcgaccacagaatcgcctacgaggtgagagacatcaaggcccagagccacagcaccggcggcagcagagaccccgcccacagcaccttcctgagcctggacagcgtgagaagccccggcatcctgatcatgaccagcagcgtgagaaacttctacgtggtgggcagagcctggatcagctag

SEQ ID NO: 89310 - DNA, 2274 bp, Artificial Sequence
  Description of Artificial Sequence: Synthetic coding sequence
atgagcctgctgttcagcagatgcaacagcatcgtgaccgtgaagaagaacaagagacacatggccgaggtgaacgccagccccctgaagcacttcgtgaccgccaagaagaagatcaacggcatcttcgagcagctgggcgcctacatccaggagagcgccaccttcctggaggacacctacagaaacgccgagctggaccccgtgaccaccgaggagcaggtgctggacgtgaagggctacctgagcaaggtgagaggcatcagcgaggtgctggccagaagacacatgaaggtggccttcttcggcagaaccagcaacggcaagagcaccgtgatcaacgccatgctgtgggacaaggtgctgcccagcggcatcggccacaccaccaactgcttcctgagagtggagggcaccgacggccacgaggccttcctgctgaccgagggcagcgaggagaagagaagcgccaagaccgtgaaccagctggcccacgccctgcaccaggacaagcagctgcacgccggcagcctggtgagcgtgatgtggcccaacagcaagtgccccctgctgaaggacgacctggtgctgatggacagccccggcatcgacgtgaccaccgagctggacagctggatcgacaagttctgcctggacgccgacgtgttcgtgctggtggccaacagcgagagcaccctgatgcagaccgagaagcacttcttccacaaggtgagcgagagactgagcagacccaacatcttcatcctgaacaacagatgggacgccagcgccagcgagcccgagtacatggaggaggtgagaagacagcacatggagagatgcaccagcttcctggtggacgagctgggcgtggtggacagaagccaggccggcgacagaatcttcttcgtgagcgccaaggaggtgctgaacgccagaatccagaaggcccagggcatgcccgagggcggcggcgccctggccgagggcttccaggtgagaatgttcgagttccagaacttcgagagaagattcgaggagtgcatcagccagagcgccgtgaagaccaagttcgagcagcacaccgtgagagccaagcagatcgccgaggccgtgagactgatcatggacagcctgcacatggccgccagagagcagcaggtgtactgcgaggagatgagagaggagagacaggacagactgaagttcatcgacaagcagctggagctgctggcccaggactacaagctgagaatcaagcagatcaccgaggaggtggagagacaggtgagcaccgccatggccgaggagatcagaagactgagcgtgctggtggacgactaccagatggacttccaccccagccccgtggtgctgaaggtgtacaagaacgagctgcacagacacatcgaggagggcctgggcagaaacatgagcgacagatgcagcaccgccatcaccaacagcctgcagaccatgcagcaggacatgatcgacggcctgaagcccctgctgcccgtgagcgtgagaagccagatcgacatgctggtgcccagacagtgcttcagcctgaactacgacctgaactgcgacaagctgtgcgccgacttccaggaggacatcgagttccacttcagcctgggctggaccatgctggtgaacagattcctgggccccaagaacagcagaagagccctgatgggctacaacgaccaggtgcagagacccatccccctgacccccgccaaccccagcatgccccccctgccccagggcagcctgacccaggaggagttcatggtgagcatggtgaccggcctggccagcctgaccagcagaaccagcatgggcatcctggtggtgggcggcgtggtgtggaaggccgtgggctggagactgatcgccctgagcttcggcctgtacggcctgctgtacgtgtacgagagactgacctggaccaccaaggccaaggagagagccttcaagagacagttcgtggagcacgccagcgagaagctgcagctggtgatcagctacaccggcagcaactgcagccaccaggtgcagcaggagctgagcggcaccttcgcccacctgtgccagcaggtggacgtgaccagagagaacctggagcaggagatcgccgccatgaacaagaagatcgaggtgctggacagcctgcagagcaaggccaagctgctgagaaacaaggccggctggctggacagcgagctgaacatgttcacccaccagtacctgcagcccagcagatag

SEQ ID NO: 89311 - DNA, 1311 bp, Artificial Sequence
  Description of Artificial Sequence: Synthetic coding sequence
atgcacccccacctgagcaccctgagcctgcccagaagaagaagcatggccttcctgagcagctggggcgccctggccgagggcttccaggtgagaatgttcgagttccagaacttcgagagaagattcgaggagtgcatcagccagagcgccgtgaagaccaagttcgagcagcacaccgtgagagccaagcagatcgccgaggccgtgagactgatcatggacagcctgcacatggccgccagagagcagcaggtgtactgcgaggagatgagagaggagagacaggacagactgaagttcatcgacaagcagctggagctgctggcccaggactacaagctgagaatcaagcagatcaccgaggaggtggagagacaggtgagcaccgccatggccgaggagatcagaagactgagcgtgctggtggacgactaccagatggacttccaccccagccccgtggtgctgaaggtgtacaagaacgagctgcacagacacatcgaggagggcctgggcagaaacatgagcgacagatgcagcaccgccatcaccaacagcctgcagaccatgcagcaggacatgatcgacggcctgaagcccctgctgcccgtgagcgtgagaagccagatcgacatgctggtgcccagacagtgcttcagcctgaactacgacctgaactgcgacaagctgtgcgccgacttccaggaggacatcgagttccacttcagcctgggctggaccatgctggtgaacagattcctgggccccaagaacagcagaagagccctgatgggctacaacgaccaggtgcagagacccatccccctgacccccgccaaccccagcatgccccccctgccccagggcagcctgacccaggaggagttcatggtgagcatggtgaccggcctggccagcctgaccagcagaaccagcatgggcatcctggtggtgggcggcgtggtgtggaaggccgtgggctggagactgatcgccctgagcttcggcctgtacggcctgctgtacgtgtacgagagactgacctggaccaccaaggccaaggagagagccttcaagagacagttcgtggagcacgccagcgagaagctgcagctggtgatcagctacaccggcagcaactgcagccaccaggtgcagcaggagctgagcggcaccttcgcccacctgtgccagcaggtggacggcgagaccctgagcgagagaagcatggccaagagcaccctgatgctgctgaccctgctgttcctgtgcagcttcgccggcgcccaggacgtgctgacccagtag

SEQ ID NO: 89312 - DNA, 297 bp, Artificial Sequence
  Description of Artificial Sequence: Synthetic coding sequence
atgagcctgctgttcagcagatgcaacagcatcgtgaccgtgaagaagaacaagagacacatggccgaggtgaacgccagccccctgaagcacttcgtgaccgccaagaagaagatcaacggcatcttcgagcagctgggcgcctacatccaggagagcgccaccttcctggaggacacctacagaaacgccgagctggaccccgtgaccaccgaggagcaggtgctggacgtgaagggctacctgagcaaggtgagaggcatcagcgaggtgctggccagaagacacatgaagtag

SEQ ID NO: 89313 - DNA, 2274 bp, Artificial Sequence; identical to SEQ ID NO: 89310
  Description of Artificial Sequence: Synthetic coding sequence

SEQ ID NO: 89314 - DNA, 1395 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgcgtgaaccacaagaacatcatcagcctgctgaacgtgttcaccccccagaagaccctggaggagttccaggacgtgtacctggtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatggtgagacacaagatcctgttccccggcagagactacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcggcgccgccgtgaacagcagcgagagcctgccccccagcagcagcgtgaacgacatcagcagcatgagcaccgaccagaccctggccagcgacaccgacagcagcctggaggccagcgccggccccctgggctgctgcagatag

SEQ ID NO: 89315 - DNA, 1269 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgcgtgaaccacaagaacatcatcagcctgctgaacgtgttcaccccccagaagaccctggaggagttccaggacgtgtacctggtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatggtgagacacaagatcctgttccccggcagagactacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcgcccaggtgcagcagtag

SEQ ID NO: 89316 - DNA, 960 bp, Artificial Sequence
  Description of Artificial Sequence: Synthetic coding sequence
atggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatggtgagacacaagatcctgttccccggcagagactacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcggcgccgccgtgaacagcagcgagagcctgccccccagcagcagcgtgaacgacatcagcagcatgagcaccgaccagaccctggccagcgacaccgacagcagcctggaggccagcgccggccccctgggctgctgcagatag

SEQ ID NO: 89317 - DNA, 834 bp, Artificial Sequence
  Description of Artificial Sequence: Synthetic coding sequence
atggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatggtgagacacaagatcctgttccccggcagagactacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcgcccaggtgcagcagtag

SEQ ID NO: 89318 - DNA, 1269 bp, Artificial Sequence; identical to SEQ ID NO: 89315
  Description of Artificial Sequence: Synthetic coding sequence

SEQ ID NO: 89319 - DNA, 1281 bp, Artificial Sequence
  Description of Artificial Sequence: Synthetic coding sequence
atgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgcgtgaaccacaagaacatcatcagcctgctgaacgtgttcaccccccagaagaccctggaggagttccaggacgtgtacctggtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatggtgagacacaagatcctgttccccggcagagactacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcggcgccgccgtgaacagcagcgagagcctgccccccagcagcagcgtgaacgacatcagcagcatgagcaccgaccagaccctggccagcgacaccgacagcagcctggaggccagcgccggccccctgggctgctgcagatag

SEQ ID NO: 89320 - DNA, 1281 bp, Artificial Sequence; identical to SEQ ID NO: 89319
  Description of Artificial Sequence: Synthetic coding sequence

SEQ ID NO: 89321 - DNA, 960 bp, Artificial Sequence
  Description of Artificial Sequence: Synthetic coding sequence
atggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatgtggagcgtgggctgcatcatgggcgagatgatcaagggcgccgtgctgttccccggcaccgaccacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcggcgccgccgtgaacagcagcgagagcctgccccccagcagcagcgtgaacgacatcagcagcatgagcaccgaccagaccctggccagcgacaccgacagcagcctggaggccagcgccggccccctgggctgctgcagatag

SEQ ID NO: 89322 - DNA, 102 bp, Artificial Sequence
  Description of Artificial Sequence: Synthetic coding sequence
atgagcaagagcaaggtggacaaccagttctacagcgtggaggtgggcgacagcaccttcaccgtgctgaagagataccagaacctgaagcccatcggctag

SEQ ID NO: 89323 - DNA, 156 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtgtag

SEQ ID NO: 89324 - DNA, 276 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggcctag

SEQ ID NO: 89325 - DNA, 225 bp, Artificial Sequence
  Description of Artificial Sequence: Synthetic coding sequence
atgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctgtag

SEQ ID NO: 89326 - DNA, 366 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgcgtgaaccacaagtag

SEQ ID NO: 89327 - DNA, 354 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgctag

SEQ ID NO: 89328 - DNA, 426 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgcgtgaaccacaagaacatcatcagcctgctgaacgtgttcaccccccagaagaccctggaggagttccaggactag

SEQ ID NO: 89329 - DNA, 255 bp, Artificial Sequence
  Description of Artificial Sequence: Synthetic coding sequence
atgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtggccatcaagaagctgagcagacccttccagaaccagacccacgccaagagagcctacagagagctggtgctgatgaagtgcgtgaaccacaagaactag

SEQ ID NO: 89330 - DNA, 159 bp, Artificial Sequence
  Description of Artificial Sequence: Synthetic coding sequence
atgagcaagagcaaggtggacaaccagttctacagcgtggaggtgggcgacagcaccttcaccgtgctgaagagataccagaacctgaagcccatcggcagcggcgcccagggcatcgtgtgcgccgcctacgacgccgtgctggacagaaacgtgtag

SEQ ID NO: 89331 - DNA, 147 bp, Artificial Sequence
  Description of Artificial Sequence: Synthetic coding sequence
atgagcctgcacttcctgtactactgcagcgagcccaccctggacgtgaagatcgccttctgccagggcttcgacaagcaggtggacgtgagctacatcgccaagcactacaacatgagcaagagcaaggtggacaaccagttctag

SEQ ID NO: 89332 - DNA, 1008 bp, Artificial Sequence
  Description of Artificial Sequence: Synthetic coding sequence
tgaaacgtggccatcaagaagctgagcagacccttccagaaccagacccacgccaagagagcctacagagagctggtgctgatgaagtgcgtgaaccacaagaacatcatcagcctgctgaacgtgttcaccccccagaagaccctggaggagttccaggacgtgtacctggtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatgtggagcgtgggctgcatcatgggcgagatgatcaagggcgccgtgctgttccccggcaccgaccacatcgaccagtggaacaaggtgatcgagcagctgggcaccccctgccccgagttcatgaagaagctgcagcccaccgtgagaaactacgtggagaacagacccaagtacgccggcctgaccttccccaagctgttccccgacagcctgttccccgccgacagcgagcacaacaagctgaaggccagccaggccagagacctgctgagcaagatgctggtgatcgaccccgccaagagaatcagcgtggacgacgccctgcagcacccctacatcaacgtgtggtacgaccccgccgaggtggaggccccccccccccagatctacgacaagcagctggacgagagagagcacaccatcgaggagtggaaggagctgatctacaaggaggtgatgaacagcgaggagaagaccaagaacggcgtggtgaagggccagcccagccccagcgcccaggtgcagcagtag

SEQ ID NO: 89333 - DNA, 1764 bp, Artificial Sequence
  Description of Artificial Sequence: Synthetic coding sequence
atggccgagaagggcgactgcatcgccagcgtgtacggctacgacctgggcggcagattcgtggacttccagcccctgggcttcggcgtgaacggcctggtgctgagcgccgtggacagcagagcctgcagaaaggtggccgtgaagaagatcgccctgagcgacgccagaagcatgaagcacgccctgagagagatcaagatcatcagaagactggaccacgacaacatcgtgaaggtgtacgaggtgctgggccccaagggcaccgacctgcagggcgagctgttcaagttcagcgtggcctacatcgtgcaggagtacatggagaccgacctggccagactgctggagcagggcaccctggccgaggagcacgccaagctgttcatgtaccagctgctgagaggcctgaagtacatccacagcgccaacgtgctgcacagagacctgaagcccgccaacatcttcatcagcaccgaggacctggtgctgaagatcggcgacttcggcctggccagaatcgtggaccagcactacagccacaagggctacctgagcgagggcctggtgaccaagtggtacagaagccccagactgctgctgagccccaacaactacaccaaggccatcgacatgtgggccgccggctgcatcctggccgagatgctgaccggcagaatgctgttcgccggcgcccacgagctggagcagatgcagctgatcctggagaccatccccgtgatcagagaggaggacaaggacgagctgctgagagtgatgcccagcttcgtgagcagcacctgggaggtgaagagacccctgagaaagctgctgcccgaggtgaacagcgaggccatcgacttcctggagaagatcctgaccttcaaccccatggacagactgaccgccgagatgggcctgcagcacccctacatgagcccctacagctgccccgaggacgagcccaccagccagcaccccttcagaatcgaggacgagatcgacgacatcgtgctgatggccgccaaccagagccagctgagcaactgggacacctgcagcagcagataccccgtgagcctgagcagcgacctggagtggagacccgacagatgccaggacgccagcgaggtgcagagagaccccagagccggcagcgcccccctggccgaggacgtgcaggtggaccccagaaaggacagccacagcagcagcgagagattcctggagcagagccacagcagcatggagagagccttcgaggccgactacggcagaagctgcgactacaaggtgggcagccccagctacctggacaagctgctgtggagagacaacaagccccaccactacagcgagcccaagctgatcctggacctgagccactggaagcaggccgccggcgccccccccaccgccaccggcctggccgacaccggcgccagagaggacgagcccgccagcctgttcctggagatcgcccagtgggtgaagagcacccagggcggccccgagcacgccagcccccccgccgacgaccccgagagaagactgagcgccagcccccccggcagacccgcccccgtggacggcggcgccagcccccagttcgacctggacgtgttcatcagcagagccctgaagctgtgcaccaagcccgaggacctgcccgacaacaagctgggcgacctgaacggcgcctgcatccccgagcaccccggcgacctggtgcagaccgaggccttcagcaaggagagatggtag

SEQ ID NO: 89334 - DNA, 1131 bp, Artificial Sequence
  Description of Artificial Sequence: Synthetic coding sequence
atgtgggccgccggctgcatcctggccgagatgctgaccggcagaatgctgttcgccggcgcccacgagctggagcagatgcagctgatcctggagaccatccccgtgatcagagaggaggacaaggacgagctgctgagagtgatgcccagcttcgtgagcagcacctgggaggtgaagagacccctgagaaagctgctgcccgaggtgaacagcgaggccatcgacttcctggagaagatcctgaccttcaaccccatggacagactgaccgccgagatgggcctgcagcacccctacatgagcccctacagctgccccgaggacgagcccaccagccagcaccccttcagaatcgaggacgagatcgacgacatcgtgctgatggccgccaaccagagccagctgagcaactgggacacctgcagcagcagataccccgtgagcctgagcagcgacctggagtggagacccgacagatgccaggacgccagcgaggtgcagagagaccccagagccggcagcgcccccctggccgaggacgtgcaggtggaccccagaaaggacagccacagcagcagcgagagattcctggagcagagccacagcagcatggagagagccttcgaggccgactacggcagaagctgcgactacaaggtgggcagccccagctacctggacaagctgctgtggagagacaacaagccccaccactacagcgagcccaagctgatcctggacctgagccactggaagcaggccgccggcgccccccccaccgccaccggcctggccgacaccggcgccagagaggacgagcccgccagcctgttcctggagatcgcccagtgggtgaagagcacccagggcggccccgagcacgccagcccccccgccgacgaccccgagagaagactgagcgccagcccccccggcagacccgcccccgtggacggcggcgccagcccccagttcgacctggacgtgttcatcagcagagccctgaagctgtgcaccaagcccgaggacctgcccgacaacaagctgggcgacctgaacggcgcctgcatccccgagcaccccggcgacctggtgcagaccgaggccttcagcaaggagagatggtag

SEQ ID NO: 89335 - DNA, 2034 bp, Artificial Sequence
  Description of Artificial Sequence: Synthetic coding sequence
atggagagcgacctgcaccagatcatccacagcagccagcccctgaccctggagcacgtgagatacttcctgtaccagctgctgagaggcctgaagtacatgcacagcgcccaggtgatccacagagacctgaagcccagcaacctgctggtgaacgagaactgcgagctgaagatcggcgacttcggcatggccagaggcctgtgcaccagccccgccgagcaccagtacttcatgaccgagtacgtggccaccagatggtacagagcccccgagctgatgctgagcctgcacgagtacacccaggccatcgacctgtggagcgtgggctgcatcttcggcgagatgctggccagaagacagctgttccccggcaagaactacgtgcaccagctgcagctgatcatgatggtgctgggcacccccagccccgccgtgatccaggccgtgggcgccgagagagtgagagcctacatccagagcctgccccccagacagcccgtgccctgggagaccgtgtaccccggcgccgacagacaggccctgagcctgctgggcagaatgctgagattcgagcccagcgccagaatcagcgccgccgccgccctgagacaccccttcctggccaagtaccacgaccccgacgacgagcccgactgcgccccccccttcgacttcgccttcgacagagaggccctgaccagagagagaatcaaggaggccatcgtggccgagatcgaggacttccacgccagaagagagggcatcagacagcagatcagattccagcccagcctgcagcccgtggccagcgagcccggctgccccgacgtggagatgcccagcccctgggcccccagcggcgactgcgccatggagagccccccccccgccccccccccctgccccggccccgcccccgacaccatcgacctgaccctgcagccccccccccccgtgagcgagcccgccccccccaagaaggacggcgccatcagcgacaacaccaaggccgccctgaaggccgccctgctgaagagcctgagaagcagactgagagacggccccagcgcccccctggaggcccccgagcccagaaagcccgtgaccgcccaggagagacagagagagagagaggagaagagaagaagaagacaggagagagccaaggagagagagaagagaagacaggagagagagagaaaggagagaggcgccggcgccagcggcggccccagcaccgaccccctggccggcctggtgctgagcgacaacgacagaagcctgctggagagatggaccagaatggccagacccgccgcccccgccctgaccagcgtgcccgcccccgcccccgcccccacccccacccccacccccgtgcagcccaccagccccccccccggccccgtggcccagcccaccggcccccagccccagagcgccggcagcaccagcggccccgtgccccagcccgcctgccccccccccggccccgccccccaccccaccggcccccccggccccatccccgtgcccgcccccccccagatcgccaccagcaccagcctgctggccgcccagagcctggtgcccccccccggcctgcccggcagcagcacccccggcgtgctgccctacttcccccccggcctgcccccccccgacgccggcggcgccccccagagcagcatgagcgagagccccgacgtgaacctggtgacccagcagctgagcaagagccaggtggaggaccccctgccccccgtgttcagcggcacccccaagggcagcggcgccggctacggcgtgggcttcgacctggaggagttcctgaaccagagcttcgacatgggcgtggccgacggcccccaggacggccaggccgacagcgccagcctgagcgccagcctgctggccgactggctggagggccacggcatgaaccccgccgacatcgagagcctgcagagagagatccagatggacagccccatgctgctggccgacctgcccgacctgcaggacccctag

SEQ ID NO: 89336 - DNA, 2451 bp, Artificial Sequence
  Description of Artificial Sequence: Synthetic coding sequence
atggccgagcccctgaaggaggaggacggcgaggacggcagcgccgagccccccggccccgtgaaggccgagcccgcccacaccgccgccagcgtggccgccaagaacctggccctgctgaaggccagaagcttcgacgtgaccttcgacgtgggcgacgagtacgagatcatcgagaccatcggcaacggcgcctacggcgtggtgagcagcgccagaagaagactgaccggccagcaggtggccatcaagaagatccccaacgccttcgacgtggtgaccaacgccaagagaaccctgagagagctgaagatcctgaagcacttcaagcacgacaacatcatcgccatcaaggacatcctgagacccaccgtgccctacggcgagttcaagagcgtgtacgtggtgctggacctgatggagagcgacctgcaccagatcatccacagcagccagcccctgaccctggagcacgtgagatacttcctgtaccagctgctgagaggcctgaagtacatgcacagcgcccaggtgatccacagagacctgaagcccagcaacctgctggtgaacgagaactgcgagctgaagatcggcgacttcggcatggccagaggcctgtgcaccagccccgccgagcaccagtacttcatgaccgagtacgtggccaccagatggtacagagcccccgagctgatgctgagcctgcacgagtacacccaggccatcgacctgtggagcgtgggctgcatcttcggcgagatgctggccagaagacagctgttccccggcaagaactacgtgcaccagctgcagctgatcatgatggtgctgggcacccccagccccgccgtgatccaggccgtgggcgccgagagagtgagagcctacatccagagcctgccccccagacagcccgtgccctgggagaccgtgtaccccggcgccgacagacaggccctgagcctgctgggcagaatgctgagattcgagcccagcgccagaatcagcgccgccgccgccctgagacaccccttcctggccaagtaccacgaccccgacgacgagcccgactgcgccccccccttcgacttcgccttcgacagagaggccctgaccagagagagaatcaaggaggccatcgtggccgagatcgaggacttccacgccagaagagagggcatcagacagcagatcagattccagcccagcctgcagcccgtggccagcgagcccggctgccccgacgtggagatgcccagcccctgggcccccagcggcgactgcgccatggagagccccccccccgccccccccccctgccccggccccgcccccgacaccatcgacctgaccctgcagccccccccccccgtgagcgagcccgccccccccaagaaggacggcgccatcagcgacaacaccaaggccgccctgaaggccgccctgctgaagagcctgagaagcagactgagagacggccccagcgcccccctggaggcccccgagcccagaaagcccgtgaccgcccaggagagacagagagagagagaggagaagagaagaagaagacaggagagagccaaggagagagagaagagaagacaggagagagagagaaaggagagaggcgccggcgccagcggcggccccagcaccgaccccctggccggcctggtgctgagcgacaacgacagaagcctgctggagagatggaccagaatggccagacccgccgcccccgccctgaccagcgtgcccgcccccgcccccgcccccacccccacccccacccccgtgcagcccaccagccccccccccggccccgtggcccagcccaccggcccccagccccagagcgccggcagcaccagcggccccgtgccccagcccgcctgccccccccccggccccgccccccaccccaccggcccccccggccccatccccgtgcccgcccccccccagatcgccaccagcaccagcctgctggccgcccagagcctggtgcccccccccggcctgcccggcagcagcacccccggcgtgctgccctacttcccccccggcctgcccccccccgacgccggcggcgccccccagagcagcatgagcgagagccccgacgtgaacctggtgacccagcagctgagcaagagccaggtggaggaccccctgccccccgtgttcagcggcacccccaagggcagcggcgccggctacggcgtgggcttcgacctggaggagttcctgaaccagagcttcgacatgggcgtggccgacggcccccaggacggccaggccgacagcgccagcctgagcgccagcctgctggccgactggctggagggccacggcatgaaccccgccgacatcgagagcctgcagagagagatccagatggacagccccatgctgctggccgacctgcccgacctgcaggacccctag

SEQ ID NO: 89337 - DNA, 2451 bp, Artificial Sequence; identical to SEQ ID NO: 89336
  Description of Artificial Sequence: Synthetic coding sequence

SEQ ID NO: 89338 - DNA, 2451 bp, Artificial Sequence; identical to SEQ ID NO: 89336
  Description of Artificial Sequence: Synthetic coding sequence

SEQ ID NO: 89339 - DNA, 726 bp, Artificial Sequence
  Description of Artificial Sequence: Synthetic coding sequence
atggccgagcccctgaaggaggaggacggcgaggacggcagcgccgagccccccggccccgtgaaggccgagcccgcccacaccgccgccagcgtggccgccaagaacctggccctgctgaaggccagaagcttcgacgtgaccttcgacgtgggcgacgagtacgagatcatcgagaccatcggcaacggcgcctacggcgtggtgagcagcgccagaagaagactgaccggccagcaggtggccatcaagaagatccccaacgccttcgacgtggtgaccaacgccaagagaaccctgagagagctgaagatcctgaagcacttcaagcacgacaacatcatcgccatcaaggacatcctgagacccaccgtgccctacggcgagttcaagagcgtgtacgtggtgctggacctgatggagagcgacctgcaccagatcatccacagcagccagcccctgaccctggagcacgtgagatacttcctgtaccagctgctgagaggcctgaagtacatgcacagcgcccaggtgatccacagagacctgaagcccagcaacctgctggtgaacgagaactgcgagctgaagatcggcgacttcggcatggccagaggcctgtgcaccagccccgccgagcaccagtacttcatgaccgagtacgtggccaccagatggtacagagcccccgagctgatgctgagcctgcacgagtacacccagtag

SEQ ID NO: 89340 - DNA, 2136 bp, Artificial Sequence
  Description of Artificial Sequence: Synthetic coding sequence
atggccgagagagagagcggcggcctgggcggcggcgccgccagcccccccgccgccagccccttcctgggcctgcacatcgccagcccccccaacttcagactgacccacgacatcagcctggaggagttcgaggacgaggacctgagcgagatcaccgacgagtgcggcatcagcctgcagtgcaaggacaccctgagcctgagaccccccagagccggcctgctgagcgccggcggcggcggcgccggcagcagactgcaggccgagatgctgcagatggacctgatcgacgccaccggcgacacccccggcgccgaggacgacgaggaggacgacgacgaggagagagccgccagaagacccggcgccggcccccccaaggccgagagcggccaggagcccgccagcagaggccagggccagagccagggccagagccagggccccggcagcggcgacacctacagacccaagagacccaccaccctgaacctgttcccccaggtgcccagaagccaggacaccctgaacaacaacagcctgggcaagaagcacagctggcaggacagagtgagcagaagcagcagccccctgaagaccggcgagcagacccccccccacgagcacatctgcctgagcgacgagctgcccccccagagcggccccgcccccaccaccgacagaggcaccagcaccgacagcccctgcagaagaagcaccgccacccagatggccccccccggcggcccccccgccgccccccccggcggcagaggccacagccacagagacagaatccactaccaggccgacgtgagactggaggccaccgaggagatctacctgacccccgtgcagagaccccccgacgccgccgagcccaccagcgccttcctgccccccaccgagagcagaatgagcgtgagcagcgaccccgaccccgccgcctaccccagcaccgccggcagaccccaccccagcatcagcgaggaggaggagggcttcgactgcctgagcagccccgagagagccgagccccccggcggcggctggagaggcagcctgggcgagcccccccccccccccagagccagcctgagcagcgacaccagcgccctgagctacgacagcgtgaagtacaccctggtggtggacgagcacgcccagctggagctggtgagcctgagaccctgcttcggcgactacagcgacgagagcgacagcgccaccgtgtacgacaactgcgccagcgtgagcagcccctacgagagcgccatcggcgaggagtacgaggaggcccccagaccccagccccccgcctgcctgagcgaggacagcacccccgacgagcccgacgtgcacttcagcaagaagttcctgaacgtgttcatgagcggcagaagcagaagcagcagcgccgagagcttcggcctgttcagctgcatcatcaacggcgaggagcaggagcagacccacagagccatcttcagattcgtgcccagacacgaggacgagctggagctggaggtggacgaccccctgctggtggagctgcaggccgaggactactggtacgaggcctacaacatgagaaccggcgccagaggcgtgttccccgcctactacgccatcgaggtgaccaaggagcccgagcacatggccgccctggccaagaacagcgactgggtggaccagttcagagtgaagttcctgggcagcgtgcaggtgccctaccacaagggcaacgacgtgctgtgcgccgccatgcagaagatcgccaccaccagaagactgaccgtgcacttcaacccccccagcagctgcgtgctggagatcagcgtgagaggcgtgaagatcggcgtgaaggccgacgacagccaggaggccaagggcaacaagtgcagccacttcttccagctgaagaacatcagcttctgcggctaccaccccaagaacaacaagtacttcggcttcatcaccaagcaccccgccgaccacagattcgcctgccacgtgttcgtgagcgaggacagcaccaaggccctggccgagagcgtgggcagagccttccagcagttctacaagcagttcgtggagtacacctgccccaccgaggacatctacctggagtag

SEQ ID NO: 89341 - DNA, 1797 bp, Artificial Sequence
  Description of Artificial Sequence: Synthetic coding sequence
atgctgcccgacttccccagccccagcacctgggcccccggcctgctgctgcccagcggccccgccctgctgagccccagcgtgctgcaggacagcctgagcctgggcagaagcgagcagccccaccccatctgcagcttccaggacgacttccaggagttcgagatgatcgacgacaacgaggaggaggacgacgaggacgaggaggaggaggaggaggaggaggagggcgacggcgagggccaggagggcggcgaccccggcagcgaggcccccgcccccggccccctgatccccagccccagcgtggaggagccccacaagcacagacccaccaccctgagactgaccaccctgggcgcccaggacagccaggaccccgaggccgccgccggccccggcggcgtggagctggtggacatggagaccctgaaccccaccagagacaccatcacccccctgtgggccgcccccggcagagccgccagacccggcagagcctgcagcgccgcctgcagcgaggaggaggacgaggaggacgacgaggaggaggaggacgccgaggacagcgccggcagccccggcggcagaggcaccggccccagcgcccccagagacgccagcctggtgtacgacgccgtgaagtacaccctggtggtggacgagcacacccagctggagctggtgagcctgagaagatgcgccggcctgggccacgacagcgaggaggacagcggcggcgaggccagcgaggaggaggccggcgccgccctgctgggcggcggccaggtgagcggcgacaccagccccgacagccccgacctgaccttcagcaagaagttcctgaacgtgttcgtgaacagcaccagcagaagcagcagcaccgagagcttcggcctgttcagctgcctggtgaacggcgaggagagagagcagacccacagagccgtgttcagattcatccccagacaccccgacgagctggagctggacgtggacgaccccgtgctggtggaggccgaggaggacgacttctggttcagaggcttcaacatgagaaccggcgagagaggcgtgttccccgccttctacgcccacgccgtgcccggccccgccaaggacctgctgggcagcaagagaagcccctgctgggtggagagattcgacgtgcagttcctgggcagcgtggaggtgccctgccaccagggcaacggcatcctgtgcgccgccatgcagaagatcgccaccgccagaaagctgaccgtgcacctgagaccccccgccagctgcgacctggagatcagcctgagaggcgtgaagctgagcctgagcggcggcggccccgagttccagagatgcagccacttcttccagatgaagaacatcagcttctgcggctgccaccccagaaacagctgcgaggccccccagggcgccgccttccagtgggagagaggcgtggacagaaagagagtgctgcagaccagaggcaacgtgcagccccacctgggcgccggccagggcgccgccctgaacagagccaccgagggcagcagcaccggcagcgagaagggcgagtggacccccctggtgatcatggagctgacccagagcgtgaacagctgctacttcggcttcatcaccaagcaccccctgctgagcagattcgcctgccacgtgttcgtgagccaggagagcatgagacccgtggcccagagcgtgggcagagccttcctggagtactaccaggagcacctggcctacgcctgccccaccgaggacatctacctggagtag

SEQ ID NO: 89342 - DNA, 2472 bp, Artificial Sequence
  Description of Artificial Sequence: Synthetic coding sequence
atggccgacagagccgagatgttcagcctgagcaccttccacagcctgagcccccccggctgcagacccccccaggacatcagcctggaggagttcgacgacgaggacctgagcgagatcaccgacgactgcggcctgggcctgagctacgacagcgaccactgcgagaaggacagcctgagcctgggcagaagcgagcagccccaccccatctgcagcttccaggacgacttccaggagttcgagatgatcgacgacaacgaggaggaggacgacgaggacgaggaggaggaggaggaggaggaggagggcgacggcgagggccaggagggcggcgaccccggcagcgaggcccccgcccccggccccctgatccccagccccagcgtggaggagccccacaagcacagacccaccaccctgagactgaccaccctgggcgcccaggacagcctgaacaacaacggcggcttcgacctggtgagacccgccagctggcaggagaccgccctgtgcagccccgcccccgaggccctgagagagctgcccggccccctgcccgccaccgacaccggccccggcggcgcccagagccccgtgagacccggctgcgactgcgagggcaacagacccgccgagccccccgcccccggcggcaccagccccagcagcgaccccggcatcgaggccgacctgagaagcagaagcagcggcggcagaggcggcagaagaagcagccaggagctgagcagccccggcagcgacagcgaggacgccggcggcagactgggcagaatgatcagcagcatcagcgagaccgagctggagctgagcagcgacggcggcagcagcagcagcggcagaagcagccacctgaccaacagcatcgaggaggccagcagccccgccagcgagcccgagccccccagagagccccccagaagacccgccttcctgcccgtgggccccgacgacaccaacagcgagtacgagagcggcagcgagagcgagcccgacctgagcgaggacgccgacagcccctggctgctgagcaacctggtgagcagaatgatcagcgagggcagcagccccatcagatgccccggccagtgcctgagccccgcccccagaccccccggcgagcccgtgagccccgccggcggcgccgcccaggacagccaggaccccgaggccgccgccggccccggcggcgtggagctggtggacatggagaccctgtgcgccccccccccccccgcccccgccgcccccagacccggccccgcccagcccggcccctgcctgttcctgagcaaccccaccagagacaccatcacccccctgtgggccgcccccggcagagccgccagacccggcagagcctgcagcgccgcctgcagcgaggaggaggacgaggaggacgacgaggaggaggaggacgccgaggacagcgccggcagccccggcggcagaggcaccggccccagcgcccccagagacgccagcctggtgtacgacgccgtgaagtacaccctggtggtggacgagcacacccagctggagctggtgagcctgagaagatgcgccggcctgggccacgacagcgaggaggacagcggcggcgaggccagcgaggaggaggccggcgccgccctgctgggcggcggccaggtgagcggcgacaccagccccgacagccccgacctgaccttcagcaagaagttcctgaacgtgttcgtgaacagcaccagcagaagcagcagcaccgagagcttcggcctgttcagctgcctggtgaacggcgaggagagagagcagacccacagagccgtgttcagattcatccccagacaccccgacgagctggagctggacgtggacgaccccgtgctggtggaggccgaggaggacgacttctggttcagaggcttcaacatgagaaccggcgagagaggcgtgttccccgccttctacgcccacgccgtgcccggccccgccaaggacctgctgggcagcaagagaagcccctgctgggtggagagattcgacgtgcagttcctgggcagcgtggaggtgccctgccaccagggcaacggcatcctgtgcgccgccatgcagaagatcgccaccgccagaaagctgaccgtgcacctgagaccccccgccagctgcgacctggagatcagcctgagaggcgtgaagctgagcctgagcggcggcggccccgagttccagagatgcagccacttcttccagatgaagaacatcagcttctgcggctgccaccccagaaacagctgctacttcggcttcatcaccaagcaccccctgctgagcagattcgcctgccacgtgttcgtgagccaggagagcatgagacccgtggcccagagcgtgggcagagccttcctggagtactaccaggagcacctggcctacgcctgccccaccgaggacatctacctggagtag

SEQ ID NO: 89343 - DNA, 1335 bp, Artificial Sequence
  Description of Artificial Sequence: Synthetic coding sequence
atggccgacagagccgagatgttcagcctgagcaccttccacagcctgagcccccccggctgcagacccccccaggacatcagcctggaggagttcgacgacgaggacctgagcgagatcaccgacgactgcggcctgggcctgagctacgacagcgaccactgcgagaaggacagcctgagcctgggcagaagcgagcagccccaccccatctgcagcttccaggacgacttccaggagttcgagatgatcgacgacaacgaggaggaggaggacgaggaggacgacgaggaggaggaggacgccgaggacagcgccggcagccccggcggcagaggcaccggccccagcgcccccagagacgccagcctggtgtacgacgccgtgaagtacaccctggtggtggacgagcacacccagctggagctggtgagcctgagaagatgcgccggcctgggccacgacagcgaggaggacagcggcggcgaggccagcgaggaggaggccggcgccgccctgctgggcggcggccaggtgagcggcgacaccagccccgacagccccgacctgaccttcagcaagaagttcctgaacgtgttcgtgaacagcaccagcagaagcagcagcaccgagagcttcggcctgttcagctgcctggtgaacggcgaggagagagagcagacccacagagccgtgttcagattcatccccagacaccccgacgagctggagctggacgtggacgaccccgtgctggtggaggccgaggaggacgacttctggttcagaggcttcaacatgagaaccggcgagagaggcgtgttccccgccttctacgcccacgccgtgcccggccccgccaaggacctgctgggcagcaagagaagcccctgctgggtggagagattcgacgtgcagttcctgggcagcgtggaggtgccctgccaccagggcaacggcatcctgtgcgccgccatgcagaagatcgccaccgccagaaagctgaccgtgcacctgagaccccccgccagctgcgacctggagatcagcctgagaggcgtgaagctgagcctgagcggcggcggccccgagttccagagatgcagccacttcttccagatgaagaacatcagcttctgcggctgccaccccagaaacagctgctacttcggcttcatcaccaagcaccccctgctgagcagattcgcctgccacgtgttcgtgagccaggagagcatgagacccgtggcccagagcgtgggcagagccttcctggagtactaccaggagcacctggcctacgcctgccccaccgaggacatctacctggagtag

SEQ ID NO: 89344 - DNA, 1677 bp, Artificial Sequence
  Description of Artificial Sequence: Synthetic coding sequence
atgatcagcagcatcagcgagaccgagctggagctgagcagcgacggcggcagcagcagcagcggcagaagcagccacctgaccaacagcatcgaggaggccagcagccccgccagcgagcccgagccccccagagagccccccagaagacccgccttcctgcccgtgggccccgacgacaccaacagcgagtacgagagcggcagcgagagcgagcccgacctgagcgaggacgccgacagcccctggctgctgagcaacctggtgagcagaatgatcagcgagggcagcagccccatcagatgccccggccagtgcctgagccccgcccccagaccccccggcgagcccgtgagccccgccggcggcgccgcccaggacagccaggaccccgaggccgccgccggccccggcggcgtggagctggtggacatggagaccctgtgcgccccccccccccccgcccccgccgcccccagacccggccccgcccagcccggcccctgcctgttcctgagcaaccccaccagagacaccatcacccccctgtgggccgcccccggcagagccgccagacccggcagagcctgcagcgccgcctgcagcgaggaggaggacgaggaggacgacgaggaggaggaggacgccgaggacagcgccggcagccccggcggcagaggcaccggccccagcgcccccagagacgccagcctggtgtacgacgccgtgaagtacaccctggtggtggacgagcacacccagctggagctggtgagcctgagaagatgcgccggcctgggccacgacagcgaggaggacagcggcggcgaggccagcgaggaggaggccggcgccgccctgctgggcggcggccaggtgagcggcgacaccagccccgacagccccgacctgaccttcagcaagaagttcctgaacgtgttcgtgaacagcaccagcagaagcagcagcaccgagagcttcggcctgttcagctgcctggtgaacggcgaggagagagagcagacccacagagccgtgttcagattcatccccagacaccccgacgagctggagctggacgtggacgaccccgtgctggtggaggccgaggaggacgacttctggttcagaggcttcaacatgagaaccggcgagagaggcgtgttccccgccttctacgcccacgccgtgcccggccccgccaaggacctgctgggcagcaagagaagcccctgctgggtggagagattcgacgtgcagttcctgggcagcgtggaggtgccctgccaccagggcaacggcatcctgtgcgccgccatgcagaagatcgccaccgccagaaagctgaccgtgcacctgagaccccccgccagctgcgacctggagatcagcctgagaggcgtgaagctgagcctgagcggcggcggccccgagttccagagatgcagccacttcttccagatgaagaacatcagcttctgcggctgccaccccagaaacagctgctacttcggcttcatcaccaagcaccccctgctgagcagattcgcctgccacgtgttcgtgagccaggagagcatgagacccgtggcccagagcgtgggcagagccttcctggagtactaccaggagcacctggcctacgcctgccccaccgaggacatctacctggagtag

SEQ ID NO: 89345 - DNA, 1677 bp, Artificial Sequence; identical to SEQ ID NO: 89344
  Description of Artificial Sequence: Synthetic coding sequence

SEQ ID NO: 89346 - DNA, 1641 bp, Artificial Sequence
  Description of Artificial Sequence: Synthetic coding sequence
atggccgacagagccgagatgttcagcctgagcaccttccacagcctgagcccccccggctgcagacccccccaggacatcagcctggaggagttcgacgacgaggacctgagcgagatcaccgacgactgcggcctgggcctgagctacgacagcgaccactgcgagaaggacagcctgagcctgggcagaagcgagcagccccaccccatctgcagcttccaggacgacttccaggagttcgagatgatcgacgacaacgaggaggaggacgacgaggacgaggaggaggaggaggaggaggaggagggcgacggcgagggccaggagggcggcgaccccggcagcgaggcccccgcccccggccccctgatccccagccccagcgtggaggagccccacaagcacagacccaccaccctgagactgaccaccctgggcgcccaggacagcctgaacaacaacggcggcttcgacctggtgagacccgccagctggcaggagaccgccctgtgcagccccgcccccgaggccctgagagagctgcccggccccctgcccgccaccgacaccggccccggcggcgcccagagccccgtgagacccggctgcgactgcgagggcaacagacccgccgagccccccgcccccggcggcaccagccccagcagcgaccccggcatcgaggccgacctgagaagcagaagcagcggcggcagaggcggcagaagaagcagccaggagctgagcagccccggcagcgacagcgaggacgccggcggcagactgggcagaatgatcagcagcatcagcgagaccgagctggagctgagcagcgacggcggcagcagcagcagcggcagaagcagccacctgaccttcagcaagaagttcctgaacgtgttcgtgaacagcaccagcagaagcagcagcaccgagagcttcggcctgttcagctgcctggtgaacggcgaggagagagagcagacccacagagccgtgttcagattcatccccagacaccccgacgagctggagctggacgtggacgaccccgtgctggtggaggccgaggaggacgacttctggttcagaggcttcaacatgagaaccggcgagagaggcgtgttccccgccttctacgcccacgccgtgcccggccccgccaaggacctgctgggcagcaagagaagcccctgctgggtggagagattcgacgtgcagttcctgggcagcgtggaggtgccctgccaccagggcaacggcatcctgtgcgccgccatgcagaagatcgccaccgccagaaagctgaccgtgcacctgagaccccccgccagctgcgacctggagatcagcctgagaggcgtgaagctgagcctgagcggcggcggccccgagttccagagatgcagccacttcttccagatgaagaacatcagcttctgcggctgccaccccagaaacagctgctacttcggcttcatcaccaagcaccccctgctgagcagattcgcctgccacgtgttcgtgagccaggagagcatgagacccgtggcccagagcgtgggcagagccttcctggagtactaccaggagcacctggcctacgcctgccccaccgaggacatctacctggagtag

SEQ ID NO: 89347 - DNA, 1149 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtacctggtgatggagctgatggacgccaacctgtgccaggtgatccacatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgcctgcaccaacttcatgatgaccccctacgtggtgaccagatactacagagcccccgaggtgatcctgggcatgggctacaaggagaacgtggacatctggagcgtgggctgcatcatggccgagatggtgctgcacaaggtgctgttccccggcagagactacatcgaccagtggaacaaggtgatcgagcagctgggcacccccagcgccgagttcatgaagaagctgcagcccaccgtgagaaactacgtggagaacagacccaagtaccccggcatcaagttcgaggagctgttccccgactggatcttccccagcgagagcgagagagacaagatcaagaccagccaggccagagacctgctgagcaagatgctggtgatcgaccccgacaagagaatcagcgtggacgaggccctgagacacccctacatcaccgtgtggtacgaccccgccgaggccgaggccccccccccccagatctacgacgcccagctggaggagagagagcacgccatcgaggagtggaaggagctgatctacaaggaggtgatggactgggaggagagaagcaagaacggcgtggtgaaggaccagcccagcgcccagatgcagcagtag

SEQ ID NO: 89348 - DNA, 1149 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtacctggtgatggagctgatggacgccaacctgtgccaggtgatccacatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgcctgcaccaacttcatgatgaccccctacgtggtgaccagatactacagagcccccgaggtgatcctgggcatgggctacaaggagaacgtggacatctggagcgtgggctgcatcatgggcgagctggtgaagggctgcgtgatcttccagggcaccgaccacatcgaccagtggaacaaggtgatcgagcagctgggcacccccagcgccgagttcatgaagaagctgcagcccaccgtgagaaactacgtggagaacagacccaagtaccccggcatcaagttcgaggagctgttccccgactggatcttccccagcgagagcgagagagacaagatcaagaccagccaggccagagacctgctgagcaagatgctggtgatcgaccccgacaagagaatcagcgtggacgaggccctgagacacccctacatcaccgtgtggtacgaccccgccgaggccgaggccccccccccccagatctacgacgcccagctggaggagagagagcacgccatcgaggagtggaaggagctgatctacaaggaggtgatggactgggaggagagaagcaagaacggcgtggtgaaggaccagcccagcgcccagatgcagcagtag

SEQ ID NO: 89349 - DNA, 375 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtggagacaccactgcagcgccctgcccttcatcggcagaatgagacccgtgagcgtgatcgtgaccccctggatcaaccaggagggcatgctgtgcgagggcctgggctggcccagcctgccctggtgcctgaccagcaccgtgtgccccgcccagaacgtgagaatcgtgagcctgaccctgaacgtgagcctgctgcacggcaagaccgtgagcagaagaagcatcaccggccagctgaagtgctgcatctag

SEQ ID NO: 89350 - DNA, 729 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtacctggtgatggagctgatggacgccaacctgtgccaggtgatccacatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgcctgcaccaacttcatgatgaccccctacgtggtgaccagatactacagagcccccgaggtgatcctgggcatgggctacaaggagaacgtggacatctggagcgtgggctgcatcatgggcgagctggtgaagggctgcgtgatcttccagggcaccgacagaatcctgcccagagacctgggccccgccatgctgagctag

SEQ ID NO: 89351 - DNA, 1275 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtacctggtgatggagctgatggacgccaacctgtgccaggtgatccacatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgcctgcaccaacttcatgatgaccccctacgtggtgaccagatactacagagcccccgaggtgatcctgggcatgggctacaaggagaacgtggacatctggagcgtgggctgcatcatgggcgagctggtgaagggctgcgtgatcttccagggcaccgaccacatcgaccagtggaacaaggtgatcgagcagctgggcacccccagcgccgagttcatgaagaagctgcagcccaccgtgagaaactacgtggagaacagacccaagtaccccggcatcaagttcgaggagctgttccccgactggatcttccccagcgagagcgagagagacaagatcaagaccagccaggccagagacctgctgagcaagatgctggtgatcgaccccgacaagagaatcagcgtggacgaggccctgagacacccctacatcaccgtgtggtacgaccccgccgaggccgaggccccccccccccagatctacgacgcccagctggaggagagagagcacgccatcgaggagtggaaggagctgatctacaaggaggtgatggactgggaggagagaagcaagaacggcgtggtgaaggaccagcccagcgacgccgccgtgagcagcaacgccacccccagccagagcagcagcatcaacgacatcagcagcatgagcaccgagcagaccctggccagcgacaccgacagcagcctggacgccagcaccggccccctggagggctgcagatag

SEQ ID NO: 89352 - DNA, 1275 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtacctggtgatggagctgatggacgccaacctgtgccaggtgatccacatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgcctgcaccaacttcatgatgaccccctacgtggtgaccagatactacagagcccccgaggtgatcctgggcatgggctacaaggagaacgtggacatctggagcgtgggctgcatcatggccgagatggtgctgcacaaggtgctgttccccggcagagactacatcgaccagtggaacaaggtgatcgagcagctgggcacccccagcgccgagttcatgaagaagctgcagcccaccgtgagaaactacgtggagaacagacccaagtaccccggcatcaagttcgaggagctgttccccgactggatcttccccagcgagagcgagagagacaagatcaagaccagccaggccagagacctgctgagcaagatgctggtgatcgaccccgacaagagaatcagcgtggacgaggccctgagacacccctacatcaccgtgtggtacgaccccgccgaggccgaggccccccccccccagatctacgacgcccagctggaggagagagagcacgccatcgaggagtggaaggagctgatctacaaggaggtgatggactgggaggagagaagcaagaacggcgtggtgaaggaccagcccagcgacgccgccgtgagcagcaacgccacccccagccagagcagcagcatcaacgacatcagcagcatgagcaccgagcagaccctggccagcgacaccgacagcagcctggacgccagcaccggccccctggagggctgcagatag

SEQ ID NO: 89353 - DNA, 315 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtag

SEQ ID NO: 89354 - DNA, 645 bp, Artificial Sequence
  Description of Artificial Sequence: Synthetic coding sequence
atgagcgacagcaagtgcgacagccagttctacagcgtgcaggtggccgacagcaccttcaccgtgctgaagagataccagcagctgaagcccatcggcagcggcgcccagggcatcgtgtgcgccgccttcgacaccgtgctgggcatcaacgtggccgtgaagaagctgagcagacccttccagaaccagacccacgccaagagagcctacagagagctggtgctgctgaagtgcgtgaaccacaagaacatcatcagcctgctgaacgtgttcaccccccagaagaccctggaggagttccaggacgtgtacctggtgatggagctgatggacgccaacctgtgccaggtgatccacatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgcctgcaccaacttcatgatgaccccctacgtggtgaccagatactacagagcccccgaggtgatcctgggcatgggctacaaggagaacgccatcaagtactggaccctgtggcactag

SEQ ID NO: 89355 - DNA, 1347 bp, Artificial Sequence
  Description of Artificial Sequence: Synthetic coding sequence
atgctgtggctggccctgggccccttccccgccatggagaaccaggtgctggtgatcagaatcaagatccccaacagcggcgccgtggactggaccgtgcacagcggcccccagctgctgttcagagacgtgctggacgtgatcggccaggtgctgcccgaggccaccaccaccgccttcgagtacgaggacgaggacggcgacagaatcaccgtgagaagcgacgaggagatgaaggccatgctgagctactactacagcaccgtgatggagcagcaggtgaacggccagctgatcgagcccctgcagatcttccccagagcctgcaagccccccggcgagagaaacatccacggcctgaaggtgaacaccagagccggccccagccagcacagcagccccgccgtgagcgacagcctgcccagcaacagcctgaagaagagcagcgccgagctgaagaagatcctggccaacggccagatgaacgagcaggacatcagatacagagacaccctgggccacggcaacggcggcaccgtgtacaaggcctaccacgtgcccagcggcaagatcctggccgtgaaggtgatcctgctggacatcaccctggagctgcagaagcagatcatgagcgagctggagatcctgtacaagtgcgacagcagctacatcatcggcttctacggcgccttcttcgtggagaacagaatcagcatctgcaccgagttcatggacggcggcagcctggacgtgtacagaaagatgcccgagcacgtgctgggcagaatcgccgtggccgtggtgaagggcctgacctacctgtggagcctgaagatcctgcacagagacgtgaagcccagcaacatgctggtgaacaccagaggccaggtgaagctgtgcgacttcggcgtgagcacccagctggtgaacagcatcgccaagacctacgtgggcaccaacgcctacatggcccccgagagaatcagcggcgagcagtacggcatccacagcgacgtgtggagcctgggcatcagcttcatggagctggccctgggcagattcccctacccccagatccagaagaaccagggcagcctgatgcccctgcagctgctgcagtgcatcgtggacgaggacagccccgtgctgcccgtgggcgagttcagcgagcccttcgtgcacttcatcacccagtgcatgagaaagcagcccaaggagagacccgcccccgaggagctgatgggccaccccttcatcgtgcagttcaacgacggcaacgccgccgtggtgagcatgtgggtgtgcagagccctggaggagagaagaagccagcagggccccccctag

SEQ ID NO: 89356 - DNA, 1317 bp, Artificial Sequence
  Description of Artificial Sequence: Synthetic coding sequence
atgctgtggctggccctgggccccttccccgccatggagaaccaggtgctggtgatcagaatcaagatccccaacagcggcgccgtggactggaccgtgcacagcggcccccagctgctgttcagagacgtgctggacgtgatcggccaggtgctgcccgaggccaccaccaccgccttcgagtacgaggacgaggacggcgacagaatcaccgtgagaagcgacgaggagatgaaggccatgctgagctactactacagcaccgtgatggagcagcaggtgaacggccagctgatcgagcccctgcagatcttccccagagcctgcaagccccccggcgagagaaacatccacggcctgaaggtgaacaccagagccggccccagccagcacagcagccccgccgtgagcgacagcctgcccagcaacagcctgaagaagagcagcgccgagctgaagaagatcctggccaacggccagatgaacgagcaggacatcagatacagagacaccctgggccacggcaacggcggcaccgtgtacaaggcctaccacgtgcccagcggcaagatcctggccgtgaaggtgatcctgctggacatcaccctggagctgcagaagcagatcatgagcgagctggagatcctgtacaagtgcgacagcagctacatcatcggcttctacggcgccttcttcgtggagaacagaatcagcatctgcaccgagttcatggacggcggcagcctggacgtgtacagaaagatgcccgagcacgtgctgggcagaatcgccgtggccgtggtgaagggcctgacctacctgtggagcctgaagatcctgcacagagacgtgaagcccagcaacatgctggtgaacaccagaggccaggtgaagctgtgcgacttcggcgtgagcacccagctggtgaacagcatcgccaagacctacgtgggcaccaacgcctacatggcccccgagagaatcagcggcgagcagtacggcatccacagcgacgtgtggagcctgggcatcagcttcatggagatccagaagaaccagggcagcctgatgcccctgcagctgctgcagtgcatcgtggacgaggacagccccgtgctgcccgtgggcgagttcagcgagcccttcgtgcacttcatcacccagtgcatgagaaagcagcccaaggagagacccgcccccgaggagctgatgggccaccccttcatcgtgcagttcaacgacggcaacgccgccgtggtgagcatgtgggtgtgcagagccctggaggagagaagaagccagcagggccccccctag

SEQ ID NO: 89357 - DNA, 1335 bp, Artificial Sequence
  Description of Artificial Sequence: Synthetic coding sequence
atgctgtggctggccctgggccccttccccgccatggagaaccaggtgctggtgatcagaatcaagatccccaacagcggcgccgtggactggaccgtgcacagcggcccccagctgctgttcagagacgtgctggacgtgatcggccaggtgctgcccgaggccaccaccaccgccttcgagtacgaggacgaggacggcgacagaatcaccgtgagaagcgacgaggagatgaaggccatgctgagctactactacagcaccgtgatggagcagcaggtgaacggccagctgatcgagcccctgcagatcttccccagagcctgcaagccccccggcgagagaaacatccacggcctgaaggtgaacaccagagccggccccagccagcacagcagccccgccgtgagcgacagcctgcccagcaacagcctgaagaagagcagcgccgagctgaagaagatcctggccaacggccagatgaacgagcaggacatcagatacagagacaccctgggccacggcaacggcggcaccgtgtacaaggcctaccacgtgcccagcggcaagatcctggccgtgaaggtgatcctgctggacatcaccctggagctgcagaagcagatcatgagcgagctggagatcctgtacaagtgcgacagcagctacatcatcggcttctacggcgccttcttcgtggagaacagaatcagcatctgcaccgagttcatggacggcggcagcctggacgtgtacagaaagatgcccgagcacgtgctgggcagaatcgccgtggccgtggtgaagggcctgacctacctgtggagcctgaagatcctgcacagagacgtgaagcccagcaacatgctggtgaacaccagaggccaggtgaagctgtgcgacttcggcgtgagcacccagctggtgaacagcatcgccaagacctacgtgggcaccaacgcctacatggcccccgagagaatcagcggcgagcagtacggcatccacagcgacgtgtggagcctgggcatcagcttcatggagatccagaagaaccagggcagcctgatgcccctgcagctgctgcagtgcatcgtggacgaggacagccccgtgctgcccgtgggcgagttcagcgagcccttcgtgcacttcatcacccagtgcatgagaaagcagcccaaggagagacccgcccccgaggagctgatgggccaccccttcatcgtgcagttcaacgacggcaacgccgccgtggtgagcatgtgggtgtgcagagccctggaggagagaagaagccccgccagcctgcccagccccagcagcagcatctag

SEQ ID NO: 89358 - DNA, 1239 bp, Artificial Sequence
  Description of Artificial Sequence: Synthetic coding sequence
atgatggagggccacttcccccagagcgacgtgatcggccaggtgctgcccgaggccaccaccaccgccttcgagtacgaggacgaggacggcgacagaatcaccgtgagaagcgacgaggagatgaaggccatgctgagctactactacagcaccgtgatggagcagcaggtgaacggccagctgatcgagcccctgcagatcttccccagagcctgcaagccccccggcgagagaaacatccacggcctgaaggtgaacaccagagccggccccagccagcacagcagccccgccgtgagcgacagcctgcccagcaacagcctgaagaagagcagcgccgagctgaagaagatcctggccaacggccagatgaacgagcaggacatcagatacagagacaccctgggccacggcaacggcggcaccgtgtacaaggcctaccacgtgcccagcggcaagatcctggccgtgaaggtgatcctgctggacatcaccctggagctgcagaagcagatcatgagcgagctggagatcctgtacaagtgcgacagcagctacatcatcggcttctacggcgccttcttcgtggagaacagaatcagcatctgcaccgagttcatggacggcggcagcctggacgtgtacagaaagatgcccgagcacgtgctgggcagaatcgccgtggccgtggtgaagggcctgacctacctgtggagcctgaagatcctgcacagagacgtgaagcccagcaacatgctggtgaacaccagaggccaggtgaagctgtgcgacttcggcgtgagcacccagctggtgaacagcatcgccaagacctacgtgggcaccaacgcctacatggcccccgagagaatcagcggcgagcagtacggcatccacagcgacgtgtggagcctgggcatcagcttcatggagctggccctgggcagattcccctacccccagatccagaagaaccagggcagcctgatgcccctgcagctgctgcagtgcatcgtggacgaggacagccccgtgctgcccgtgggcgagttcagcgagcccttcgtgcacttcatcacccagtgcatgagaaagcagcccaaggagagacccgcccccgaggagctgatgggccaccccttcatcgtgcagttcaacgacggcaacgccgccgtggtgagcatgtgggtgtgcagagccctggaggagagaagaagccagcagggccccccctag

SEQ ID NO: 89359 - DNA, 1005 bp, Artificial Sequence
  Description of Artificial Sequence: Synthetic coding sequence
atgagccagagcaagggcaagaagagaaaccccggcctgaagatccccaaggaggccttcgagcagccccagaccagcagcaccccccccagagacctggacagcaaggcctgcatcagcatcggcaaccagaacttcgaggtgaaggccgacgacctggagcccatcatggagctgggcagaggcgcctacggcgtggtggagaagatgagacacgtgcccagcggccagatcatggccgtgaagagaatcagagccaccgtgaacagccaggagcagaagagactgctgatggacctggacatcagcatgagaaccgtggactgccccttcaccgtgaccttctacggcgccctgttcagagagggcgacgtgtggatctgcatggagctgatggacaccagcctggacaagttctacaagcaggtgatcgacaagggccagaccatccccgaggacatcctgggcaagatcgccgtgagcatcgtgaaggccctggagcacctgcacagcaagctgagcgtgatccacagagacgtgaagcccagcaacgtgctgatcaacgccctgggccaggtgaagatgtgcgacttcggcatcagcggctacctggtggacagcgtggccaagaccatcgacgccggctgcaagccctacatggcccccgagagaatcaaccccgagctgaaccagaagggctacagcgtgaagagcgacatctggagcctgggcatcaccatgatcgagctggccatcctgagattcccctacgacagctggggcacccccttccagcagctgaagcaggtggtggaggagcccagcccccagctgcccgccgacaagttcagcgccgagttcgtggacttcaccagccagtgcctgaagaagaacagcaaggagagacccacctaccccgagctgatgcagcaccccttcttcaccctgcacgagagcaagggcaccgacgtggccagcttcgtgaagctgatcctgggcgactag

SEQ ID NO: 89360 - DNA, 1005 bp, Artificial Sequence; identical to SEQ ID NO: 89359
  Description of Artificial Sequence: Synthetic coding sequence

SEQ ID NO: 89361 - DNA, 2865 bp, Artificial Sequence
  Description of Artificial Sequence: Synthetic coding sequence
atggaggaggaggagggcgccgtggccaaggagtggggcaccacccccgccggccccgtgtggaccgccgtgttcgactacgaggccgccggcgacgaggagctgaccctgagaagaggcgacagagtgcaggtgctgagccaggactgcgccgtgagcggcgacgagggctggtggaccggccagctgcccagcggcagagtgggcgtgttccccagcaactacgtggcccccggcgcccccgccgcccccgccggcctgcagctgccccaggagatccccttccacgagctgcagctggaggagatcatcggcgtgggcggcttcggcaaggtgtacagagccctgtggagaggcgaggaggtggccgtgaaggccgccagactggaccccgagaaggaccccgccgtgaccgccgagcaggtgtgccaggaggccagactgttcggcgccctgcagcaccccaacatcatcgccctgagaggcgcctgcctgaaccccccccacctgtgcctggtgatggagtacgccagaggcggcgccctgagcagagtgctggccggcagaagagtgcccccccacgtgctggtgaactgggccgtgcaggtggccagaggcatgaactacctgcacaacgacgcccccgtgcccatcatccacagagacctgaagagcatcaacatcctgatcctggaggccatcgagaaccacaacctggccgacaccgtgctgaagatcaccgacttcggcctggccagagagtggcacaagaccaccaagatgagcgccgccggcacctacgcctggatggcccccgaggtgatcagactgagcctgttcagcaagagcagcgacgtgtggagcttcggcgtgctgctgtgggagctgctgaccggcgaggtgccctacagagagatcgacgccctggccgtggcctacggcgtggccatgaacaagctgaccctgcccatccccagcacctgccccgagcccttcgccagactgctggaggagtgctgggaccccgacccccacggcagacccgacttcggcagcatcctgaagagactggaggtgatcgagcagagcgccctgttccagatgcccctggagagcttccacagcctgcaggaggactggaagctggagatccagcacatgttcgacgacctgagaaccaaggagaaggagctgagaagcagagaggaggagctgctgagagccgcccaggagcagagattccaggaggagcagctgagaagaagagagcaggagctggccgagagagagatggacatcgtggagagagagctgcacctgctgatgtgccagctgagccaggagaagcccagagtgagaaagagaaagggcaacttcaagagaagcagactgctgaagctgagagagggcggcagccacatcagcctgcccagcggcttcgagcacaagatcaccgtgcaggccagccccaccctggacaagagaaagggcagcgacggcgccagcccccccgccagccccagcatcatccccagactgagagccatcagactgacccccgtggactgcggcggcagcagcagcggcagcagcagcggcggcagcggcacctggagcagaggcggcccccccaagaaggaggagctggtgggcggcaagaagaagggcagaacctggggccccagcagcaccctgcagaaggagagagtgggcggcgaggagagactgaagggcctgggcgagggcagcaagcagtggagcagcagcgcccccaacctgggcaagagccccaagcacacccccatcgcccccggcttcgccagcctgaacgagatggaggagttcgccgaggccgaggacggcggcagcagcgtgccccccagcccctacagcacccccagctacctgagcgtgcccctgcccgccgagcccagccccggcgccagagccccctgggagcccacccccagcgccccccccgccagatggggccacggcgccagaagaagatgcgacctggccctgctgggctgcgccaccctgctgggcgccgtgggcctgggcgccgacgtggccgaggccagagccgccgacggcgaggagcagagaagatggctggacggcctgttcttccccagagccggcagattccccagaggcctgagcccccccgccagaccccacggcagaagagaggacgtgggccccggcctgggcctggcccccagcgccaccctggtgagcctgagcagcgtgagcgactgcaacagcaccagaagcctgctgagaagcgacagcgacgaggccgcccccgccgcccccagccccccccccagcccccccgcccccacccccacccccagccccagcaccaaccccctggtggacctggagctggagagcttcaagaaggaccccagacagagcctgacccccacccacgtgaccgccgcctgcgccgtgagcagaggccacagaagaacccccagcgacggcgccctgggccagagaggcccccccgagcccgccggccacggccccggccccagagacctgctggacttccccagactgcccgacccccaggccctgttccccgccagaagaagaccccccgagttccccggcagacccaccaccctgaccttcgcccccagacccagacccgccgccagcagacccagactggacccctggaagctggtgagcttcggcagaaccctgaccatcagcccccccagcagacccgacacccccgagagccccggcccccccagcgtgcagcccaccctgctggacatggacatggagggccagaaccaggacagcaccgtgcccctgtgcggcgcccacggcagccactag

SEQ ID NO: 89362 - DNA, 2544 bp, Artificial Sequence
  Description of Artificial Sequence: Synthetic coding sequence
atggagcccctgaagagcctgttcctgaagagccccctgggcagctggaacggcagcggcagcggcggcggcggcggcggcggcggcggcagacccgagggcagccccaaggccgccggctacgccaaccccgtgtggaccgccctgttcgactacgagcccagcggccaggacgagctggccctgagaaagggcgacagagtggaggtgctgagcagagacgccgccatcagcggcgacgagggctggtgggccggccaggtgggcggccaggtgggcatcttccccagcaactacgtgagcagaggcggcggcccccccccctgcgaggtggccagcttccaggagctgagactggaggaggtgatcggcatcggcggcttcggcaaggtgtacagaggcagctggagaggcgagctggtggccgtgaaggccgccagacaggaccccgacgaggacatcagcgtgaccgccgagagcgtgagacaggaggccagactgttcgccatgctggcccaccccaacatcatcgccctgaaggccgtgtgcctggaggagcccaacctgtgcctggtgatggagtacgccgccggcggccccctgagcagagccctggccggcagaagagtgcccccccacgtgctggtgaactgggccgtgcagatcgccagaggcatgcactacctgcactgcgaggccctggtgcccgtgatccacagagacctgaagagcaacaacatcctgctgctgcagcccatcgagagcgacgacatggagcacaagaccctgaagatcaccgacttcggcctggccagagagtggcacaagaccacccagatgagcgccgccggcacctacgcctggatggcccccgaggtgatcaaggccagcaccttcagcaagggcagcgacgtgtggagcttcggcgtgctgctgtgggagctgctgaccggcgaggtgccctacagaggcatcgactgcctggccgtggcctacggcgtggccgtgaacaagctgaccctgcccatccccagcacctgccccgagcccttcgcccagctgatggccgactgctgggcccaggacccccacagaagacccgacttcgccagcatcctgcagcagctggaggccctggaggcccaggtgctgagagagatgcccagagacagcttccacagcatgcaggagggctggaagagagagatccagggcctgttcgacgagctgagagccaaggagaaggagctgctgagcagagaggaggagctgaccagagccgccagagagcagagaagccaggccgagcagctgagaagaagagagcacctgctggcccagtgggagctggaggtgttcgagagagagctgaccctgctgctgcagcaggtggacagagagagaccccacgtgagaagaagaagaggcaccttcaagagaagcaagctgagagccagagacggcggcgagagaatcagcatgcccctggacttcaagcacagaatcaccgtgcaggccagccccggcctggacagaagaagaaacgtgttcgaggtgggccccggcgacagccccaccttccccagattcagagccatccagctggagcccgccgagcccggccaggcctggggcagacagagccccagaagactggaggacagcagcaacggcgagagaagagcctgctgggcctggggccccagcagccccaagcccggcgaggcccagaacggcagaagaagaagcagaatggacgaggccacctggtacctggacagcgacgacagcagccccctgggcagccccagcaccccccccgccctgaacggcaacccccccagacccagcctggagcccgaggagcccaagagacccgtgcccgccgagagaggcagcagcagcggcacccccaagctgatccagagagccctgctgagaggcaccgccctgctggccagcctgggcctgggcagagacctgcagccccccggcggccccggcagagagagaggcgagagccccaccaccccccccacccccacccccgccccctgccccaccgagcccccccccagccccctgatctgcttcagcctgaagacccccgacagcccccccacccccgcccccctgctgctggacctgggcatccccgtgggccagagaagcgccaagagccccagaagagaggaggagcccagaggcggcaccgtgagccccccccccggcaccagcagaagcgcccccggcacccccggcacccccagaagcccccccctgggcctgatcagcagacccagacccagccccctgagaagcagaatcgacccctggagcttcgtgagcgccggccccagacccagccccctgcccagcccccagcccgcccccagaagagccccctggaccctgttccccgacagcgaccccttctgggacagcccccccgccaaccccttccagggcggcccccaggactgcagagcccagaccaaggacatgggcgcccaggccccctgggtgcccgaggccggcccctag

SEQ ID NO: 89363 - DNA, 1773 bp, Artificial Sequence
  Description of Artificial Sequence: Synthetic coding sequence
atggagcacaagaccctgaagatcaccgacttcggcctggccagagagtggcacaagaccacccagatgagcgccgccggcacctacgcctggatggcccccgaggtgatcaaggccagcaccttcagcaagggcagcgacgtgtggagcttcggcgtgctgctgtgggagctgctgaccggcgaggtgccctacagaggcatcgactgcctggccgtggcctacggcgtggccgtgaacaagctgaccctgcccatccccagcacctgccccgagcccttcgcccagctgatggccgactgctgggcccaggacccccacagaagacccgacttcgccagcatcctgcagcagctggaggccctggaggcccaggtgctgagagagatgcccagagacagcttccacagcatgcaggagggctggaagagagagatccagggcctgttcgacgagctgagagccaaggagaaggagctgctgagcagagaggaggagctgaccagagccgccagagagcagagaagccaggccgagcagctgagaagaagagagcacctgctggcccagtgggagctggaggtgttcgagagagagctgaccctgctgctgcagcaggtggacagagagagaccccacgtgagaagaagaagaggcaccttcaagagaagcaagctgagagccagagacggcggcgagagaatcagcatgcccctggacttcaagcacagaatcaccgtgcaggccagccccggcctggacagaagaagaaacgtgttcgaggtgggccccggcgacagccccaccttccccagattcagagccatccagctggagcccgccgagcccggccaggcctggggcagacagagccccagaagactggaggacagcagcaacggcgagagaagagcctgctgggcctggggccccagcagccccaagcccggcgaggcccagaacggcagaagaagaagcagaatggacgaggccacctggtacctggacagcgacgacagcagccccctgggcagccccagcaccccccccgccctgaacggcaacccccccagacccagcctggagcccgaggagcccaagagacccgtgcccgccgagagaggcagcagcagcggcacccccaagctgatccagagagccctgctgagaggcaccgccctgctggccagcctgggcctgggcagagacctgcagccccccggcggccccggcagagagagaggcgagagccccaccaccccccccacccccacccccgccccctgccccaccgagcccccccccagccccctgatctgcttcagcctgaagacccccgacagcccccccacccccgcccccctgctgctggacctgggcatccccgtgggccagagaagcgccaagagccccagaagagaggaggagcccagaggcggcaccgtgagccccccccccggcaccagcagaagcgcccccggcacccccggcacccccagaagcccccccctgggcctgatcagcagacccagacccagccccctgagaagcagaatcgacccctggagcttcgtgagcgccggccccagacccagccccctgcccagcccccagcccgcccccagaagagccccctggaccctgttccccgacagcgaccccttctgggacagcccccccgccaaccccttccagggcggcccccaggactgcagagcccagaccaaggacatgggcgcccaggccccctgggtgcccgaggccggcccctag

SEQ ID NO: 89364 - DNA, 2580 bp, Artificial Sequence
  Description of Artificial Sequence: Synthetic coding sequence
atggcctgcctgcacgagaccagaacccccagccccagcttcggcggcttcgtgagcaccctgagcgaggccagcatgagaaagctggaccccgacaccagcgactgcacccccgagaaggacctgacccccacccacgtgctgcagctgcacgagcaggacgccggcggccccggcggcgccgccggcagccccgagagcagagccagcagagtgagagccgacgaggtgagactgcagtgccagagcggcagcggcttcctggagggcctgttcggctgcctgagacccgtgtggaccatgatcggcaaggcctacagcaccgagcacaagcagcagcaggaggacctgtgggaggtgcccttcgaggagatcctggacctgcagtgggtgggcagcggcgcccagggcgccgtgttcctgggcagattccacggcgaggaggtggccgtgaagaaggtgagagacctgaaggagaccgacatcaagcacctgagaaagctgaagcaccccaacatcatcaccttcaagggcgtgtgcacccaggccccctgctactgcatcctgatggagttctgcgcccagggccagctgtacgaggtgctgagagccggcagacccgtgacccccagcctgctggtggactggagcatgggcatcgccggcggcatgaactacctgcacctgcacaagatcatccacagagacctgaagagccccaacatgctgatcacctacgacgacgtggtgaagatcagcgacttcggcaccagcaaggagctgagcgacaagagcaccaagatgagcttcgccggcaccgtggcctggatggcccccgaggtgatcagaaacgagcccgtgagcgagaaggtggacatctggagcttcggcgtggtgctgtgggagctgctgaccggcgagatcccctacaaggacgtggacagcagcgccatcatctggggcgtgggcagcaacagcctgcacctgcccgtgcccagcagctgccccgacggcttcaagatcctgctgagacagtgctggaacagcaagcccagaaacagacccagcttcagacagatcctgctgcacctggacatcgccagcgccgacgtgctgagcaccccccaggagacctacttcaagagccaggccgagtggagagaggaggtgaagctgcacttcgagaagatcaagagcgagggcacctgcctgcacagactggaggaggagctggtgatgagaagaagagaggagctgagacacgccctggacatcagagagcactacgagagaaagctggagagagccaacaacctgtacatggagctgaacgccctgatgctgcagctggagctgaaggagagagagctgctgagaagagagcaggccctggagagaagatgccccggcctgctgaagccccaccccagcagaggcctgctgcacggcaacaccatggagaagctgatcaagaagagaaacgtgccccagaagctgagcccccacagcaagagacccgacatcctgaagaccgagagcctgctgcccaagctggacgccgccctgagcggcgtgggcctgcccggctgccccaagggcccccccagccccggcagaagcagaagaggcaagaccagacacagaaaggccagcgccaagggcagctgcggcgacctgcccggcctgagaaccgccgtgcccccccacgagcccggcggccccggcagccccggcggcctgggcggcggccccagcgcctgggaggcctgcccccccgccctgagaggcctgcaccacgacctgctgctgagaaagatgagcagcagcagccccgacctgctgagcgccgccctgggcagcagaggcagaggcgccaccggcggcgccggcgaccccggcagccccccccccgccagaggcgacaccccccccagcgagggcagcgcccccggcagcaccagccccgacagccccggcggcgccaagggcgagccccccccccccgtgggccccggcgagggcgtgggcctgctgggcaccggcagagagggcaccagcggcagaggcggcagcagagccggcagccagcacctgacccccgccgccctgctgtacagagccgccgtgaccagaagccagaagagaggcatcagcagcgaggaggaggagggcgaggtggacagcgaggtggagctgaccagcagccagagatggccccagagcctgaacatgagacagagcctgagcaccttcagcagcgagaaccccagcgacggcgaggagggcaccgccagcgagcccagccccagcggcacccccgaggtgggcagcaccaacaccgacgagagacccgacgagagaagcgacgacatgtgcagccagggcagcgagatccccctggaccccccccccagcgaggtgatccccggccccgagcccagcagcctgcccatcccccaccaggagctgctgagagagagaggcccccccaacagcgaggacagcgactgcgacagcaccgagctggacaacagcaacagcgtggacgccctgagaccccccgccagcctgcccccctag

SEQ ID NO: 89365 - DNA, 2901 bp, Artificial Sequence
  Description of Artificial Sequence: Synthetic coding sequence
atggccaacttccaggagcacctgagctgcagcagcagcccccacctgcccttcagcgagagcaagaccttcaacggcctgcaggacgagctgaccgccatgggcaaccaccccagccccaagctgctggaggaccagcaggagaagggcatggtgagaaccgagctgatcgagagcgtgcacagccccgtgaccaccaccgtgctgaccagcgtgagcgaggacagcagagaccagttcgagaacagcgtgctgcagctgagagagcacgacgagagcgagaccgccgtgagccagggcaacagcaacaccgtggacggcgagagcaccagcggcaccgaggacatcaagatccagttcagcagaagcggcagcggcagcggcggcttcctggagggcctgttcggctgcctgagacccgtgtggaacatcatcggcaaggcctacagcaccgactacaagctgcagcagcaggacacctgggaggtgcccttcgaggagatcagcgagctgcagtggctgggcagcggcgcccagggcgccgtgttcctgggcaagttcagagccgaggaggtggccatcaagaaggtgagagagcagaacgagaccgacatcaagcacctgagaaagctgaagcaccccaacatcatcgccttcaagggcgtgtgcacccaggccccctgctactgcatcatcatggagtactgcgcccacggccagctgtacgaggtgctgagagccggcagaaagatcacccccagactgctggtggactggagcaccggcatcgccagcggcatgaactacctgcacctgcacaagatcatccacagagacctgaagagccccaacgtgctggtgacccacaccgacgccgtgaagatcagcgacttcggcaccagcaaggagctgagcgacaagagcaccaagatgagcttcgccggcaccgtggcctggatggcccccgaggtgatcagaaacgagcccgtgagcgagaaggtggacatctggagcttcggcgtggtgctgtgggagctgctgaccggcgagatcccctacaaggacgtggacagcagcgccatcatctggggcgtgggcagcaacagcctgcacctgcccgtgcccagcacctgccccgacggcttcaagatcctgatgaagcagacctggcagagcaagcccagaaacagacccagcttcagacagaccctgatgcacctggacatcgccagcgccgacgtgctggccaccccccaggagacctacttcaagagccaggccgagtggagagaggaggtgaagaagcacttcgagaagatcaagagcgagggcacctgcatccacagactggacgaggagctgatcagaagaagaagagaggagctgagacacgccctggacatcagagagcactacgagagaaagctggagagagccaacaacctgtacatggagctgagcgccatcatgctgcagctggagatgagagagaaggagctgatcaagagagagcaggccgtggagaagaagtaccccggcacctacaagagacaccccgtgagacccatcatccaccccaacgccatggagaagctgatgaagagaaagggcgtgccccacaagagcggcatgcagaccaagagacccgacctgctgagaagcgagggcatccccaccaccgaggtggcccccaccgccagccccctgagcggcagccccaagatgagcaccagcagcagcaagagcagatacagaagcaagcccagacacagaagaggcaacagcagaggcagccacagcgacttcgccgccatcctgaagaaccagcccgcccaggagaacagcccccaccccacctacctgcaccaggcccagagccagtaccccagcctgcaccaccacaacagcctgcagcagcagtaccagcagcccccccccgccatgagccagagccaccaccccagactgaacatgcacggccaggacatcgccacctgcgccaacaacctgagatacttcggccccgccgccgccctgagaagccccctgagcaaccacgcccagagacagctgcccggcagcagccccgacctgatcagcaccgccatggccgccgactgctggagaagcagcgagcccgacaagggccaggccggcccctggggctgctgccaggccgacgcctacgacccctgcctgcagtgcagacccgagcagtacggcagcctggacatccccagcgccgagcccgtgggcagaagccccgacctgagcaagagccccgcccacaaccccctgctggagaacgcccagagcagcgagaagaccgaggagaacgagttcagcggctgcagaagcgagagcagcctgggcaccagccacctgggcaccccccccgccctgcccagaaagaccagacccctgcagaagagcggcgacgacagcagcgaggaggaggagggcgaggtggacagcgaggtggagttccccagaagacagagaccccacagatgcatcagcagctgccagagctacagcaccttcagcagcgagaacttcagcgtgagcgacggcgaggagggcaacaccagcgaccacagcaacagccccgacgagctggccgacaagctggaggacagactggccgagaagctggacgacctgctgagccagacccccgagatccccatcgacatcagcagccacagcgacggcctgagcgacaaggagtgcgccgtgagaagagtgaagacccagatgagcctgggcaagctgtgcgtggaggagagaggctacgagaaccccatgcagttcgaggagagcgactgcgacagcagcgacggcgagtgcagcgacgccaccgtgagaaccaacaagcactacagcagcgccacctggtag

SEQ ID NO: 89366 - DNA, 2901 bp, Artificial Sequence; identical to SEQ ID NO: 89365
  Description of Artificial Sequence: Synthetic coding sequence

SEQ ID NO: 89367 - DNA, 414 bp, Artificial Sequence
  Description of Artificial Sequence: Synthetic coding sequence
atggccaacttccaggagcacctgagctgcagcagcagcccccacctgcccttcagcgagagcaagaccttcaacggcctgcaggacgagctgaccgccatgggcaaccaccccagccccaagctgctggaggaccagcaggagaagggcatggtgagaaccgagctgatcgagagcgtgcacagccccgtgaccaccaccgtgctgaccagcgtgagcgaggacagcagagaccagttcgagaacagcgtgctgcagctgagagagcacgacgagagcgagaccgccgtgagccagggcaacagcaacaccgtggacggcgagagcaccagcggcaccgaggacatcaagatccagttcagcagaagcggcagcggcagcggcggcttcctggagggcctgttcggctgctag

SEQ ID NO: 89368 - DNA, 342 bp, Artificial Sequence
  Description of Artificial Sequence: Synthetic coding sequence
atggccaacttccaggagcacctgagctgcagcagcagcccccacctgcccttcagcgagagcaagaccttcaacggcctgcaggacgagctgaccgccatgggcaaccaccccagccccaagctgctggaggaccagcaggagaagggcatggtgagaaccgagctgatcgagagcgtgcacagccccgtgaccaccaccgtgctgaccagcgtgagcgaggacagcagagaccagttcgagaacagcgtgctgcagctgagagagcacgacgagagcgagaccgccgtgagccagggcaacagcaacaccgtggacggcgagagcaccagcggcacctag

SEQ ID NO: 89369 - DNA, 2469 bp, Artificial Sequence
  Description of Artificial Sequence: Synthetic coding sequence
atgagctacgtggagtgcaagtgcctgcagctggagaacaagaacacctgggaggtgcccttcgaggagatcagcgagctgcagtggctgggcagcggcgcccagggcgccgtgttcctgggcaagttcagagccgaggaggtggccatcaagaaggtgagagagcagaacgagaccgacatcaagcacctgagaaagctgaagcaccccaacatcatcgccttcaagggcgtgtgcacccaggccccctgctactgcatcatcatggagtactgcgcccacggccagctgtacgaggtgctgagagccggcagaaagatcacccccagactgctggtggactggagcaccggcatcgccagcggcatgaactacctgcacctgcacaagatcatccacagagacctgaagagccccaacgtgctggtgacccacaccgacgccgtgaagatcagcgacttcggcaccagcaaggagctgagcgacaagagcaccaagatgagcttcgccggcaccgtggcctggatggcccccgaggtgatcagaaacgagcccgtgagcgagaaggtggacatctggagcttcggcgtggtgctgtgggagctgctgaccggcgagatcccctacaaggacgtggacagcagcgccatcatctggggcgtgggcagcaacagcctgcacctgcccgtgcccagcacctgccccgacggcttcaagatcctgatgaagcagacctggcagagcaagcccagaaacagacccagcttcagacagaccctgatgcacctggacatcgccagcgccgacgtgctggccaccccccaggagacctacttcaagagccaggccgagtggagagaggaggtgaagaagcacttcgagaagatcaagagcgagggcacctgcatccacagactggacgaggagctgatcagaagaagaagagaggagctgagacacgccctggacatcagagagcactacgagagaaagctggagagagccaacaacctgtacatggagctgagcgccatcatgctgcagctggagatgagagagaaggagctgatcaagagagagcaggccgtggagaagaagtaccccggcacctacaagagacaccccgtgagacccatcatccaccccaacgccatggagaagctgatgaagagaaagggcgtgccccacaagagcggcatgcagaccaagagacccgacctgctgagaagcgagggcatccccaccaccgaggtggcccccaccgccagccccctgagcggcagccccaagatgagcaccagcagcagcaagagcagatacagaagcaagcccagacacagaagaggcaacagcagaggcagccacagcgacttcgccgccatcctgaagaaccagcccgcccaggagaacagcccccaccccacctacctgcaccaggcccagagccagtaccccagcctgcaccaccacaacagcctgcagcagcagtaccagcagcccccccccgccatgagccagagccaccaccccagactgaacatgcacggccaggacatcgccacctgcgccaacaacctgagatacttcggccccgccgccgccctgagaagccccctgagcaaccacgcccagagacagctgcccggcagcagccccgacctgatcagcaccgccatggccgccgactgctggagaagcagcgagcccgacaagggccaggccggcccctggggctgctgccaggccgacgcctacgacccctgcctgcagtgcagacccgagcagtacggcagcctggacatccccagcgccgagcccgtgggcagaagccccgacctgagcaagagccccgcccacaaccccctgctggagaacgcccagagcagcgagaagaccgaggagaacgagttcagcggctgcagaagcgagagcagcctgggcaccagccacctgggcaccccccccgccctgcccagaaagaccagacccctgcagaagagcggcgacgacagcagcgaggaggaggagggcgaggtggacagcgaggtggagttccccagaagacagagaccccacagatgcatcagcagctgccagagctacagcaccttcagcagcgagaacttcagcgtgagcgacggcgaggagggcaacaccagcgaccacagcaacagccccgacgagctggccgacaagctggaggacagactggccgagaagctggacgacctgctgagccagacccccgagatccccatcgacatcagcagccacagcgacggcctgagcgacaaggagtgcgccgtgagaagagtgaagacccagatgagcctgggcaagctgtgcgtggaggagagaggctacgagaaccccatgcagttcgaggagagcgactgcgacagcagcgacggcgagtgcagcgacgccaccgtgagaaccaacaagcactacagcagcgccacctggtag

SEQ ID NO: 89370 - DNA, 2280 bp, Artificial Sequence
  Description of Artificial Sequence: Synthetic coding sequence
atgtactgcggcatccagatcctggccctgtgggagagaggcgtgtgcacccaggccccctgctactgcatcatcatggagtactgcgcccacggccagctgtacgaggtgctgagagccggcagaaagatcacccccagactgctggtggactggagcaccggcatcgccagcggcatgaactacctgcacctgcacaagatcatccacagagacctgaagagccccaacgtgctggtgacccacaccgacgccgtgaagatcagcgacttcggcaccagcaaggagctgagcgacaagagcaccaagatgagcttcgccggcaccgtggcctggatggcccccgaggtgatcagaaacgagcccgtgagcgagaaggtggacatctggagcttcggcgtggtgctgtgggagctgctgaccggcgagatcccctacaaggacgtggacagcagcgccatcatctggggcgtgggcagcaacagcctgcacctgcccgtgcccagcacctgccccgacggcttcaagatcctgatgaagcagacctggcagagcaagcccagaaacagacccagcttcagacagaccctgatgcacctggacatcgccagcgccgacgtgctggccaccccccaggagacctacttcaagagccaggccgagtggagagaggaggtgaagaagcacttcgagaagatcaagagcgagggcacctgcatccacagactggacgaggagctgatcagaagaagaagagaggagctgagacacgccctggacatcagagagcactacgagagaaagctggagagagccaacaacctgtacatggagctgagcgccatcatgctgcagctggagatgagagagaaggagctgatcaagagagagcaggccgtggagaagaagtaccccggcacctacaagagacaccccgtgagacccatcatccaccccaacgccatggagaagctgatgaagagaaagggcgtgccccacaagagcggcatgcagaccaagagacccgacctgctgagaagcgagggcatccccaccaccgaggtggcccccaccgccagccccctgagcggcagccccaagatgagcaccagcagcagcaagagcagatacagaagcaagcccagacacagaagaggcaacagcagaggcagccacagcgacttcgccgccatcctgaagaaccagcccgcccaggagaacagcccccaccccacctacctgcaccaggcccagagccagtaccccagcctgcaccaccacaacagcctgcagcagcagtaccagcagcccccccccgccatgagccagagccaccaccccagactgaacatgcacggccaggacatcgccacctgcgccaacaacctgagatacttcggccccgccgccgccctgagaagccccctgagcaaccacgcccagagacagctgcccggcagcagccccgacctgatcagcaccgccatggccgccgactgctggagaagcagcgagcccgacaagggccaggccggcccctggggctgctgccaggccgacgcctacgacccctgcctgcagtgcagacccgagcagtacggcagcctggacatccccagcgccgagcccgtgggcagaagccccgacctgagcaagagccccgcccacaaccccctgctggagaacgcccagagcagcgagaagaccgaggagaacgagttcagcggctgcagaagcgagagcagcctgggcaccagccacctgggcaccccccccgccctgcccagaaagaccagacccctgcagaagagcggcgacgacagcagcgaggaggaggagggcgaggtggacagcgaggtggagttccccagaagacagagaccccacagatgcatcagcagctgccagagctacagcaccttcagcagcgagaacttcagcgtgagcgacggcgaggagggcaacaccagcgaccacagcaacagccccgacgagctggccgacaagctggaggacagactggccgagaagctggacgacctgctgagccagacccccgagatccccatcgacatcagcagccacagcgacggcctgagcgacaaggagtgcgccgtgagaagagtgaagacccagatgagcctgggcaagctgtgcgtggaggagagaggctacgagaaccccatgcagttcgaggagagcgactgcgacagcagcgacggcgagtgcagcgacgccaccgtgagaaccaacaagcactacagcagcgccacctggtag

SEQ ID NO: 89371 - DNA, 2841 bp, Artificial Sequence
  Description of Artificial Sequence: Synthetic coding sequence
atggccgtgatggagatggcctgccccggcgcccccggcagcgccgtgggccagcagaaggagctgcccaaggccaaggagaagaccccccccctgggcaagaagcagagcagcgtgtacaagctggaggccgtggagaagagccccgtgttctgcggcaagtgggagatcctgaacgacgtgatcaccaagggcaccgccaaggagggcagcgaggccggccccgccgccatcagcatcatcgcccaggccgagtgcgagaacagccaggagttcagccccaccttcagcgagagaatcttcatcgccggcagcaagcagtacagccagagcgagagcctggaccagatccccaacaacgtggcccacgccaccgagggcaagatggccagagtgtgctggaagggcaagagaagaagcaaggccagaaagaagagaaagaagaagagcagcaagagcctggcccacgccggcgtggccctggccaagcccctgcccagaacccccgagcaggagagctgcaccatccccgtgcaggaggacgagagccccctgggcgccccctacgtgagaaacaccccccagttcaccaagcccctgaaggagcccggcctgggccagctgtgcttcaagcagctgggcgagggcctgagagccctgcccagaagcgagctgcacaagctgatcagccccctgcagtgcctgaaccacgtgtggaagctgcaccacccccaggacggcggccccctgcccctgcccacccaccccttcccctacagcagactgccccaccccttccccttccaccccctgcagccctggaagccccaccccctggagagcttcctgggcaagctggcctgcgtggacagccagaagcccctgcccgacccccacctgagcaagctggcctgcgtggacagccccaagcccctgcccggcccccacctggagcccagctgcctgagcagaggcgcccacgagaagttcagcgtggaggagtacctggtgcacgccctgcagggcagcgtgagcagcggccaggcccacagcctgaccagcctggccaagacctgggccgccagaggcagcagaagcagagagcccagccccaagaccgaggacaacgagggcgtgctgctgaccgagaagctgaagcccgtggactacgagtacagagaggaggtgcactgggccacccaccagctgagactgggcagaggcagcttcggcgaggtgcacagaatggaggacaagcagaccggcttccagtgcgccgtgaagaaggtgagactggaggtgttcagagccgaggagctgatggcctgcgccggcctgaccagccccagaatcgtgcccctgtacggcgccgtgagagagggcccctgggtgaacatcttcatggagctgctggagggcggcagcctgggccagctggtgaaggagcagggctgcctgcccgaggacagagccctgtactacctgggccaggccctggagggcctggagtacctgcacagcagaagaatcctgcacggcgacgtgaaggccgacaacgtgctgctgagcagcgacggcagccacgccgccctgtgcgacttcggccacgccgtgtgcctgcagcccgacggcctgggcaagagcctgctgaccggcgactacatccccggcaccgagacccacatggcccccgaggtggtgctgggcagaagctgcgacgccaaggtggacgtgtggagcagctgctgcatgatgctgcacatgctgaacggctgccacccctggacccagttcttcagaggccccctgtgcctgaagatcgccagcgagcccccccccgtgagagagatcccccccagctgcgcccccctgaccgcccaggccatccaggagggcctgagaaaggagcccatccacagagtgagcgccgccgagctgggcggcaaggtgaacagagccctgcagcaggtgggcggcctgaagagcccctggagaggcgagtacaaggagcccagacaccccccccccaaccaggccaactaccaccagaccctgcacgcccagcccagagagctgagccccagagcccccggccccagacccgccgaggagaccaccggcagagcccccaagctgcagccccccctgccccccgagccccccgagcccaacaagagcccccccctgaccctgagcaaggaggagagcggcatgtgggagcccctgcccctgagcagcctggagcccgcccccgccagaaaccccagcagccccgagagaaaggccaccgtgcccgagcaggagctgcagcagctggagatcgagctgttcctgaacagcctgagccagcccttcagcctggaggagcaggagcagatcctgagctgcctgagcatcgacagcctgagcctgagcgacgacagcgagaagaaccccagcaaggccagccagagcagcagagacaccctgagcagcggcgtgcacagctggagcagccaggccgaggccagaagcagcagctggaacatggtgctggccagaggcagacccaccgacacccccagctacttcaacggcgtgaaggtgcagatccagagcctgaacggcgagcacctgcacatcagagagttccacagagtgaaggtgggcgacatcgccaccggcatcagcagccagatccccgccgccgccttcagcctggtgaccaaggacggccagcccgtgagatacgacatggaggtgcccgacagcggcatcgacctgcagtgcaccctggcccccgacggcagcttcgcctggagctggagagtgaagcacggccagctggagaacagaccctag

SEQ ID NO: 89372 - DNA, 1302 bp, Artificial Sequence
  Description of Artificial Sequence: Synthetic coding sequence
tgcttcaagcagctgggcgagggcctgagagccctgcccagaagcgagctgcacaagctgatcagccccctgcagtgcctgaaccacgtgtggaagctgcaccacccccaggacggcggccccctgcccctgcccacccaccaccccttccccttccaccccctgcagccctggaagccccaccccctggagagcttcctgggcaagctggcctgcgtggacagccagaagcccctgcccgacccccacctgagcaagctggcctgcgtggacagccccaagcccctgcccggcccccacctggagcccagctgcctgagcagaggcgcccacgagaagttcagcgtggaggagtacctggtgcacgccctgcagggcagcgtgagcagcggccaggcccacagcctgaccagcctggccaagacctgggccgccagaggcagcagaagcagagagcccagccccaagaccgaggacaacgagggcgtgctgctgaccgagaagctgaagcccgtggactacgagtacagagaggaggtgcactgggccacccaccagctgagactgggcagaggcagcttcggcgaggtgcacagaatggaggacaagcagaccggcttccagtgcgccgtgaagaaggtgagactggaggtgttcagagccgaggagctgatggcctgcgccggcctgaccagccccagaatcgtgcccctgtacggcgccgtgagagagggcccctgggtgaacatcttcatggagctgctggagggcggcagcctgggccagctggtgaaggagcagggctgcctgcccgaggacagagccctgtactacctgggccaggccctggagggcctggagtacctgcacagcagaagaatcctgcacggcgacgtgaaggccgacaacgtgctgctgagcagcgacggcagccacgccgccctgtgcgacttcggccacgccgtgtgcctgcagcccgacggcctgggcaagagcctgctgaccggcgactacatccccggcaccgagacccacatggcccccgaggtggtgctgggcagaagctgcgacgccaaggtggacgtgtggagcagctgctgcatgatgctgcacatgctgaacggctgccacccctggacccagttcttcagaggccccctgtgcctgaaggtgggcgacggcacccagcacggccagcagggcgagctgcagggccccggcgcccaggccgccggctggagaggctgcagcgccgtggccgacggcgccagaggcggcctggtgatccacgtgggcagctag

SEQ ID NO: 89373 - DNA, 3942 bp, Artificial Sequence
  Description of Artificial Sequence: Synthetic coding sequence
atggagagcggcggcggcaacgcccccgccggcgccctgggcgccgccagcgagagcccccagtgcccccccccccccggcgtggagggcgccgccggccccgccgagcccgacggcgccgccgagggcgccgccggcggcagcggcgagggcgagagcggcggcggccccagaagagccctgagagccgtgtacgtgagaagcgagagcagccagggcggcgccgccggcggccccgaggccggcgccagacagtgcctgctgagagcctgcgaggccgagggcgcccacctgaccagcgtgcccttcggcgagctggacttcggcgagaccgccgtgctggacgccttctacgacgccgacgtggccgtggtggacatgagcgacgtgagcagacagcccagcctgttctaccacctgggcgtgagagagagcttcgacatggccaacaacgtgatcctgtaccacgacaccgacgccgacaccgccctgagcctgaaggacatggtgacccagaagaacaccgccagcagcggcaactactacttcatcccctacatcgtgaccccctgcgccgactacttctgctgcgagagcgacgcccagagaagagccagcgagtacatgcagcccaactgggacaacatcctgggccccctgtgcatgcccctggtggacagattcatcagcctgctgaaggacatccacgtgaccagctgcgtgtactacaaggagaccctgctgaacgacatcagaaaggccagagagaagtaccagggcgaggagctggccaaggagctggccagaatcaagctgagaatggacaacaccgaggtgctgaccagcgacatcatcatcaacctgctgctgagctacagagacatccaggactacgacgccatggtgaagctggtggagaccctggagatgctgcccacctgcgacctggccgaccagcacaacatcaagttccactacgccttcgccctgaacagaagaaacagcaccggcgacagagagaaggccctgcagatcatgctgcaggtgctgcagagctgcgaccaccccggccccgacatgttctgcctgtgcggcagaatctacaaggacatcttcctggacagcgactgcaaggacgacaccagcagagacagcgccatcgagtggtacagaaagggcttcgagctgcagagcagcctgtacagcggcatcaacctggccgtgctgctgatcgtggccggccagcagttcgagaccagcctggagctgagaaagatcggcgtgagactgaacagcctgctgggcagaaagggcagcctggagaagatgaacaactactgggacgtgggccagttcttcagcgtgagcatgctggcccacgacgtgggcaaggccgtgcaggccgccgagagactgttcaagctgaagccccccgtgtggtacctgagaagcctggtgcagaacctgctgctgatcagaagattcaagaagaccatcatcgagcacagccccagacaggagagactgaacttctggctggacatcatcttcgaggccaccaacgaggtgaccaacggcctgagattccccgtgctggtgatcgagcccaccaaggtgtaccagcccagctacgtgagcatcaacaacgaggccgaggagagaaccgtgagcctgtggcacgtgagccccaccgagatgaagcagatgcacgagtggaacttcaccgccagcagcatcaagggcatcagcctgagcaagttcgacgagagatgctgcttcctgtacgtgcacgacaacagcgacgacttccagatctacttcagcaccgaggagcagtgcagcagattcttcagcctggtgaaggagatgatcaccaacaccgccggcagcaccgtggagctggagggcgagaccgacggcgacaccctggagtacgagtacgaccacgacgccaacggcgagagagtggtgctgggcaagggcacctacggcatcgtgtacgccggcagagacctgagcaaccaggtgagaatcgccatcaaggagatccccgagagagacagcagatacagccagcccctgcacgaggagatcgccctgcacaagtacctgaagcacagaaacatcgtgcagtacctgggcagcgtgagcgagaacggctacatcaagatcttcatggagcaggtgcccggcggcagcctgagcgccctgctgagaagcaagtggggccccatgaaggagcccaccatcaagttctacaccaagcagatcctggagggcctgaagtacctgcacgagaaccagatcgtgcacagagacatcaagggcgacaacgtgctggtgaacacctacagcggcgtggtgaagatcagcgacttcggcaccagcaagagactggccggcgtgaacccctgcaccgagaccttcaccggcaccctgcagtacatggcccccgagatcatcgaccagggccccagaggctacggcgcccccgccgacatctggagcctgggctgcaccatcatcgagatggccaccagcaagccccccttccacgagctgggcgagccccaggccgccatgttcaaggtgggcatgttcaagatccaccccgagatccccgaggccctgagcgccgaggccagagccttcatcctgagctgcttcgagcccgacccccacaagagagccaccaccgccgagctgctgagagagggcttcctgagacaggtgaacaagggcaagaagaacagaatcgccttcaagcccagcgagggccccagaggcgtggtgctggccctgcccacccagggcgagcccatggccaccagcagcagcgagcacggcagcgtgagccccgacagcgacgcccagcccgacgccctgttcgagagaaccagagcccccagacaccacctgggccacctgctgagcgtgcccgacgagagcagcgccctggaggacagaggcctggccagcagccccgaggacagagaccagggcctgttcctgctgagaaaggacagcgagagaagagccatcctgtacaagatcctgtgggaggagcagaaccaggtggccagcaacctgcaggagtgcgtggcccagagcagcgaggagctgcacctgagcgtgggccacatcaagcagatcatcggcatcctgagagacttcatcagaagccccgagcacagagtgatggccaccaccatcagcaagctgaaggtggacctggacttcgacagcagcagcatcagccagatccacctggtgctgttcggcttccaggacgccgtgaacaagatcctgagaaaccacctgatcagaccccactggatgttcgccatggacaacatcatcagaagagccgtgcaggccgccgtgaccatcctgatccccgagctgagagcccacttcgagcccacctgcgagaccgagggcgtggacaaggacatggacgaggccgaggagggctacccccccgccaccggccccggccaggaggcccagccccaccagcagcacctgagcctgcagctgggcgagctgagacaggagaccaacagactgctggagcacctggtggagaaggagagagagtaccagaacctgctgagacagaccctggagcagaagacccaggagctgtaccacctgcagctgaagctgaagagcaactgcatcaccgagaaccccgccggcccctacggccagagaaccgacaaggagctgatcgactggctgagactgcagggcgccgacgccaagaccatcgagaagatcgtggaggagggctacaccctgagcgacatcctgaacgagatcaccaaggaggacctgagatacctgagactgagaggcggcctgctgtgcagactgtggagcgccgtgagccagtacagaagagcccaggaggccagcgagaccaaggacaaggcctag

SEQ ID NO: 89374 - DNA, 4677 bp, Artificial Sequence
  Description of Artificial Sequence: Synthetic coding sequence
atgagagaggccgccgccgccctggtgcccccccccgccttcgccgtgacccccgccgccgccatggaggagccccccccccccccccccccccccccccccccccccgagcccgagaccgagagcgagcccgagtgctgcctggccgccagacaggagggcaccctgggcgacagcgcctgcaagagccccgagagcgacctggaggacttcagcgacgagaccaacaccgagaacctgtacggcaccagcccccccagcacccccagacagatgaagagaatgagcaccaagcaccagagaaacaacgtgggcagacccgccagcagaagcaacctgaaggagaagatgaacgcccccaaccagcccccccacaaggacaccggcaagaccgtggagaacgtggaggagtacagctacaagcaggagaagaagatcagagccgccctgagaaccaccgagagagacagaaagaagaacgtgcagtgcagcttcatgctggacagcgtgggcggcagcctgcccaagaagagcatccccgacgtggacctgaacaagccctacctgagcctgggctgcagcaacgccaagctgcccgtgagcgtgcccatgcccatcgccagacccgccagacagaccagcagaaccgactgccccgccgacagactgaagttcttcgagaccctgagactgctgctgaagctgaccagcgtgagcaagaagaaggacagagagcagagaggccaggagaacaccagcggcttctggctgaacagaagcaacgagctgatctggctggagctgcaggcctggcacgccggcagaaccatcaacgaccaggacttcttcctgtacaccgccagacaggccatccccgacatcatcaacgagatcctgaccttcaaggtggactacggcagcttcgccttcgtgagagacagagccggcttcaacggcaccagcgtggagggccagtgcaaggccacccccggcaccaagatcgtgggctacagcacccaccacgagcacctgcagagacagagagtgagcttcgagcaggtgaagagaatcatggagctgctggagtacatcgaggccctgtaccccagcctgcaggccctgcagaaggactacgagaagtacgccgccaaggacttccaggacagagtgcaggccctgtgcctgtggctgaacatcaccaaggacctgaaccagaagctgagaatcatgggcaccgtgctgggcatcaagaacctgagcgacatcggctggcccgtgttcgagatccccagccccagacccagcaagggcaacgagcccgagtacgagggcgacgacaccgagggcgagctgaaggagctggagagcagcaccgacgagagcgaggaggagcagatcagcgaccccagagtgcccgagatcagacagcccatcgacaacagcttcgacatccagagcagagactgcatcagcaagaagctggagagactggagagcgaggacgacagcctgggctggggcgcccccgactggagcaccgaggccggcttcagcagacactgcctgaccagcatctacagacccttcgtggacaaggccctgaagcagatgggcctgagaaagctgatcctgagactgcacaagctgatggacggcagcctgcagagagccagaatcgccctggtgaagaacgacagacccgtggagttcagcgagttccccgaccccatgtggggcagcgactacgtgcagctgagcagaaccccccccagcagcgaggagaagtgcagcgccgtgagctgggaggagctgaaggccatggacctgcccagcttcgagcccgccttcctggtgctgtgcagagtgctgctgaacgtgatccacgagtgcctgaagctgagactggagcagagacccgccggcgagcccagcctgctgagcatcaagcagctggtgagagagtgcaaggaggtgctgaagggcggcctgctgatgaagcagtactaccagttcatgctgcaggaggtgctggaggacctggagaagcccgactgcaacatcgacgccttcgaggaggacctgcacaagatgctgatggtgtacttcgactacatgagaagctggatccagatgctgcagcagctgccccaggccagccacagcctgaagaacctgctggaggaggagtggaacttcaccaaggagatcacccactacatcagaggcggcgaggcccaggccggcaagctgttctgcgacatcgccggcatgctgctgaagagcaccggcagcttcctggagttcggcctgcaggagagctgcgccgagttctggaccagcgccgacgacagcagcgccagcgacgagatcagaagaagcgtgatcgagatcagcagagccctgaaggagctgttccacgaggccagagagagagccagcaaggccctgggcttcgccaagatgctgagaaaggacctggagatcgccgccgagttcagactgagcgcccccgtgagagacctgctggacgtgctgaagagcaagcagtacgtgaaggtgcagatccccggcctggagaacctgcagatgttcgtgcccgacaccctggccgaggagaagagcatcatcctgcagctgctgaacgccgccgccggcaaggactgcagcaaggacagcgacgacgtgctgatcgacgcctacctgctgctgaccaagcacggcgacagagccagagacagcgaggacagctggggcacctgggaggcccagcccgtgaaggtggtgccccaggtggagaccgtggacaccctgagaagcatgcaggtggacaacctgctgctggtggtgatgcagagcgcccacctgaccatccagagaaaggccttccagcagagcatcgagggcctgatgaccctgtgccaggagcagaccagcagccagcccgtgatcgccaaggccctgcagcagctgaagaacgacgccctggagctgtgcaacagaatcagcaacgccatcgacagagtggaccacatgttcaccagcgagttcgacgccgaggtggacgagagcgagagcgtgaccctgcagcagtactacagagaggccatgatccagggctacaacttcggcttcgagtaccacaaggaggtggtgagactgatgagcggcgagttcagacagaagatcggcgacaagtacatcagcttcgccagaaagtggatgaactacgtgctgaccaagtgcgagagcggcagaggcaccagacccagatgggccacccagggcttcgacttcctgcaggccatcgagcccgccttcatcagcgccctgcccgaggacgacttcctgagcctgcaggccctgatgaacgagtgcatcggccacgtgatcggcaagccccacagccccgtgaccggcctgtacctggccatccacagaaacagccccagacccatgaaggtgcccagatgccacagcgacccccccaacccccacctgatcatccccacccccgagggcttcagaggcagcagcgtgcccgagaacgacagactggccagcatcgccgccgagctgcagttcagaagcctgagcagacacagcagccccaccgaggagagagacgagcccgcctaccccagaggcgacagcagcggcagcaccagaagaagctgggagctgagaaccctgatcagccagagcaaggacaccgccagcaagctgggccccatcgaggccatccagaagagcgtgagactgttcgaggagaagagatacagagagatgagaagaaagaacatcatcggccaggtgtgcgacacccccaagagctacgacaacgtgatgcacgtgggcctgagaaaggtgaccttcaagtggcagagaggcaacaagatcggcgagggccagtacggcaaggtgtacacctgcatcagcgtggacaccggcgagctgatggccatgaaggagatcagattccagcccaacgaccacaagaccatcaaggagaccgccgacgagctgaagatcttcgagggcatcaagcaccccaacctggtgagatacttcggcgtggagctgcacagagaggagatgtacatcttcatggagtactgcgacgagggcaccctggaggaggtgagcagactgggcctgcaggagcacgtgatcagactgtacagcaagcagatcaccatcgccatcaacgtgctgcacgagcacggcatcgtgcacagagacatcaagggcgccaacatcttcctgaccagcagcggcctgatcaagctgggcgacttcggctgcagcgtgaagctgaagaacaacgcccagaccatgcccggcgaggtgaacagcaccctgggcaccgccgcctacatggcccccgaggtgatcaccagagccaagggcgagggccacggcagagccgccgacatctggagcctgggctgcgtggtgatcgagatggtgaccggcaagagaccctggcacgagtacgagcacaacttccagatcatgtacaaggtgggcatgggccacaagccccccatccccgagagactgagccccgagggcaaggacttcctgagccactgcctggagagcgaccccaagatgagatggaccgccagccagctgctggaccacagcttcgtgaaggtgtgcaccgacgaggagtag

SEQ ID NO: 89375 - DNA, 4827 bp, Artificial Sequence
  Description of Artificial Sequence: Synthetic coding sequence
atgagagaggccgccgccgccctggtgcccccccccgccttcgccgtgacccccgccgccgccatggaggagccccccccccccccccccccccccccccccccccccgagcccgagaccgagagcgagcccgagtgctgcctggccgccagacaggagggcaccctgggcgacagcgcctgcaagagccccgagagcgacctggaggacttcagcgacgagaccaacaccgagaacctgtacggcaccagcccccccagcacccccagacagatgaagagaatgagcaccaagcaccagagaaacaacgtgggcagacccgccagcagaagcaacctgaaggagaagatgaacgcccccaaccagcccccccacaaggacaccggcaagaccgtggagaacgtggaggagtacagctacaagcaggagaagaagatcagagccgccctgagaaccaccgagagagacagaaagaagaacgtgcagtgcagcttcatgctggacagcgtgggcggcagcctgcccaagaagagcatccccgacgtggacctgaacaagccctacctgagcctgggctgcagcaacgccaagctgcccgtgagcgtgcccatgcccatcgccagacccgccagacagaccagcagaaccgactgccccgccgacagactgaagttcttcgagaccctgagactgctgctgaagctgaccagcgtgagcaagaagaaggacagagagcagagaggccaggagaacaccagcggcttctggctgaacagaagcaacgagctgatctggctggagctgcaggcctggcacgccggcagaaccatcaacgaccaggacttcttcctgtacaccgccagacaggccatccccgacatcatcaacgagatcctgaccttcaaggtggactacggcagcttcgccttcgtgagagacagagccggcttcaacggcaccagcgtggagggccagtgcaaggccacccccggcaccaagatcgtgggctacagcacccaccacgagcacctgcagagacagagagtgagcttcgagcaggtgaagagaatcatggagctgctggagtacatcgaggccctgtaccccagcctgcaggccctgcagaaggactacgagaagtacgccgccaaggacttccaggacagagtgcaggccctgtgcctgtggctgaacatcaccaaggacctgaaccagaagctgagaatcatgggcaccgtgctgggcatcaagaacctgagcgacatcggctggcccgtgttcgagatccccagccccagacccagcaagggcaacgagcccgagtacgagggcgacgacaccgagggcgagctgaaggagctggagagcagcaccgacgagagcgaggaggagcagatcagcgaccccagagtgcccgagatcagacagcccatcgacaacagcttcgacatccagagcagagactgcatcagcaagaagctggagagactggagagcgaggacgacagcctgggctggggcgcccccgactggagcaccgaggccggcttcagcagacactgcctgaccagcatctacagacccttcgtggacaaggccctgaagcagatgggcctgagaaagctgatcctgagactgcacaagctgatggacggcagcctgcagagagccagaatcgccctggtgaagaacgacagacccgtggagttcagcgagttccccgaccccatgtggggcagcgactacgtgcagctgagcagaaccccccccagcagcgaggagaagtgcagcgccgtgagctgggaggagctgaaggccatggacctgcccagcttcgagcccgccttcctggtgctgtgcagagtgctgctgaacgtgatccacgagtgcctgaagctgagactggagcagagacccgccggcgagcccagcctgctgagcatcaagcagctggtgagagagtgcaaggaggtgctgaagggcggcctgctgatgaagcagtactaccagttcatgctgcaggaggtgctggaggacctggagaagcccgactgcaacatcgacgccttcgaggaggacctgcacaagatgctgatggtgtacttcgactacatgagaagctggatccagatgctgcagcagctgccccaggccagccacagcctgaagaacctgctggaggaggagtggaacttcaccaaggagatcacccactacatcagaggcggcgaggcccaggccggcaagctgttctgcgacatcgccggcatgctgctgaagagcaccggcagcttcctggagttcggcctgcaggagagctgcgccgagttctggaccagcgccgacgacagcagcgccagcgacgagatcagaagaagcgtgatcgagatcagcagagccctgaaggagctgttccacgaggccagagagagagccagcaaggccctgggcttcgccaagatgctgagaaaggacctggagatcgccgccgagttcagactgagcgcccccgtgagagacctgctggacgtgctgaagagcaagcagtacgtgaaggtgcagatccccggcctggagaacctgcagatgttcgtgcccgacaccctggccgaggagaagagcatcatcctgcagctgctgaacgccgccgccggcaaggactgcagcaaggacagcgacgacgtgctgatcgacgcctacctgctgctgaccaagcacggcgacagagccagagacagcgaggacagctggggcacctgggaggcccagcccgtgaaggtggtgccccaggtggagaccgtggacaccctgagaagcatgcaggtggacaacctgctgctggtggtgatgcagagcgcccacctgaccatccagagaaaggccttccagcagagcatcgagggcctgatgaccctgtgccaggagcagaccagcagccagcccgtgatcgccaaggccctgcagcagctgaagaacgacgccctggagctgtgcaacagaatcagcaacgccatcgacagagtggaccacatgttcaccagcgagttcgacgccgaggtggacgagagcgagagcgtgaccctgcagcagtactacagagaggccatgatccagggctacaacttcggcttcgagtaccacaaggaggtggtgagactgatgagcggcgagttcagacagaagatcggcgacaagtacatcagcttcgccagaaagtggatgaactacgtgctgaccaagtgcgagagcggcagaggcaccagacccagatgggccacccagggcttcgacttcctgcaggccatcgagcccgccttcatcagcgccctgcccgaggacgacttcctgagcctgcaggccctgatgaacgagtgcatcggccacgtgatcggcaagccccacagccccgtgaccggcctgtacctggccatccacagaaacagccccagacccatgaaggtgcccagatgccacagcgacccccccaacccccacctgatcatccccacccccgagggcttcagcaccagaagcatgcccagcgacgccagaagccacggcagccccgccgccgccgccgccgccgccgccgccgccgtggccgccagcagacccagccccagcggcggcgacagcgtgctgcccaagagcatcagcagcgcccacgacaccagaggcagcagcgtgcccgagaacgacagactggccagcatcgccgccgagctgcagttcagaagcctgagcagacacagcagccccaccgaggagagagacgagcccgcctaccccagaggcgacagcagcggcagcaccagaagaagctgggagctgagaaccctgatcagccagagcaaggacaccgccagcaagctgggccccatcgaggccatccagaagagcgtgagactgttcgaggagaagagatacagagagatgagaagaaagaacatcatcggccaggtgtgcgacacccccaagagctacgacaacgtgatgcacgtgggcctgagaaaggtgaccttcaagtggcagagaggcaacaagatcggcgagggccagtacggcaaggtgtacacctgcatcagcgtggacaccggcgagctgatggccatgaaggagatcagattccagcccaacgaccacaagaccatcaaggagaccgccgacgagctgaagatcttcgagggcatcaagcaccccaacctggtgagatacttcggcgtggagctgcacagagaggagatgtacatcttcatggagtactgcgacgagggcaccctggaggaggtgagcagactgggcctgcaggagcacgtgatcagactgtacagcaagcagatcaccatcgccatcaacgtgctgcacgagcacggcatcgtgcacagagacatcaagggcgccaacatcttcctgaccagcagcggcctgatcaagctgggcgacttcggctgcagcgtgaagctgaagaacaacgcccagaccatgcccggcgaggtgaacagcaccctgggcaccgccgcctacatggcccccgaggtgatcaccagagccaagggcgagggccacggcagagccgccgacatctggagcctgggctgcgtggtgatcgagatggtgaccggcaagagaccctggcacgagtacgagcacaacttccagatcatgtacaaggtgggcatgggccacaagccccccatccccgagagactgagccccgagggcaaggacttcctgagccactgcctggagagcgaccccaagatgagatggaccgccagccagctgctggaccacagcttcgtgaaggtgtgcaccgacgaggagtag

SEQ ID NO: 89376 - DNA, 4497 bp, Artificial Sequence
  Description of Artificial Sequence: Synthetic coding sequence
atgagagaggccgccgccgccctggtgcccccccccgccttcgccgtgacccccgccgccgccatggaggagccccccccccccccccccccccccccccccccccccgagcccgagaccgagagcgagcccgagtgctgcctggccgccagacaggagggcaccctgggcgacagcgcctgcaagagccccgagagcgacctggaggacttcagcgacgagaccaacaccgagaacctgtacggcaccagcccccccagcacccccagacagatgaagagaatgagcaccaagcaccagagaaacaacgtgggcagacccgccagcagaagcaacctgaaggagaagatgaacgcccccaaccagcccccccacaaggacaccggcaagaccgtggagaacgtggaggagtacagctacaagcaggagaagaagatcagagccgccctgagaaccaccgagagagacagaaagaagaacgtgcagtgcagcttcatgctggacagcgtgggcggcagcctgcccaagaagagcatccccgacgtggacctgaacaagccctacctgagcctgggctgcagcaacgccaagctgcccgtgagcgtgcccatgcccatcgccagacccgccagacagaccagcagaaccgactgccccgccgacagactgaagttcttcgagaccctgagactgctgctgaagctgaccagcgtgagcaagaagaaggacagagagcagagaggccaggagaacaccagcggcttctggctgaacagaagcaacgagctgatctggctggagctgcaggcctggcacgccggcagaaccatcaacgaccaggacttcttcctgtacaccgccagacaggccatccccgacatcatcaacgagatcctgaccttcaaggtggactacggcagcttcgccttcgtgagagacagagccggcttcaacggcaccagcgtggagggccagtgcaaggccacccccggcaccaagatcgtgggctacagcacccaccacgagcacctgcagagacagagagtgagcttcgagcaggtgaagagaatcatggagctgctggagtacatcgaggccctgtaccccagcctgcaggccctgcagaaggactacgagaagtacgccgccaaggacttccaggacagagtgcaggccctgtgcctgtggctgaacatcaccaaggacctgaaccagaagctgagaatcatgggcaccgtgctgggcatcaagaacctgagcgacatcggctggcccgtgttcgagatccccagccccagacccagcaagggcaacgagcccgagtacgagggcgacgacaccgagggcgagctgaaggagctggagagcagcaccgacgagagcgaggaggagcagatcagcgaccccagagtgcccgagatcagacagcccatcgacaacagcttcgacatccagagcagagactgcatcagcaagaagctggagagactggagagcgaggacgacagcctgggctggggcgcccccgactggagcaccgaggccggcttcagcagacactgcctgaccagcatctacagacccttcgtggacaaggccctgaagcagatgggcctgagaaagctgatcctgagactgcacaagctgatggacggcagcctgcagagagccagaatcgccctggtgaagaacgacagacccgtggagttcagcgagttccccgaccccatgtggggcagcgactacgtgcagctgagcagaaccccccccagcagcgaggagaagtgcagcgccgtgagctgggaggagctgaaggccatggacctgcccagcttcgagcccgccttcctggtgctgtgcagagtgctgctgaacgtgatccacgagtgcctgaagctgagactggagcagagacccgccggcgagcccagcctgctgagcatcaagcagctggtgagagagtgcaaggaggtgctgaagggcggcctgctgatgaagcagtactaccagttcatgctgcaggaggtgctggaggacctggagaagcccgactgcaacatcgacgccttcgaggaggacctgcacaagatgctgatggtgtacttcgactacatgagaagctggatccagatgctgcagcagctgccccaggccagccacagcctgaagaacctgctggaggaggagtggaacttcaccaaggagatcacccactacatcagaggcggcgaggcccaggccggcaagctgttctgcgacatcgccggcatgctgctgaagagcaccggcagcttcctggagttcggcctgcaggagagctgcgccgagttctggaccagcgccgacgacagcagcgccagcgacgagatcagaagaagcgtgatcgagatcagcagagccctgaaggagctgttccacgaggccagagagagagccagcaaggccctgggcttcgccaagatgctgagaaaggacctggagatcgccgccgagttcagactgagcgcccccgtgagagacctgctggacgtgctgaagagcaagcagtacgtgaaggtgcagatccccggcctggagaacctgcagatgttcgtgcccgacaccctggccgaggagaagagcatcatcctgcagctgctgaacgccgccgccggcaaggactgcagcaaggacagcgacgacgtgctgatcgacgcctacctgctgctgaccaagcacggcgacagagccagagacagcgaggacagctggggcacctgggaggcccagcccgtgaaggtggtgccccaggtggagaccgtggacaccctgagaagcatgcaggtggacaacctgctgctggtggtgatgcagagcgcccacctgaccatccagagaaaggccttccagcagagcatcgagggcctgatgaccctgtgccaggagcagaccagcagccagcccgtgatcgccaaggccctgcagcagctgaagaacgacgccctggagctgtgcaacagaatcagcaacgccatcgacagagtggaccacatgttcaccagcgagttcgacgccgaggtggacgagagcgagagcgtgaccctgcagcagtactacagagaggccatgatccagggctacaacttcggcttcgagtaccacaaggaggtggtgagactgatgagcggcgagttcagacagaagatcggcgacaagtacatcagcttcgccagaaagtggatgaactacgtgctgaccaagtgcgagagcggcagaggcaccagacccagatgggccacccagggcttcgacttcctgcaggccatcgagcccgccttcatcagcgccctgcccgaggacgacttcctgagcctgcaggccctgatgaacgagtgcatcggccacgtgatcggcaagccccacagccccgtgaccggcctgtacctggccatccacagaaacagccccagacccatgaaggtgcccagatgccacagcgacccccccaacccccacctgatcatccccacccccgagggcttcagaggcagcagcgtgcccgagaacgacagactggccagcatcgccgccgagctgcagttcagaagcctgagcagacacagcagccccaccgaggagagagacgagcccgcctaccccagaggcgacagcagcggcagcaccagaagaagctgggagctgagaaccctgatcagccagagcaaggacaccgccagcaagctgggccccatcgaggccatccagaagagcgtgagactgttcgaggagaagagatacagagagatgagaagaaagaacatcatcggccaggtgtgcgacacccccaagagctacgacaacgtgatgcacgtgggcctgagaaaggtgaccttcaagtggcagagaggcaacaagatcggcgagggccagtacggcaaggtgtacacctgcatcagcgtggacaccggcgagctgatggccatgaaggagatcagattccagcccaacgaccacaagaccatcaaggagaccgccgacgagctgaagatcttcgagggcatcaagcaccccaacctggtgagatacttcggcgtggagctgcacagagaggagatgtacatcttcatggagtactgcgacgagggcaccctggaggaggtgagcagactgggcctgcaggagcacgtgatcagactgtacagcaagcagatcaccatcgccatcaacgtgctgcacgagcacggcatcgtgcacagagacatcaagggcgccaacatcttcctgaccagcagcggcctgatcaagctgggcgacttcggctgcagcgtgaagctgaagaacaacgcccagaccatgcccggcgaggtgaacagcaccctgggcaccgccgcctacatggcccccgaggtgatcaccagagccaagggcgagggccacggcagagccgccgacatctggagcctgggctgcgtggtgatcgagatggtgaccggcaagatctgcaaggacaccgagtag

SEQ ID NO: 89377 - DNA, 324 bp, Artificial Sequence
  Description of Artificial Sequence: Synthetic coding sequence
atggaggagccccccccccccccccccccccccccccccccccccgagcccgagaccgagagcgagcccgagtgctgcctggccgccagacaggagggcaccctgggcgacagcgcctgcaagagccccgagagcgacctggaggacttcagcgacgagaccaacaccgagaacctgtacggcaccagcccccccagcacccccagacagatgaagagaatgagcaccaagcaccagagaaacaacgtgggcagacccgccagcagaagcaacctgaagggcgtgagacagatcagccacgccgtgagcagcagcctgaactag

SEQ ID NO: 89378 - DNA, 1866 bp, Artificial Sequence
  Description of Artificial Sequence: Synthetic coding sequence
atggagcaggtgcccggcggcagcctgagcgccctgctgagaagcaagtggggccccctgaaggacaacgagcagaccatcggcttctacaccaagcagatcctggagggcctgaagtacctgcacgacaaccagatcgtgcacagagacatcaagggcgacaacgtgctgatcaacacctacagcggcgtgctgaagatcagcgacttcggcaccagcaagagactggccggcatcaacccctgcaccgagaccttcaccggcaccctgcagtacatggcccccgagatcatcgacaagggccccagaggctacggcaaggccgccgacatctggagcctgggctgcaccatcatcgagatggccaccggcaagccccccttctacgagctgggcgagccccaggccgccatgttcaaggtgggcatgttcaaggtgcaccccgagatccccgagagcatgagcgccgaggccaaggccttcatcctgaagtgcttcgagcccgaccccgacaagagagcctgcgccaacgacctgctggtggacgagttcctgaaggtgagcagcaagaagaagaagacccagcccaagctgagcgccctgagcgccggcagcaacgagtacctgagaagcatcagcctgcccgtgcccgtgctggtggaggacaccagcagcagcagcgagtacggcagcgtgagccccgacaccgagctgaaggtggaccccttcagcttcaagaccagagccaagagctgcggcgagagagacgtgaagggcatcagaaccctgttcctgggcatccccgacgagaacttcgaggaccacagcgccccccccagccccgaggagaaggacagcggcttcttcatgctgagaaaggacagcgagagaagagccaccctgcacagaatcctgaccgaggaccaggacaagatcgtgagaaacctgatggagagcctggcccagggcgccgaggagcccaagctgaagtgggagcacatcaccaccctgatcgccagcctgagagagttcgtgagaagcaccgacagaaagatcatcgccaccaccctgagcaagctgaagctggagctggacttcgacagccacggcatcagccaggtgcaggtggtgctgttcggcttccaggacgccgtgaacaaggtgctgagaaaccacaacatcaagccccactggatgttcgccctggacagcatcatcagaaaggccgtgcagaccgccatcaccatcctggtgcccgagctgagaccccacttcagcctggccagcgagagcgacaccgccgaccaggaggacctggacgtggaggacgaccacgaggagcagcccagcaaccagaccgtgagaagaccccaggccgtgatcgaggacgccgtggccaccagcggcgtgagcaccctgagcagcaccgtgagccacgacagccagagcgcccacagaagcctgaacgtgcagctgggcagaatgaagatcgagaccaacagactgctggaggagctggtgagaaaggagaaggagctgcaggccctgctgcacagagccatcgaggagaaggaccaggagatcaagcacctgaagctgaagagccagcccatcgagatccccgagctgcccgtgttccacctgaacagcagcggcaccaacaccgaggacagcgagctgaccgactggctgagagtgaacggcgccgacgaggacaccatcagcagattcctggccgaggactacaccctgctggacgtgctgtactacgtgaccagagacgacctgaagtgcctgagactgagaggcggcatgctgtgcaccctgtggaaggccatcatcgacttcagaaacaagcagacctag

SEQ ID NO: 89379 - DNA, 4125 bp, Artificial Sequence
  Description of Artificial Sequence: Synthetic coding sequence
atgagcaccgaggccgacgagggcatcaccttcagcgtgccccccttcgcccccagcggcttctgcaccatccccgagggcggcatctgcagaagaggcggcgccgccgccgtgggcgagggcgaggagcaccagctgcccccccccccccccggcagcttctggaacgtggagagcgccgccgcccccggcatcggctgccccgccgccaccagcagcagcagcgccaccagaggcagaggcagcagcgtgggcggcggcagcagaagaaccaccgtggcctacgtgatcaacgaggccagccagggccagctggtggtggccgagagcgaggccctgcagagcctgagagaggcctgcgagaccgtgggcgccaccctggagaccctgcacttcggcaagctggacttcggcgagaccaccgtgctggacagattctacaacgccgacatcgccgtggtggagatgagcgacgccttcagacagcccagcctgttctaccacctgggcgtgagagagagcttcagcatggccaacaacatcatcctgtactgcgacaccaacagcgacagcctgcagagcctgaaggagatcatctgccagaagaacaccatgtgcaccggcaactacaccttcgtgccctacatgatcaccccccacaacaaggtgtactgctgcgacagcagcttcatgaagggcctgaccgagctgatgcagcccaacttcgagctgctgctgggccccatctgcctgcccctggtggacagattcatccagctgctgaaggtggcccaggccagcagcagccagtacttcagagagagcatcctgaacgacatcagaaaggccagaaacctgtacaccggcaaggagctggccgccgagctggccagaatcagacagagagtggacaacatcgaggtgctgaccgccgacatcgtgatcaacctgctgctgagctacagagacatccaggactacgacagcatcgtgaagctggtggagaccctggagaagctgcccaccttcgacctggccagccaccaccacgtgaagttccactacgccttcgccctgaacagaagaaacctgcccggcgacagagccaaggccctggacatcatgatccccatggtgcagagcgagggccaggtggccagcgacatgtactgcctggtgggcagaatctacaaggacatgttcctggacagcaacttcaccgacaccgagagcagagaccacggcgccagctggttcaagaaggccttcgagagcgagcccaccctgcagagcggcatcaactacgccgtgctgctgctggccgccggccaccagttcgagagcagcttcgagctgagaaaggtgggcgtgaagctgagcagcctgctgggcaagaagggcaacctggagaagctgcagagctactgggaggtgggcttcttcctgggcgccagcgtgctggccaacgaccacatgagagtgatccaggccagcgagaagctgttcaagctgaagacccccgcctggtacctgaagagcatcgtggagaccatcctgatctacaagcacttcgtgaagctgaccaccgagcagcccgtggccaagcaggagctggtggacttctggatggacttcctggtggaggccaccaagaccgacgtgaccgtggtgagattccccgtgctgatcctggagcccaccaagatctaccagcccagctacctgagcatcaacaacgaggtggaggagaagaccatcagcatctggcacgtgctgcccgacgacaagaagggcatccacgagtggaacttcagcgccagcagcgtgagaggcgtgagcatcagcaagttcgaggagagatgctgcttcctgtacgtgctgcacaacagcgacgacttccagatctacttctgcaccgagctgcactgcaagaagttcttcgagatggtgaacaccatcaccgaggagaagggcagaagcaccgaggagggcgactgcgagagcgacctgctggagtacgactacgagtacgacgagaacggcgacagagtggtgctgggcaagggcacctacggcatcgtgtacgccggcagagacctgagcaaccaggtgagaatcgccatcaaggagatccccgagagagacagcagatacagccagcccctgcacgaggagatcgccctgcacaagcacctgaagcacaagaacatcgtgcagtacctgggcagcttcagcgagaacggcttcatcaagatcttcatggagcaggtgcccggcggcagcctgagcgccctgctgagaagcaagtggggccccctgaaggacaacgagcagaccatcggcttctacaccaagcagatcctggagggcctgaagtacctgcacgacaaccagatcgtgcacagagacatcaagggcgacaacgtgctgatcaacacctacagcggcgtgctgaagatcagcgacttcggcaccagcaagagactggccggcatcaacccctgcaccgagaccttcaccggcaccctgcagtacatggcccccgagatcatcgacaagggccccagaggctacggcaaggccgccgacatctggagcctgggctgcaccatcatcgagatggccaccggcaagccccccttctacgagctgggcgagccccaggccgccatgttcaaggtgggcatgttcaaggtgcaccccgagatccccgagagcatgagcgccgaggccaaggccttcatcctgaagtgcttcgagcccgaccccgacaagagagcctgcgccaacgacctgctggtggacgagttcctgaaggtgagcagcaagaagaagaagacccagcccaagctgagcgccctgagcgccggcagcaacgagtacctgagaagcatcagcctgcccgtgcccgtgctggtggaggacaccagcagcagcagcgagtacggcagcgtgagccccgacaccgagctgaaggtggaccccttcagcttcaagaccagagccaagagctgcggcgagagagacgtgaagggcatcagaaccctgttcctgggcatccccgacgagaacttcgaggaccacagcgccccccccagccccgaggagaaggacagcggcttcttcatgctgagaaaggacagcgagagaagagccaccctgcacagaatcctgaccgaggaccaggacaagatcgtgagaaacctgatggagagcctggcccagggcgccgaggagcccaagctgaagtgggagcacatcaccaccctgatcgccagcctgagagagttcgtgagaagcaccgacagaaagatcatcgccaccaccctgagcaagctgaagctggagctggacttcgacagccacggcatcagccaggtgcaggtggtgctgttcggcttccaggacgccgtgaacaaggtgctgagaaaccacaacatcaagccccactggatgttcgccctggacagcatcatcagaaaggccgtgcagaccgccatcaccatcctggtgcccgagctgagaccccacttcagcctggccagcgagagcgacaccgccgaccaggaggacctggacgtggaggacgaccacgaggagcagcccagcaaccagaccgtgagaagaccccaggccgtgatcgaggacgccgtggccaccagcggcgtgagcaccctgagcagcaccgtgagccacgacagccagagcgcccacagaagcctgaacgtgcagctgggcagaatgaagatcgagaccaacagactgctggaggagctggtgagaaaggagaaggagctgcaggccctgctgcacagagccatcgaggagaaggaccaggagatcaagcacctgaagctgaagagccagcccatcgagatccccgagctgcccgtgttccacctgaacagcagcggcaccaacaccgaggacagcgagctgaccgactggctgagagtgaacggcgccgacgaggacaccatcagcagattcctggccgaggactacaccctgctggacgtgctgtactacgtgaccagagacgacctgaagtgcctgagactgagaggcggcatgctgtgcaccctgtggaaggccatcatcgacttcagaaacaagcagacctag

SEQ ID NO: 89380 - DNA, 3771 bp, Artificial Sequence
  Description of Artificial Sequence: Synthetic coding sequence
accctgcagagagccagcggcgccgccaccgaggcccccagaagaagcgagcccccccccggcagcggcgtgcccagcggcgagagagcccccgagagaagaagaagaagaggcggcgagggcgccgccagagacggcagctgcctggccagaagagccagaagcagccccgagctgtggctggccagaagatgcggctgggccggcgacgccgccgccgtggccgccagacccggcgagatgagcaccgaggccgacgagggcatcaccttcagcgtgccccccttcgcccccagcggcttctgcaccatccccgagggcggcatctgcagaagaggcggcgccgccgccgtgggcgagggcgaggagcaccagctgcccccccccccccccggcagcttctggaacgtggagagcgccgccgcccccggcatcggctgccccgccgccaccagcagcagcagcgccaccagaggcagaggcagcagcgtgggcggcggcagcagaagaaccaccgtggcctacgtgatcaacgaggccagccagggccagctggtggtggccgagagcgaggccctgcagagcctgagagaggcctgcgagaccgtgggcgccaccctggagaccctgcacttcggcaagctggacttcggcgagaccaccgtgctggacagattctacaacgccgacatcgccgtggtggagatgagcgacgccttcagacagcccagcctgttctaccacctgggcgtgagagagagcttcagcatggccaacaacatcatcctgtactgcgacaccaacagcgacagcctgcagagcctgaaggagatcatctgccagaagaacaccatgtgcaccggcaactacaccttcgtgccctacatgatcaccccccacaacaaggtgtactgctgcgacagcagcttcatgaagggcctgaccgagctgatgcagcccaacttcgagctgctgctgggccccatctgcctgcccctggtggacagattcatccagctgctgaaggtggcccaggccagcagcagccagtacttcagagagagcatcctgaacgacatcagaaaggccagaaacctgtacaccggcaaggagctggccgccgagctggccagaatcagacagagagtggacaacatcgaggtgctgaccgccgacatcgtgatcaacctgctgctgagctacagagacatccaggactacgacagcatcgtgaagctggtggagaccctggagaagctgcccaccttcgacctggccagccaccaccacgtgaagttccactacgccttcgccctgaacagaagaaacctgcccggcgacagagccaaggccctggacatcatgatccccatggtgcagagcgagggccaggtggccagcgacatgtactgcctggtgggcagaatctacaaggacatgttcctggacagcaacttcaccgacaccgagagcagagaccacggcgccagctggttcaagaaggccttcgagagcgagcccaccctgcagagcggcatcaactacgccgtgctgctgctggccgccggccaccagttcgagagcagcttcgagctgagaaaggtgggcgtgaagctgagcagcctgctgggcaagaagggcaacctggagaagctgcagagctactgggaggtgggcttcttcctgggcgccagcgtgctggccaacgaccacatgagagtgatccaggccagcgagaagctgttcaagctgaagacccccgcctggtacctgaagagcatcgtggagaccatcctgatctacaagcacttcgtgaagctgaccaccgagcagcccgtggccaagcaggagctggtggacttctggatggacttcctggtggaggccaccaagaccgacgtgaccgtggtgagattccccgtgctgatcctggagcccaccaagatctaccagcccagctacctgagcatcaacaacgaggtggaggagaagaccatcagcatctggcacgtgctgcccgacgacaagaagggcatccacgagtggaacttcagcgccagcagcgtgagaggcgtgagcatcagcaagttcgaggagagatgctgcttcctgtacgtgctgcacaacagcgacgacttccagatctacttctgcaccgagctgcactgcaagaagttcttcgagatggtgaacaccatcaccgaggagaagggcagaagcaccgaggagggcgactgcgagagcgacctgctggagtacgactacgagtacgacgagaacggcgacagagtggtgctgggcaagggcacctacggcatcgtgtacgccggcagagacctgagcaaccaggtgagaatcgccatcaaggagatccccgagagagacagcagatacagccagcccctgcacgaggagatcgccctgcacaagcacctgaagcacaagaacatcgtgcagtacctgggcagcttcagcgagaacggcttcatcaagatcttcatggagcaggtgcccggcggcagcctgagcgccctgctgagaagcaagtggggccccctgaaggacaacgagcagaccatcggcttctacaccaagcagatcctggagggcctgaagtacctgcacgacaaccagatcgtgcacagagacatcaagggcgacaacgtgctgatcaacacctacagcggcgtgctgaagatcagcgacttcggcaccagcaagagactggccggcatcaacccctgcaccgagaccttcaccggcaccctgcagtacatggcccccgagatcatcgacaagggccccagaggctacggcaaggccgccgacatctggagcctgggctgcaccatcatcgagatggccaccggcaagccccccttctacgagctgggcgagccccaggccgccatgttcaaggtgggcatgttcaaggtgcaccccgagatccccgagagcatgagcgccgaggccaaggccttcatcctgaagtgcttcgagcccgaccccgacaagagagcctgcgccaacgacctgctggtggacgagttcctgaaggtgagcagcaagaagaagaagacccagcccaagctgagcgacctgagcatcgcccaggccgagtacctgagaagcatcagcctgcccgtgcccgtgctggtggaggacaccagcagcagcagcgagtacggcagcgtgagccccgacaccgagctgaaggtggaccccttcagcttcaagaccagagccaagagctgcggcgagagagacgtgaagggcatcagaaccctgttcctgggcatccccgacgagaacttcgaggaccacagcgccccccccagccccgaggagaaggacagcggcttcttcatgctgagaaaggacagcgagagaagagccaccctgcacagaatcctgaccgaggaccaggacaagatcgtgagaaacctgatggagagcctggcccagggcgccgaggagcccaagctgaagtgggagcacatcaccaccctgatcgccagcctgagagagttcgtgagaagcaccgacagaaagatcatcgccaccaccctgagcaagctgaagctggagctggacttcgacagccacggcatcagccaggtgcaggtggtgctgttcggcttccaggacgccgtgaacaaggtgctgagaaaccacaacatcaagccccactggatgttcgccctggacagcatcatcagaaaggccgtgcagaccgccatcaccatcctggtgcccggcatcaagccctag

SEQ ID NO: 89381 - DNA, 3867 bp, Artificial Sequence
  Description of Artificial Sequence: Synthetic coding sequence
atggccggcccctgccccagaagcggcgccgagagagccggcagctgctggcaggaccccctggccgtggccctgagcagaggcagacagctggccgccccccccggcagaggctgcgccagaagcagacccctgagcgtggtgtacgtgctgaccagagagccccagcccggcctggagcccagagagggcaccgaggccgagcccctgcccctgagatgcctgagagaggcctgcgcccaggtgcccagacccagaccccccccccagctgagaagcctgcccttcggcaccctggagctgggcgacaccgccgccctggacgccttctacaacgccgacgtggtggtgctggaggtgagcagcagcctggtgcagcccagcctgttctaccacctgggcgtgagagagagcttcagcatgaccaacaacgtgctgctgtgcagccaggccgacctgcccgacctgcaggccctgagagaggacgtgttccagaagaacagcgactgcgtgggcagctacaccctgatcccctacgtggtgaccgccaccggcagagtgctgtgcggcgacgccggcctgctgagaggcctggccgacggcctggtgcaggccggcgtgggcaccgaggccctgctgacccccctggtgggcagactggccagactgctggaggccacccccaccgacagctgcggctacttcagagagaccatcagaagagacatcagacaggccagagagagattcagcggcccccagctgagacaggagctggccagactgcagagaagactggacagcgtggagctgctgagccccgacatcatcatgaacctgctgctgagctacagagacgtgcaggactacagcgccatcatcgagctggtggagaccctgcaggccctgcccacctgcgacgtggccgagcagcacaacgtgtgcttccactacaccttcgccctgaacagaagaaacagacccggcgacagagccaaggccctgagcgtgctgctgcccctggtgcagctggagggcagcgtggcccccgacctgtactgcatgtgcggcagaatctacaaggacatgttcttcagcagcggcttccaggacgccggccacagagagcaggcctaccactggtacagaaaggccttcgacgtggagcccagcctgcacagcggcatcaacgccgccgtgctgctgatcgccgccggccagcacttcgaggacagcaaggagctgagactgatcggcatgaagctgggctgcctgctggccagaaagggctgcgtggagaagatgcagtactactgggacgtgggcttctacctgggcgcccagatcctggccaacgaccccacccaggtggtgctggccgccgagcagctgtacaagctgaacgcccccatctggtacctggtgagcgtgatggagaccttcctgctgtaccagcacttcagacccacccccgagccccccggcggcccccccagaagagcccacttctggctgcacttcctgctgcagagctgccagcccttcaagaccgcctgcgcccagggcgaccagtgcctggtgctggtgctggagatgaacaaggtgctgctgcccgccaagctggaggtgagaggcaccgaccccgtgagcaccgtgaccctgagcctgctggagcccgagacccaggacatccccagcagctggaccttccccgtggccagcatctgcggcgtgagcgccagcaagagagacgagagatgctgcttcctgtacgccctgccccccgcccaggacgtgcagctgtgcttccccagcgtgggccactgccagtggttctgcggcctgatccaggcctgggtgaccaaccccgacagcaccgcccccgccgaggaggccgagggcgccggcgagatgctggagttcgactacgagtacaccgagaccggcgagagactggtgctgggcaagggcacctacggcgtggtgtacgccggcagagacagacacaccagagtgagaatcgccatcaaggagatccccgagagagacagcagattcagccagcccctgcacgaggagatcgccctgcacagaagactgagacacaagaacatcgtgagatacctgggcagcgccagccagggcggctacctgaagatcttcatggaggaggtgcccggcggcagcctgagcagcctgctgagaagcgtgtggggccccctgaaggacaacgagagcaccatcagcttctacaccagacagatcctgcagggcctgggctacctgcacgacaaccacatcgtgcacagagacatcaagggcgacaacgtgctgatcaacaccttcagcggcctgctgaagatcagcgacttcggcaccagcaagagactggccggcatcaccccctgcaccgagaccttcaccggcaccctgcagtacatggcccccgagatcatcgaccagggccccagaggctacggcaaggccgccgacatctggagcctgggctgcaccgtgatcgagatggccaccggcagaccccccttccacgagctgggcagcccccaggccgccatgttccaggtgggcatgtacaaggtgcacccccccatgcccagcagcctgagcgccgaggcccaggccttcctgctgagaaccttcgagcccgaccccagactgagagccagcgcccagaccctgctgggcgaccccttcctgcagcccggcaagagaagcagaagccccagcagccccagacacgcccccagacccagcgacgcccccagcgccagccccacccccagcgccaacagcaccacccagagccagaccttcccctgcccccaggcccccagccagcacccccccagcccccccaagagatgcctgagctacggcggcaccagccagctgagagtgcccgaggagcccgccgccgaggagcccgccagccccgaggagagcagcggcctgagcctgctgcaccaggagagcaagagaagagccatgctggccgccgtgctggagcaggagctgcccgccctggccgagaacctgcaccaggagcagaagcaggagcagggcgccagactgggcagaaaccacgtggaggagctgctgagatgcctgggcgcccacatccacacccccaacagaagacagctggcccaggagctgagagccctgcagggcagactgagagcccagggcctgggccccgccctgctgcacagacccctgttcgccttccccgacgccgtgaagcagatcctgagaaagagacagatcagaccccactggatgttcgtgctggacagcctgctgagcagagccgtgagagccgccctgggcgtgctgggccccgaggtggagaaggaggccgtgagccccagaagcgaggagctgagcaacgagggcgacagccagcagagccccggccagcagagccccctgcccgtggagcccgagcagggccccgcccccctgatggtgcagctgagcctgctgagagccgagaccgacagactgagagagatcctggccggcaaggagagagagtaccaggccctggtgcagagagccctgcagagactgaacgaggaggccagaacctacgtgctggcccccgagccccccaccgccctgagcaccgaccagggcctggtgcagtggctgcaggagctgaacgtggacagcggcaccatccagatgctgctgaaccacagcttcaccctgcacaccctgctgacctacgccaccagagacgacctgatctacaccagaatcagaggcggcatggtgtgcagaatctggagagccatcctggcccagagagccggcagcacccccgtgaccagcggcccctag

SEQ ID NO: 89382 - DNA, 315 bp, Artificial Sequence
  Description of Artificial Sequence: Synthetic coding sequence
atggtgcagctgagcctgctgagagccgagaccgacagactgagagagatcctggccggcaaggagagagagtaccaggccctggtgcagagagccctgcagagactgaacgaggaggccagaacctacgtgctggcccccgagccccccaccgccctgagcaccgaccagggcctggtgcagtggctgcaggagctgaacgtggacagcggcaccatccagatgggcagagacggcatgccccacctggagggccacctgggcaccgccagcagaatccacaccagccacctgtggaccctgagagccgagtag

SEQ ID NO: 89383 - DNA, 3843 bp, Artificial Sequence
  Description of Artificial Sequence: Synthetic coding sequence
atggccggcccctgccccagaagcggcgccgagagagccggcagctgctggcaggaccccctggccgtggccctgagcagaggcagacagctggccgccccccccggcagaggctgcgccagaagcagacccctgagcgtggtgtacgtgctgaccagagagccccagcccggcctggagcccagagagggcaccgaggccgagcccctgcccctgagatgcctgagagaggcctgcgcccaggtgcccagacccagaccccccccccagctgagaagcctgcccttcggcaccctggagctgggcgacaccgccgccctggacgccttctacaacgccgacgtggtggtgctggaggtgagcagcagcctggtgcagcccagcctgttctaccacctgggcgtgagagagagcttcagcatgaccaacaacgtgctgctgtgcagccaggccgacctgcccgacctgcaggccctgagagactgcgtgggcagctacaccctgatcccctacgtggtgaccgccaccggcagagtgctgtgcggcgacgccggcctgctgagaggcctggccgacggcctggtgcaggccggcgtgggcaccgaggccctgctgacccccctggtgggcagactggccagactgctggaggccacccccaccgacagctgcggctacttcagagagaccatcagaagagacatcagacaggccagagagagattcagcggcccccagctgagacaggagctggccagactgcagagaagactggacagcgtggagctgctgagccccgacatcatcatgaacctgctgctgagctacagagacgtgcaggactacagcgccatcatcgagctggtggagaccctgcaggccctgcccacctgcgacgtggccgagcagcacaacgtgtgcttccactacaccttcgccctgaacagaagaaacagacccggcgacagagccaaggccctgagcgtgctgctgcccctggtgcagctggagggcagcgtggcccccgacctgtactgcatgtgcggcagaatctacaaggacatgttcttcagcagcggcttccaggacgccggccacagagagcaggcctaccactggtacagaaaggccttcgacgtggagcccagcctgcacagcggcatcaacgccgccgtgctgctgatcgccgccggccagcacttcgaggacagcaaggagctgagactgatcggcatgaagctgggctgcctgctggccagaaagggctgcgtggagaagatgcagtactactgggacgtgggcttctacctgggcgcccagatcctggccaacgaccccacccaggtggtgctggccgccgagcagctgtacaagctgaacgcccccatctggtacctggtgagcgtgatggagaccttcctgctgtaccagcacttcagacccacccccgagccccccggcggcccccccagaagagcccacttctggctgcacttcctgctgcagagctgccagcccttcaagaccgcctgcgcccagggcgaccagtgcctggtgctggtgctggagatgaacaaggtgctgctgcccgccaagctggaggtgagaggcaccgaccccgtgagcaccgtgaccctgagcctgctggagcccgagacccaggacatccccagcagctggaccttccccgtggccagcatctgcggcgtgagcgccagcaagagagacgagagatgctgcttcctgtacgccctgccccccgcccaggacgtgcagctgtgcttccccagcgtgggccactgccagtggttctgcggcctgatccaggcctgggtgaccaaccccgacagcaccgcccccgccgaggaggccgagggcgccggcgagatgctggagttcgactacgagtacaccgagaccggcgagagactggtgctgggcaagggcacctacggcgtggtgtacgccggcagagacagacacaccagagtgagaatcgccatcaaggagatccccgagagagacagcagattcagccagcccctgcacgaggagatcgccctgcacagaagactgagacacaagaacatcgtgagatacctgggcagcgccagccagggcggctacctgaagatcttcatggaggaggtgcccggcggcagcctgagcagcctgctgagaagcgtgtggggccccctgaaggacaacgagagcaccatcagcttctacaccagacagatcctgcagggcctgggctacctgcacgacaaccacatcgtgcacagagacatcaagggcgacaacgtgctgatcaacaccttcagcggcctgctgaagatcagcgacttcggcaccagcaagagactggccggcatcaccccctgcaccgagaccttcaccggcaccctgcagtacatggcccccgagatcatcgaccagggccccagaggctacggcaaggccgccgacatctggagcctgggctgcaccgtgatcgagatggccaccggcagaccccccttccacgagctgggcagcccccaggccgccatgttccaggtgggcatgtacaaggtgcacccccccatgcccagcagcctgagcgccgaggcccaggccttcctgctgagaaccttcgagcccgaccccagactgagagccagcgcccagaccctgctgggcgaccccttcctgcagcccggcaagagaagcagaagccccagcagccccagacacgcccccagacccagcgacgcccccagcgccagccccacccccagcgccaacagcaccacccagagccagaccttcccctgcccccaggcccccagccagcacccccccagcccccccaagagatgcctgagctacggcggcaccagccagctgagagtgcccgaggagcccgccgccgaggagcccgccagccccgaggagagcagcggcctgagcctgctgcaccaggagagcaagagaagagccatgctggccgccgtgctggagcaggagctgcccgccctggccgagaacctgcaccaggagcagaagcaggagcagggcgccagactgggcagaaaccacgtggaggagctgctgagatgcctgggcgcccacatccacacccccaacagaagacagctggcccaggagctgagagccctgcagggcagactgagagcccagggcctgggccccgccctgctgcacagacccctgttcgccttccccgacgccgtgaagcagatcctgagaaagagacagatcagaccccactggatgttcgtgctggacagcctgctgagcagagccgtgagagccgccctgggcgtgctgggccccgaggtggagaaggaggccgtgagccccagaagcgaggagctgagcaacgagggcgacagccagcagagccccggccagcagagccccctgcccgtggagcccgagcagggccccgcccccctgatggtgcagctgagcctgctgagagccgagaccgacagactgagagagatcctggccggcaaggagagagagtaccaggccctggtgcagagagccctgcagagactgaacgaggaggccagaacctacgtgctggcccccgagccccccaccgccctgagcaccgaccagggcctggtgcagtggctgcaggagctgaacgtggacagcggcaccatccagatgctgctgaaccacagcttcaccctgcacaccctgctgacctacgccaccagagacgacctgatctacaccagaatcagaggcggcatggtgtgcagaatctggagagccatcctggcccagagagccggcagcacccccgtgaccagcggcccctag

SEQ ID NO: 89384 - DNA, 2397 bp, Artificial Sequence
  Description of Artificial Sequence: Synthetic coding sequence
tgaatgaacctgctgctgagctacagagacgtgcaggactacagcgccatcatcgagctggtggagaccctgcaggccctgcccacctgcgacgtggccgagcagcacaacgtgtgcttccactacaccttcgccctgaacagaagaaacagacccggcgacagagccaaggccctgagcgtgctgctgcccctggtgcagctggagggcagcgtggcccccgacctgtactgcatgtgcggcagaatctacaaggacatgttcttcagcagcggcttccaggacgccggccacagagagcaggcctaccactggtacagaaaggccttcgacgtggagcccagcctgcacagcggcatcaacgccgccgtgctgctgatcgccgccggccagcacttcgaggacagcaaggagctgagactgatcggcatgaagctgggctgcctgctggccagaaagggctgcgtggagaagatgcagtactactgggacgtgggcttctacctgggcgcccagatcctggccaacgaccccacccaggtggtgctggccgccgagcagctgtacaagctgaacgcccccatctggtacctggtgagcgtgatggagaccttcctgctgtaccagcacttcagacccacccccgagccccccggcggcccccccagaagagcccacttctggctgcacttcctgctgcagagctgccagcccttcaagaccgcctgcgcccagggcgaccagtgcctggtgctggtgctggagatgaacaaggtgctgctgcccgccaagctggaggtgagaggcaccgaccccgtgagcaccgtgaccctgagcctgctggagcccgagacccaggacatccccagcagctggaccttccccgtggccagcatctgcggcgtgagcgccagcaagagagacgagagatgctgcttcctgtacgccctgccccccgcccaggacgtgcagctgtgcttccccagcgtgggccactgccagtggttctgcggcctgatccaggcctgggtgaccaaccccgacagcaccgcccccgccgaggaggccgagggcgccggcgagatgctggagttcgactacgagtacaccgagaccggcgagagactggtgctgggcaagggcacctacggcgtggtgtacgccggcagagacagacacaccagagtgagaatcgccatcaaggagatccccgagagagacagcagattcagccagcccctgcacgaggagatcgccctgcacagaagactgagacacaagaacatcgtgagatacctgggcagcgccagccagggcggctacctgaagatcttcatggaggaggtgcccggcggcagcctgagcagcctgctgagaagcgtgtggggccccctgaaggacaacgagagcaccatcagcttctacaccagacagatcctgcagggcctgggctacctgcacgacaaccacatcgtgcacagagacatcaagggcgacaacgtgctgatcaacaccttcagcggcctgctgaagatcagcgacttcggcaccagcaagagactggccggcatcaccccctgcaccgagaccttcaccggcaccctgcagtacatggcccccgagatcatcgaccagggccccagaggctacggcaaggccgccgacatctggagcctgggctgcaccgtgatcgagatggccaccggcagaccccccttccacgagctgggcagcccccaggccgccatgttccaggtgggcatgtacaaggtgcacccccccatgcccagcagcctgagcgccgaggcccaggccttcctgctgagaaccttcgagcccgaccccagactgagagccagcgcccagaccctgctgggcgaccccttcctgcagcccggcaagagaagcagaagccccagcagccccagacacgcccccagacccagcgacgcccccagcgccagccccacccccagcgccaacagcaccacccagagccagaccttcccctgcccccaggcccccagccagcacccccccagcccccccaagagatgcctgagctacggcggcaccagccagctgagagtgcccgaggagcccgccgccgaggagcccgccagccccgaggagagcagcggcctgagcctgctgcaccaggagagcaagagaagagccatgctggccgccgtgctggagcaggagctgcccgccctggccgagaacctgcaccaggagcagaagcaggagcagggcgccagactgggcagaaaccacgtggaggagctgctgagatgcctgggcgcccacatccacacccccaacagaagacagctggcccaggagctgagagccctgcagggctggatgaacggcgaggacaagggcagcttctag

SEQ ID NO: 89385 - DNA, 249 bp, Artificial Sequence
  Description of Artificial Sequence: Synthetic coding sequence
tgagagtaccaggccctggtgcagagagccctgcagagactgaacgaggaggccagaacctacgtgctggcccccgagccccccaccgccctgagcaccgaccagggcctggtgcagtggctgcaggagctgaacgtggacagcggcaccatccagatgggcagagacggcatgccccacctggagggccacctgggcaccgccagcagaatccacaccagccacctgtggaccctgagagccgagtag

SEQ ID NO: 89386 - DNA, 3867 bp, Artificial Sequence; identical to SEQ ID NO: 89381
  Description of Artificial Sequence: Synthetic coding sequence

SEQ ID NO: 89387 - DNA, 2394 bp, Artificial Sequence
  Description of Artificial Sequence: Synthetic coding sequence
atgaacctgctgctgagctacagagacgtgcaggactacagcgccatcatcgagctggtggagaccctgcaggccctgcccacctgcgacgtggccgagcagcacaacgtgtgcttccactacaccttcgccctgaacagaagaaacagacccggcgacagagccaaggccctgagcgtgctgctgcccctggtgcagctggagggcagcgtggcccccgacctgtactgcatgtgcggcagaatctacaaggacatgttcttcagcagcggcttccaggacgccggccacagagagcaggcctaccactggtacagaaaggccttcgacgtggagcccagcctgcacagcggcatcaacgccgccgtgctgctgatcgccgccggccagcacttcgaggacagcaaggagctgagactgatcggcatgaagctgggctgcctgctggccagaaagggctgcgtggagaagatgcagtactactgggacgtgggcttctacctgggcgcccagatcctggccaacgaccccacccaggtggtgctggccgccgagcagctgtacaagctgaacgcccccatctggtacctggtgagcgtgatggagaccttcctgctgtaccagcacttcagacccacccccgagccccccggcggcccccccagaagagcccacttctggctgcacttcctgctgcagagctgccagcccttcaagaccgcctgcgcccagggcgaccagtgcctggtgctggtgctggagatgaacaaggtgctgctgcccgccaagctggaggtgagaggcaccgaccccgtgagcaccgtgaccctgagcctgctggagcccgagacccaggacatccccagcagctggaccttccccgtggccagcatctgcggcgtgagcgccagcaagagagacgagagatgctgcttcctgtacgccctgccccccgcccaggacgtgcagctgtgcttccccagcgtgggccactgccagtggttctgcggcctgatccaggcctgggtgaccaaccccgacagcaccgcccccgccgaggaggccgagggcgccggcgagatgctggagttcgactacgagtacaccgagaccggcgagagactggtgctgggcaagggcacctacggcgtggtgtacgccggcagagacagacacaccagagtgagaatcgccatcaaggagatccccgagagagacagcagattcagccagcccctgcacgaggagatcgccctgcacagaagactgagacacaagaacatcgtgagatacctgggcagcgccagccagggcggctacctgaagatcttcatggaggaggtgcccggcggcagcctgagcagcctgctgagaagcgtgtggggccccctgaaggacaacgagagcaccatcagcttctacaccagacagatcctgcagggcctgggctacctgcacgacaaccacatcgtgcacagagacatcaagggcgacaacgtgctgatcaacaccttcagcggcctgctgaagatcagcgacttcggcaccagcaagagactggccggcatcaccccctgcaccgagaccttcaccggcaccctgcagtacatggcccccgagatcatcgaccagggccccagaggctacggcaaggccgccgacatctggagcctgggctgcaccgtgatcgagatggccaccggcagaccccccttccacgagctgggcagcccccaggccgccatgttccaggtgggcatgtacaaggtgcacccccccatgcccagcagcctgagcgccgaggcccaggccttcctgctgagaaccttcgagcccgaccccagactgagagccagcgcccagaccctgctgggcgaccccttcctgcagcccggcaagagaagcagaagccccagcagccccagacacgcccccagacccagcgacgcccccagcgccagccccacccccagcgccaacagcaccacccagagccagaccttcccctgcccccaggcccccagccagcacccccccagcccccccaagagatgcctgagctacggcggcaccagccagctgagagtgcccgaggagcccgccgccgaggagcccgccagccccgaggagagcagcggcctgagcctgctgcaccaggagagcaagagaagagccatgctggccgccgtgctggagcaggagctgcccgccctggccgagaacctgcaccaggagcagaagcaggagcagggcgccagactgggcagaaaccacgtggaggagctgctgagatgcctgggcgcccacatccacacccccaacagaagacagctggcccaggagctgagagccctgcagggctggatgaacggcgaggacaagggcagcttctag

SEQ ID NO: 89388 - DNA, 783 bp, Artificial Sequence
  Description of Artificial Sequence: Synthetic coding sequence
atggacatcgccagcaccaacaccagcaacaagagcgacaccaacatggagcaggtgcccgccaccaacgacaccatcaagagactggagagcaagctgctgaagaaccaggccaagcagcagagcgagagcggcagactgagcctgggcgccagcagaggcagcagcgtggagagcctgccccccaccagcgagggcaagagaatgagcgccgacatgagcgagatcgaggccagaatcgccgccaccaccggcaacggccagcccagaagaagaagcatccaggacctgaccgtgaccggcaccgagcccggccaggtgagcagcagaagcagcagccccagcgtgagaatgatcaccaccagcggccccaccagcgagaagcccaccagaagccacccctggacccccgacgacagcaccgacaccaacggcagcgacaacagcatccccatggcctacctgaccctggaccaccagctgcagcccctggccccctgccccaacagcaaggagagcatggccgtgttcgagcagcactgcaagatggcccaggagtacatgaaggtgcagaccgagatcgccctgctgctgcagagaaagcaggagctggtggccgagctggaccaggacgagaaggaccagcagaacaccagcagactggtgcaggagcacaagaagctgctggacgagaacaagagcctgagcacctactaccagcagtgcaagaagcagctggaggtgatcagaagccagcagcagaagagacagggcaccagctag

SEQ ID NO: 89389 - DNA, 1557 bp, Artificial Sequence
  Description of Artificial Sequence: Synthetic coding sequence
atgagcaccgccagcgccgccagcagcagcagcagcagcagcgccggcgagatgatcgaggcccccagccaggtgctgaacttcgaggagatcgactacaaggagatcgaggtggaggaggtggtgggcagaggcgccttcggcgtggtgtgcaaggccaagtggagagccaaggacgtggccatcaagcagatcgagagcgagagcgagagaaaggccttcatcgtggagctgagacagctgagcagagtgaaccaccccaacatcgtgaagctgtacggcgcctgcctgaaccccgtgtgcctggtgatggagtacgccgagggcggcagcctgtacaacgtgctgcacggcgccgagcccctgccctactacaccgccgcccacgccatgagctggtgcctgcagtgcagccagggcgtggcctacctgcacagcatgcagcccaaggccctgatccacagagacctgaagccccccaacctgctgctggtggccggcggcaccgtgctgaagatctgcgacttcggcaccgcctgcgacatccagacccacatgaccaacaacaagggcagcgccgcctggatggcccccgaggtgttcgagggcagcaactacagcgagaagtgcgacgtgttcagctggggcatcatcctgtgggaggtgatcaccagaagaaagcccttcgacgagatcggcggccccgccttcagaatcatgtgggccgtgcacaacggcaccagaccccccctgatcaagaacctgcccaagcccatcgagagcctgatgaccagatgctggagcaaggaccccagccagagacccagcatggaggagatcgtgaagatcatgacccacctgatgagatacttccccggcgccgacgagcccctgcagtacccctgccagtacagcgacgagggccagagcaacagcgccaccagcaccggcagcttcatggacatcgccagcaccaacaccagcaacaagagcgacaccaacatggagcaggtgcccgccaccaacgacaccatcaagagactggagagcaagctgctgaagaaccaggccaagcagcagagcgagagcggcagactgagcctgggcgccagcagaggcagcagcgtggagagcctgccccccaccagcgagggcaagagaatgagcgccgacatgagcgagatcgaggccagaatcgccgccaccaccgcctacagcaagcccaagagaggccacagaaagaccgccagcttcggcaacatcctggacgtgcccgagatcgtgatcagcggcaacggccagcccagaagaagaagcatccaggacctgaccgtgaccggcaccgagcccggccaggtgagcagcagaagcagcagccccagcgtgagaatgatcaccaccagcggccccaccagcgagaagcccaccagaagccacccctggacccccgacgacagcaccgacaccaacggcagcgacaacagcatccccatggcctacctgaccctggaccaccagctgcaggccagaaccagctgcagaaccggccccggctag

SEQ ID NO: 89390 - DNA, 1476 bp, Artificial Sequence
  Description of Artificial Sequence: Synthetic coding sequence
atgagcaccgccagcgccgccagcagcagcagcagcagcagcgccggcgagatgatcgaggcccccagccaggtgctgaacttcgaggagatcgactacaaggagatcgaggtggaggaggtggtgggcagaggcgccttcggcgtggtgtgcaaggccaagtggagagccaaggacgtggccatcaagcagatcgagagcgagagcgagagaaaggccttcatcgtggagctgagacagctgagcagagtgaaccaccccaacatcgtgaagctgtacggcgcctgcctgaaccccgtgtgcctggtgatggagtacgccgagggcggcagcctgtacaacgtgctgcacggcgccgagcccctgccctactacaccgccgcccacgccatgagctggtgcctgcagtgcagccagggcgtggcctacctgcacagcatgcagcccaaggccctgatccacagagacctgaagccccccaacctgctgctggtggccggcggcaccgtgctgaagatctgcgacttcggcaccgcctgcgacatccagacccacatgaccaacaacaagggcagcgccgcctggatggcccccgaggtgttcgagggcagcaactacagcgagaagtgcgacgtgttcagctggggcatcatcctgtgggaggtgatcaccagaagaaagcccttcgacgagatcggcggccccgccttcagaatcatgtgggccgtgcacaacggcaccagaccccccctgatcaagaacctgcccaagcccatcgagagcctgatgaccagatgctggagcaaggaccccagccagagacccagcatggaggagatcgtgaagatcatgacccacctgatgagatacttccccggcgccgacgagcccctgcagtacccctgccagtacagcgacgagggccagagcaacagcgccaccagcaccggcagcttcatggacatcgccagcaccaacaccagcaacaagagcgacaccaacatggagcaggtgcccgccaccaacgacaccatcaagagactggagagcaagctgctgaagaaccaggccaagcagcagagcgagagcggcagactgagcctgggcgccagcagaggcagcagcgtggagagcctgccccccaccagcgagggcaagagaatgagcgccgacatgagcgagatcgaggccagaatcgccgccaccaccggcaacggccagcccagaagaagaagcatccaggacctgaccgtgaccggcaccgagcccggccaggtgagcagcagaagcagcagccccagcgtgagaatgatcaccaccagcggccccaccagcgagaagcccaccagaagccacccctggacccccgacgacagcaccgacaccaacggcagcgacaacagcatccccatggcctacctgaccctggaccaccagctgcaggccagaaccagctgcagaaccggccccggctag

SEQ ID NO: 89391 - DNA, 1821 bp, Artificial Sequence
  Description of Artificial Sequence: Synthetic coding sequence
atgagcaccgccagcgccgccagcagcagcagcagcagcagcgccggcgagatgatcgaggcccccagccaggtgctgaacttcgaggagatcgactacaaggagatcgaggtggaggaggtggtgggcagaggcgccttcggcgtggtgtgcaaggccaagtggagagccaaggacgtggccatcaagcagatcgagagcgagagcgagagaaaggccttcatcgtggagctgagacagctgagcagagtgaaccaccccaacatcgtgaagctgtacggcgcctgcctgaaccccgtgtgcctggtgatggagtacgccgagggcggcagcctgtacaacgtgctgcacggcgccgagcccctgccctactacaccgccgcccacgccatgagctggtgcctgcagtgcagccagggcgtggcctacctgcacagcatgcagcccaaggccctgatccacagagacctgaagccccccaacctgctgctggtggccggcggcaccgtgctgaagatctgcgacttcggcaccgcctgcgacatccagacccacatgaccaacaacaagggcagcgccgcctggatggcccccgaggtgttcgagggcagcaactacagcgagaagtgcgacgtgttcagctggggcatcatcctgtgggaggtgatcaccagaagaaagcccttcgacgagatcggcggccccgccttcagaatcatgtgggccgtgcacaacggcaccagaccccccctgatcaagaacctgcccaagcccatcgagagcctgatgaccagatgctggagcaaggaccccagccagagacccagcatggaggagatcgtgaagatcatgacccacctgatgagatacttccccggcgccgacgagcccctgcagtacccctgccagtacagcgacgagggccagagcaacagcgccaccagcaccggcagcttcatggacatcgccagcaccaacaccagcaacaagagcgacaccaacatggagcaggtgcccgccaccaacgacaccatcaagagactggagagcaagctgctgaagaaccaggccaagcagcagagcgagagcggcagactgagcctgggcgccagcagaggcagcagcgtggagagcctgccccccaccagcgagggcaagagaatgagcgccgacatgagcgagatcgaggccagaatcgccgccaccaccgcctacagcaagcccaagagaggccacagaaagaccgccagcttcggcaacatcctggacgtgcccgagatcgtgatcagcggcaacggccagcccagaagaagaagcatccaggacctgaccgtgaccggcaccgagcccggccaggtgagcagcagaagcagcagccccagcgtgagaatgatcaccaccagcggccccaccagcgagaagcccaccagaagccacccctggacccccgacgacagcaccgacaccaacggcagcgacaacagcatccccatggcctacctgaccctggaccaccagctgcagcccctggccccctgccccaacagcaaggagagcatggccgtgttcgagcagcactgcaagatggcccaggagtacatgaaggtgcagaccgagatcgccctgctgctgcagagaaagcaggagctggtggccgagctggaccaggacgagaaggaccagcagaacaccagcagactggtgcaggagcacaagaagctgctggacgagaacaagagcctgagcacctactaccagcagtgcaagaagcagctggaggtgatcagaagccagcagcagaagagacagggcaccagctag

SEQ ID NO: 89392 - DNA, 1740 bp, Artificial Sequence
  Description of Artificial Sequence: Synthetic coding sequence
atgagcaccgccagcgccgccagcagcagcagcagcagcagcgccggcgagatgatcgaggcccccagccaggtgctgaacttcgaggagatcgactacaaggagatcgaggtggaggaggtggtgggcagaggcgccttcggcgtggtgtgcaaggccaagtggagagccaaggacgtggccatcaagcagatcgagagcgagagcgagagaaaggccttcatcgtggagctgagacagctgagcagagtgaaccaccccaacatcgtgaagctgtacggcgcctgcctgaaccccgtgtgcctggtgatggagtacgccgagggcggcagcctgtacaacgtgctgcacggcgccgagcccctgccctactacaccgccgcccacgccatgagctggtgcctgcagtgcagccagggcgtggcctacctgcacagcatgcagcccaaggccctgatccacagagacctgaagccccccaacctgctgctggtggccggcggcaccgtgctgaagatctgcgacttcggcaccgcctgcgacatccagacccacatgaccaacaacaagggcagcgccgcctggatggcccccgaggtgttcgagggcagcaactacagcgagaagtgcgacgtgttcagctggggcatcatcctgtgggaggtgatcaccagaagaaagcccttcgacgagatcggcggccccgccttcagaatcatgtgggccgtgcacaacggcaccagaccccccctgatcaagaacctgcccaagcccatcgagagcctgatgaccagatgctggagcaaggaccccagccagagacccagcatggaggagatcgtgaagatcatgacccacctgatgagatacttccccggcgccgacgagcccctgcagtacccctgccagtacagcgacgagggccagagcaacagcgccaccagcaccggcagcttcatggacatcgccagcaccaacaccagcaacaagagcgacaccaacatggagcaggtgcccgccaccaacgacaccatcaagagactggagagcaagctgctgaagaaccaggccaagcagcagagcgagagcggcagactgagcctgggcgccagcagaggcagcagcgtggagagcctgccccccaccagcgagggcaagagaatgagcgccgacatgagcgagatcgaggccagaatcgccgccaccaccggcaacggccagcccagaagaagaagcatccaggacctgaccgtgaccggcaccgagcccggccaggtgagcagcagaagcagcagccccagcgtgagaatgatcaccaccagcggccccaccagcgagaagcccaccagaagccacccctggacccccgacgacagcaccgacaccaacggcagcgacaacagcatccccatggcctacctgaccctggaccaccagctgcagcccctggccccctgccccaacagcaaggagagcatggccgtgttcgagcagcactgcaagatggcccaggagtacatgaaggtgcagaccgagatcgccctgctgctgcagagaaagcaggagctggtggccgagctggaccaggacgagaaggaccagcagaacaccagcagactggtgcaggagcacaagaagctgctggacgagaacaagagcctgagcacctactaccagcagtgcaagaagcagctggaggtgatcagaagccagcagcagaagagacagggcaccagctag

SEQ ID NO: 89393 - DNA, 1257 bp, Artificial Sequence
  Description of Artificial Sequence: Synthetic coding sequence
atgagcaccgccagcgccgccagcagcagcagcagcagcagcgccggcgagatgatcgaggcccccagccaggtgctgaacttcgaggagatcgactacaaggagatcgaggtggaggaggtggtgggcagaggcgccttcggcgtggtgtgcaaggccaagtggagagccaaggacgtggccatcaagcagatcgagagcgagagcgagagaaaggccttcatcgtggagctgagacagctgagcagagtgaaccaccccaacctgctgctggtggccggcggcaccgtgctgaagatctgcgacttcggcaccgcctgcgacatccagacccacatgaccaacaacaagggcagcgccgcctggatggcccccgaggtgttcgagggcagcaactacagcgagaagtgcgacgtgttcagctggggcatcatcctgtgggaggtgatcaccagaagaaagcccttcgacgagatcggcggccccgccttcagaatcatgtgggccgtgcacaacggcaccagaccccccctgatcaagaacctgcccaagcccatcgagagcctgatgaccagatgctggagcaaggaccccagccagagacccagcatggaggagatcgtgaagatcatgacccacctgatgagatacttccccggcgccgacgagcccctgcagtacccctgccagtacagcgacgagggccagagcaacagcgccaccagcaccggcagcttcatggacatcgccagcaccaacaccagcaacaagagcgacaccaacatggagcaggtgcccgccaccaacgacaccatcaagagactggagagcaagctgctgaagaaccaggccaagcagcagagcgagagcggcagactgagcctgggcgccagcagaggcagcagcgtggagagcctgccccccaccagcgagggcaagagaatgagcgccgacatgagcgagatcgaggccagaatcgccgccaccaccggcaacggccagcccagaagaagaagcatccaggacctgaccgtgaccggcaccgagcccggccaggtgagcagcagaagcagcagccccagcgtgagaatgatcaccaccagcggccccaccagcgagaagcccaccagaagccacccctggacccccgacgacagcaccgacaccaacggcagcgacaacagcatccccatggcctacctgaccctggaccaccagctgcaggccagaaccagctgcagaaccggccccggctag

SEQ ID NO: 89394 - DNA, 1404 bp, Artificial Sequence
  Description of Artificial Sequence: Synthetic coding sequence
atggagtacatgagcaccggcagcgacaacaaggaggagatcgacctgctgatcaagcacctgaacgtgagcgacgtgatcgacatcatggagaacctgtacgccagcgaggagcccgccgtgtacgagcccagcctgatgaccatgtgccaggacagcaaccagaacgacgagagaagcaagagcctgctgctgagcggccaggaggtgccctggctgagcagcgtgagatacggcaccgtggaggacctgctggccttcgccaaccacatcagcaacaccgccaagcacttctacggccagagaccccaggagagcggcatcctgctgaacatggtgatcaccccccagaacggcagataccagatcgacagcgacgtgctgctgatcccctggaagctgacctacagaaacatcggcagcgacttcatccccagaggcgccttcggcaaggtgtacctggcccaggacatcaagaccaagaagagaatggcctgcaagctgatccccgtggaccagttcaagcccagcgacgtggagatccaggcctgcttcagacacgagaacatcgccgagctgtacggcgccgtgctgtggggcgagaccgtgcacctgttcatggaggccggcgagggcggcagcgtgctggagaagctggagagctgcggccccatgagagagttcgagatcatctgggtgaccaagcacgtgctgaagggcctggacttcctgcacagcaagaaggtgatccaccacgacatcaagcccagcaacatcgtgttcatgagcaccaaggccgtgctggtggacttcggcctgagcgtgcagatgaccgaggacgtgtacttccccaaggacctgagaggcaccgagatctacatgagccccgaggtgatcctgtgcagaggccacagcaccaaggccgacatctacagcctgggcgccaccctgatccacatgcagaccggcacccccccctgggtgaagagataccccagaagcgcctaccccagctacctgtacatcatccacaagcaggccccccccctggaggacatcgccgacgactgcagccccggcatgagagagctgatcgaggccagcctggagagaaaccccaaccacagacccagagccgccgacctgctgaagcacgaggccctgaacccccccagagaggaccagcccagatgccagagcctggacagcgccctgctggagagaaagagactgctgagcagaaaggagctggagctgcccgagaacatcgccgacagcagctgcaccggcagcaccgaggagagcgagatgctgaagagacagagaagcctgtacatcgacctgggcgccctggccggctacttcaacctggtgagaggcccccccaccctggagtacggctag

SEQ ID NO: 89395 - DNA, 1404 bp, Artificial Sequence; identical to SEQ ID NO: 89394
  Description of Artificial Sequence: Synthetic coding sequence

SEQ ID NO: 89396 - DNA, 399 bp, Artificial Sequence
  Description of Artificial Sequence: Synthetic coding sequence
atggagtacatgagcaccggcagcgacaacaaggaggagatcgacctgctgatcaagcacctgaacgtgagcgacgtgatcgacatcatggagaacctgtacgccagcgaggagcccgccgtgtacgagcccagcctgatgaccatgtgccaggacagcaaccagaacgacgagagaagcaagagcctgctgctgagcggccaggaggtgccctggctgagcagcgtgagatacggcaccgtggaggacctgctggccttcgccaaccacatcagcaacaccgccaagcacttctacggccagagaccccaggagagcggcatcctgctgaacatggtgagattcttccccatcagctgggtgctgtgcgcccagctgagctactgcagcttcatctag

SEQ ID NO: 89397 - DNA, 1404 bp, Artificial Sequence; identical to SEQ ID NO: 89394
  Description of Artificial Sequence: Synthetic coding sequence

SEQ ID NO: 89398 - DNA, 672 bp, Artificial Sequence
  Description of Artificial Sequence: Synthetic coding sequence
atggagtacatgagcaccggcagcgacaacaaggaggagatcgacctgctgatcaagcacctgaacgtgagcgacgtgatcgacatcatggagaacctgtacgccagcgaggagcccgccgtgtacgagcccagcctgatgaccatgtgccaggacagcaaccagaacgacgagagaagcaagagcctgctgctgagcggccaggaggtgccctggctgagcagcgtgagatacggcaccgtggaggacctgctggccttcgccaaccacatcagcaacaccgccaagcacttctacggccagagaccccaggagagcggcatcctgctgaacatggtgatcaccccccagaacggcagataccagatcgacagcgacgtgctgctgatcccctggaagctgacctacagaaacatcggcagcgacttcatccccagaggcgccttcggcaaggtgtacctggcccaggacatcaagaccaagaagagaatggcctgcaagctgatccccgtggaccagttcaagcccagcgacgtggagatccaggcctgcttcagacacgagaacatcgccgagctgtacggcgccgtgctgtggggcgagaccgtgcacctgttcatggaggccggcgagggcggcagcgtgctggagaagctggagagctgcggctag

SEQ ID NO: 89399 - DNA, 768 bp, Artificial Sequence
  Description of Artificial Sequence: Synthetic coding sequence
atggagtacatgagcaccggcagcgacaacaaggaggagatcgacctgctgatcaagcacctgaacgtgagcgacgtgatcgacatcatggagaacctgtacgccagcgaggagcccgccgtgtacgagcccagcctgatgaccatgtgccaggacagcaaccagaacgacgagagaagcaagagcctgctgctgagcggccaggaggtgccctggctgagcagcgtgagatacggcaccgtggaggacctgctggccttcgccaaccacatcagcaacaccgccaagcacttctacggccagagaccccaggagagcggcatcctgctgaacatggtgatcaccccccagaacggcagataccagatcgacagcgacgtgctgctgatcccctggaagctgacctacagaaacatcggcagcgacttcatccccagaggcgccttcggcaaggtgtacctggcccaggacatcaagaccaagaagagaatggcctgcaagctgatccccgtggaccagttcaagcccagcgacgtggagatccaggcctgcttcagacacgagaacatcgccgagctgtacggcgccgtgctgtggggcgagaccgtgcacctgttcatggaggccggcgagggcggcagcgtgctggagaagctggagagctgcggccccatgagagagttcgagatcatctgggtgaccaagcacgtgctgaagggcctggacttcctgcacagcaagaaggtgatccaccacgacatcaagtag

SEQ ID NO: 89400 - DNA, 573 bp, Artificial Sequence
  Description of Artificial Sequence: Synthetic coding sequence
tgagtggaggacctgctggccttcgccaaccacatcagcaacaccgccaagcacttctacggccagagaccccaggagagcggcatcctgctgaacatggtgatcaccccccagaacggcagataccagatcgacagcgacgtgctgctgatcccctggaagctgacctacagaaacatcggcagcgacttcatccccagaggcgccttcggcaaggtgtacctggcccaggacatcaagaccaagaagagaatggcctgcaagctgatccccgtggaccagttcaagcccagcgacgtggagatccaggcctgcttcagacacgagaacatcgccgagctgtacggcgccgtgctgtggggcgagaccgtgcacctgttcatggaggccggcgagggcggcagcgtgctggagaagctggagagctgcggccccatgagagagttcgagatcatctgggtgaccaagcacgtgctgaagggcctggacttcctgcacagcaagaaggtgatccaccacgacatcaagagaaagtacctgtggacctacaccttcctggcccagagagactag

SEQ ID NO: 89401 - DNA, 1404 bp, Artificial Sequence; identical to SEQ ID NO: 89394
  Description of Artificial Sequence: Synthetic coding sequence

SEQ ID NO: 89402 - DNA, 3357 bp, Artificial Sequence
  Description of Artificial Sequence: Synthetic coding sequence
atggagcccagcagagccctgctgggctgcctggccagcgccgccgccgccgccccccccggcgaggacggcgccggcgccggcgccgaggaggaggaggaggaggaggaggaggccgccgccgccgtgggccccggcgagctgggctgcgacgcccccctgccctactggaccgccgtgttcgagtacgaggccgccggcgaggacgagctgaccctgagactgggcgacgtggtggaggtgctgagcaaggacagccaggtgagcggcgacgagggctggtggaccggccagctgaaccagagagtgggcatcttccccagcaactacgtgacccccagaagcgccttcagcagcagatgccagcccggcggcgaggaccccagctgctacccccccatccagctgctggagatcgacttcgccgagctgaccctggaggagatcatcggcatcggcggcttcggcaaggtgtacagagccttctggatcggcgacgaggtggccgtgaaggccgccagacacgaccccgacgaggacatcagccagaccatcgagaacgtgagacaggaggccaagctgttcgccatgctgaagcaccccaacatcatcgccctgagaggcgtgtgcctgaaggagcccaacctgtgcctggtgatggagttcgccagaggcggccccctgaacagagtgctgagcggcaagagaatcccccccgacatcctggtgaactgggccgtgcagatcgccagaggcatgaactacctgcacgacgaggccatcgtgcccatcatccacagagacctgaagagcagcaacatcctgatcctgcagaaggtggagaacggcgacctgagcaacaagatcctgaagatcaccgacttcggcctggccagagagtggcacagaaccaccaagatgagcgccgccggcacctacgcctggatggcccccgaggtgatcagagccagcatgttcagcaagggcagcgacgtgtggagctacggcgtgctgctgtgggagctgctgaccggcgaggtgcccttcagaggcatcgacggcctggccgtggcctacggcgtggccatgaacaagctggccctgcccatccccagcacctgccccgagcccttcgccaagctgatggaggactgctggaaccccgacccccacagcagacccagcttcaccaacatcctggaccagctgaccaccatcgaggagagcggcttcttcgagatgcccaaggacagcttccactgcctgcaggacaactggaagcacgagatccaggagatgttcgaccagctgagagccaaggagaaggagctgagaacctgggaggaggagctgaccagagccgccctgcagcagaagaaccaggaggagctgctgagaagaagagagcaggagctggccgagagagagatcgacatcctggagagagagctgaacatcatcatccaccagctgtgccaggagaagcccagagtgaagaagagaaagggcaagttcagaaagagcagactgaagctgaaggacggcaacagaatcagcctgcccagcgacttccagcacaagttcaccgtgcaggccagccccaccatggacaagagaaagagcctgatcaacagcagaagcagcccccccgccagccccaccatcatccccagactgagagccatccagctgacccccggcgagagcagcaagacctggggcagaagcagcgtggtgcccaaggaggagggcgaggaggaggagaagagagcccccaagaagaagggcagaacctggggccccggcaccctgggccagaaggagctggccagcggcgacgagggcagcccccagagaagagagaaggccaacggcctgagcacccccagcgagagcccccacttccacctgggcctgaagagcctggtggacggctacaagcagtggagcagcagcgcccccaacctggtgaagggccccagaagcagccccgccctgcccggcttcaccagcctgatggagatggccctgctggccgccagctgggtggtgcccatcgacatcgaggaggacgaggacagcgagggccccggcagcggcgagagcagactgcagcacagccccagccagagctacctgtgcatccccttccccagaggcgaggacggcgacggccccagcagcgacggcatccacgaggagcccacccccgtgaacagcgccaccagcaccccccagctgacccccaccaacagcctgaagagaggcggcgcccaccacagaagatgcgaggtggccctgctgggctgcggcgccgtgctggccgccaccggcctgggcttcgacctgctggaggccggcaagtgccagctgctgcccctggaggagcccgagccccccgccagagaggagaagaagagaagagagggcctgttccagagaagcagcagacccagaagaagcaccagcccccccagcagaaagctgttcaagaaggaggagcccatgctgctgctgggcgaccccagcgccagcctgaccctgctgagcctgagcagcatcagcgagtgcaacagcaccagaagcctgctgagaagcgacagcgacgagatcgtggtgtacgagatgcccgtgagccccgtggaggccccccccctgagcccctgcacccacaaccccctggtgaacgtgagagtggagagattcaagagagaccccaaccagagcctgacccccacccacgtgaccctgaccacccccagccagcccagcagccacagaagaacccccagcgacggcgccctgaagcccgagaccctgctggccagcagaagccccagcagcaacggcctgagccccagccccggcgccggcatgctgaagacccccagccccagcagagaccccggcgagttccccagactgcccgaccccaacgtggtgttcccccccacccccagaagatggaacacccagcaggacagcaccctggagagacccaagaccctggagttcctgcccagacccagacccagcgccaacagacagagactggacccctggtggttcgtgagccccagccacgccagaagcaccagccccgccaacagcagcagcaccgagacccccagcaacctggacagctgcttcgccagcagcagcagcaccgtggaggagagacccggcctgcccgccctgctgcccttccaggccggccccctgccccccaccgagagaaccctgctggacctggacgccgagggccagagccaggacagcaccgtgcccctgtgcagagccgagctgaacacccacagacccgccccctacgagatccagcaggagttctggagctag

SEQ ID NO: 89403 - DNA, 2463 bp, Artificial Sequence
  Description of Artificial Sequence: Synthetic coding sequence
ctggtgctgatcctgcagaaggtggagaacggcgacctgagcaacaagatcctgaagatcaccgacttcggcctggccagagagtggcacagaaccaccaagatgagcgccgccggcacctacgcctggatggcccccgaggtgatcagagccagcatgttcagcaagggcagcgacgtgtggagctacggcgtgctgctgtgggagctgctgaccggcgaggtgcccttcagaggcatcgacggcctggccgtggcctacggcgtggccatgaacaagctggccctgcccatccccagcacctgccccgagcccttcgccaagctgatggaggactgctggaaccccgacccccacagcagacccagcttcaccaacatcctggaccagctgaccaccatcgaggagagcggcttcttcgagatgcccaaggacagcttccactgcctgcaggacaactggaagcacgagatccaggagatgttcgaccagctgagagccaaggagaaggagctgagaacctgggaggaggagctgaccagagccgccctgcagcagaagaaccaggaggagctgctgagaagaagagagcaggagctggccgagagagagatcgacatcctggagagagagctgaacatcatcatccaccagctgtgccaggagaagcccagagtgaagaagagaaagggcaagttcagaaagagcagactgaagctgaaggacggcaacagaatcagcctgcccagcgacttccagcacaagttcaccgtgcaggccagccccaccatggacaagagaaagagcctgatcaacagcagaagcagcccccccgccagccccaccatcatccccagactgagagccatccagctgacccccggcgagagcagcaagacctggggcagaagcagcgtggtgcccaaggaggagggcgaggaggaggagaagagagcccccaagaagaagggcagaacctggggccccggcaccctgggccagaaggagctggccagcggcgacgagggcctgaagagcctggtggacggctacaagcagtggagcagcagcgcccccaacctggtgaagggccccagaagcagccccgccctgcccggcttcaccagcctgatggagatggcctgcttcagcagcaccctggtgatcttcaccgaggacgaggacagcgagggccccggcagcggcgagagcagactgcagcacagccccagccagagctacctgtgcatccccttccccagaggcgaggacggcgacggccccagcagcgacggcatccacgaggagcccacccccgtgaacagcgccaccagcaccccccagctgacccccaccaacagcctgaagagaggcggcgcccaccacagaagatgcgaggtggccctgctgggctgcggcgccgtgctggccgccaccggcctgggcttcgacctgctggaggccggcaagtgccagctgctgcccctggaggagcccgagccccccgccagagaggagaagaagagaagagagggcctgttccagagaagcagcagacccagaagaagcaccagcccccccagcagaaagctgttcaagaaggaggagcccatgctgctgctgggcgaccccagcgccagcctgaccctgctgagcctgagcagcatcagcgagtgcaacagcaccagaagcctgctgagaagcgacagcgacgagatcgtggtgtacgagatgcccgtgagccccgtggaggccccccccctgagcccctgcacccacaaccccctggtgaacgtgagagtggagagattcaagagagaccccaaccagagcctgacccccacccacgtgaccctgaccacccccagccagcccagcagccacagaagaacccccagcgacggcgccctgaagcccgagaccctgctggccagcagaagccccagcagcaacggcctgagccccagccccggcgccggcatgctgaagacccccagccccagcagagaccccggcgagttccccagactgcccgaccccaacgtggtgttcccccccacccccagaagatggaacacccagcaggacagcaccctggagagacccaagaccctggagttcctgcccagacccagacccagcgccaacagacagagactggacccctggtggttcgtgagccccagccacgccagaagcaccagccccgccaacagcagcagcaccgagacccccagcaacctggacagctgcttcgccagcagcagcagcaccgtggaggagagacccggcctgcccgccctgctgcccttccaggccggccccctgccccccaccgagagaaccctgctggacctggacgccgagggccagagccaggacagcaccgtgcccctgtgcagagccgagctgaacacccacagacccgccccctacgagatccagcaggagttctggagctag

SEQ ID NO: 89404 - DNA, 3315 bp, Artificial Sequence
  Description of Artificial Sequence: Synthetic coding sequence
atggagcccagcagagccctgctgggctgcctggccagcgccgccgccgccgccccccccggcgaggacggcgccggcgccggcgccgaggaggaggaggaggaggaggaggaggccgccgccgccgtgggccccggcgagctgggctgcgacgcccccctgccctactggaccgccgtgttcgagtacgaggccgccggcgaggacgagctgaccctgagactgggcgacgtggtggaggtgctgagcaaggacagccaggtgagcggcgacgagggctggtggaccggccagctgaaccagagagtgggcatcttccccagcaactacgtgacccccagaagcgccttcagcagcagatgccagcccggcggcgaggaccccagctgctacccccccatccagctgctggagatcgacttcgccgagctgaccctggaggagatcatcggcatcggcggcttcggcaaggtgtacagagccttctggatcggcgacgaggtggccgtgaaggccgccagacacgaccccgacgaggacatcagccagaccatcgagaacgtgagacaggaggccaagctgttcgccatgctgaagcaccccaacatcatcgccctgagaggcgtgtgcctgaaggagcccaacctgtgcctggtgatggagttcgccagaggcggccccctgaacagagtgctgagcggcaagagaatcccccccgacatcctggtgaactgggccgtgcagatcgccagaggcatgaactacctgcacgacgaggccatcgtgcccatcatccacagagacctgaagagcagcaacatcctgatcctgcagaaggtggagaacggcgacctgagcaacaagatcctgaagatcaccgacttcggcctggccagagagtggcacagaaccaccaagatgagcgccgccggcacctacgcctggatggcccccgaggtgatcagagccagcatgttcagcaagggcagcgacgtgtggagctacggcgtgctgctgtgggagctgctgaccggcgaggtgcccttcagaggcatcgacggcctggccgtggcctacggcgtggccatgaacaagctggccctgcccatccccagcacctgccccgagcccttcgccaagctgatggaggactgctggaaccccgacccccacagcagacccagcttcaccaacatcctggaccagctgaccaccatcgaggagagcggcttcttcgagatgcccaaggacagcttccactgcctgcaggacaactggaagcacgagatccaggagatgttcgaccagctgagagccaaggagaaggagctgagaacctgggaggaggagctgaccagagccgccctgcagcagaagaaccaggaggagctgctgagaagaagagagcaggagctggccgagagagagatcgacatcctggagagagagctgaacatcatcatccaccagctgtgccaggagaagcccagagtgaagaagagaaagggcaagttcagaaagagcagactgaagctgaaggacggcaacagaatcagcctgcccagcgacttccagcacaagttcaccgtgcaggccagccccaccatggacaagagaaagagcctgatcaacagcagaagcagcccccccgccagccccaccatcatccccagactgagagccatccagctgacccccggcgagagcagcaagacctggggcagaagcagcgtggtgcccaaggaggagggcgaggaggaggagaagagagcccccaagaagaagggcagaacctggggccccggcaccctgggccagaaggagctggccagcggcgacgagggcagcccccagagaagagagaaggccaacggcctgagcacccccagcgagagcccccacttccacctgggcctgaagagcctggtggacggctacaagcagtggagcagcagcgcccccaacctggtgaagggccccagaagcagccccgccctgcccggcttcaccagcctgatggagatggaggacgaggacagcgagggccccggcagcggcgagagcagactgcagcacagccccagccagagctacctgtgcatccccttccccagaggcgaggacggcgacggccccagcagcgacggcatccacgaggagcccacccccgtgaacagcgccaccagcaccccccagctgacccccaccaacagcctgaagagaggcggcgcccaccacagaagatgcgaggtggccctgctgggctgcggcgccgtgctggccgccaccggcctgggcttcgacctgctggaggccggcaagtgccagctgctgcccctggaggagcccgagccccccgccagagaggagaagaagagaagagagggcctgttccagagaagcagcagacccagaagaagcaccagcccccccagcagaaagctgttcaagaaggaggagcccatgctgctgctgggcgaccccagcgccagcctgaccctgctgagcctgagcagcatcagcgagtgcaacagcaccagaagcctgctgagaagcgacagcgacgagatcgtggtgtacgagatgcccgtgagccccgtggaggccccccccctgagcccctgcacccacaaccccctggtgaacgtgagagtggagagattcaagagagaccccaaccagagcctgacccccacccacgtgaccctgaccacccccagccagcccagcagccacagaagaacccccagcgacggcgccctgaagcccgagaccctgctggccagcagaagccccagcagcaacggcctgagccccagccccggcgccggcatgctgaagacccccagccccagcagagaccccggcgagttccccagactgcccgaccccaacgtggtgttcccccccacccccagaagatggaacacccagcaggacagcaccctggagagacccaagaccctggagttcctgcccagacccagacccagcgccaacagacagagactggacccctggtggttcgtgagccccagccacgccagaagcaccagccccgccaacagcagcagcaccgagacccccagcaacctggacagctgcttcgccagcagcagcagcaccgtggaggagagacccggcctgcccgccctgctgcccttccaggccggccccctgccccccaccgagagaaccctgctggacctggacgccgagggccagagccaggacagcaccgtgcccctgtgcagagccgagctgaacacccacagacccgccccctacgagatccagcaggagttctggagctag

SEQ ID NO: 89405 - DNA, 1005 bp, Artificial Sequence
  Description of Artificial Sequence: Synthetic coding sequence
atggccctgagatggggcatcgtgagcgtgggcctgatcagcagcgacttcaccgccgtgctgcagaccctgcccagaagcgagcaccaggtggtggccgtggccgccagagacctgagcagagccaaggagttcgcccagaagcacgacatccccaaggcctacggcagctacgaggagctggccaaggaccccagcgtggaggtggcctacatcggcacccagcacccccagcacaaggccgccgtgatgctgtgcctggccgccggcaaggccgtgctgtgcgagaagcccaccggcgtgaacgccgccgaggtgagagagatggtggccgaggccagaagcagagccctgttcctgatggaggccatctggaccagattcttccccgccagcgaggccctgagaagcgtgctggcccagggcaccctgggcgacctgagagtggccagagccgagttcggcaagaacctgatccacgtgcccagagccgtggacagagcccaggccggcggcgccctgctggacatcggcatctactgcgtgcagttcaccagcatggtgttcggcggccagaagcccgagaagatcagcgtggtgggcagaagacacgagaccggcgtggacgacaccgtgaccgtgctgctgcagtaccccggcgaggtgcacggcagcttcacctgcagcatcaccgtgcagctgagcaacaccgccagcgtgagcggcaccaagggcatggtgcagctgctgaacccctgctggtgccccaccgagctggtggtgaagggcgagcacaaggagttccccctgccccccgtgcccaaggactgcaacttcgacaacggcgccggcatgagctacgaggccaagcacgtgtgggagtgcctgagaaagggcatgaaggagagccccgtgatccccctgagcgagagcgagctgctggccgacatcctggaggaggtgagaaaggccatcggcgtgaccttcccccaggacaagagatag

SEQ ID NO: 89406 - DNA, 2466 bp, Artificial Sequence
  Description of Artificial Sequence: Synthetic coding sequence
atggacgtggtggaccccgacatcttcaacagagaccccagagaccactacgacctgctgcagagactgggcggcggcacctacggcgaggtgttcaaggccagagacaaggtgagcggcgacctggtggccctgaagatggtgaagatggagcccgacgacgacgtgagcaccctgcagaaggagatcctgatcctgaagacctgcagacacgccaacatcgtggcctaccacggcagctacctgtggctgcagaagctgtggatctgcatggagttctgcggcgccggcagcctgcaggacatctaccaggtgaccggcagcctgagcgagctgcagatcagctacgtgtgcagagaggtgctgcagggcctggcctacctgcacagccagaagaagatccacagagacatcaagggcgccaacatcctgatcaacgacgccggcgaggtgagactggccgacttcggcatcagcgcccagatcggcgccaccctggccagaagactgagcttcatcggcaccccctactggatggcccccgaggtggccgccgtggccctgaagggcggctacaacgagctgtgcgacatctggagcctgggcatcaccgccatcgagctggccgagctgcagccccccctgttcgacgtgcaccccctgagagtgctgttcctgatgaccaagagcggctaccagccccccagactgaaggagaagggcaagtggagcgccgccttccacaacttcatcaaggtgaccctgaccaagagccccaagaagagacccagcgccaccaagatgctgagccaccagctggtgagccagcccggcctgaacagaggcctgatcctggacctgctggacaagctgaagaaccccggcaagggccccagcatcggcgacatcgaggacgaggagcccgagctgccccccgccatccccagaagaatcagaagcacccacagaagcagcagcctgggcatccccgacgccgactgctgcagaagacacatggagttcagaaagctgagaggcatggagaccagaccccccgccaacaccgccagactgcagccccccagagacctgagaagcagcagccccagaaagcagctgagcgagagcagcgacgacgactacgacgacgtggacatccccacccccgccgaggacacccccccccccctgccccccaagcccaagttcagaagccccagcgacgagggccccggcagcatgggcgacgacggccagctgagccccggcgtgctggtgagatgcgccagcggccccccccccaacagccccagacccggccccccccccagcaccagcagcccccacctgaccgcccacagcgagcccagcctgtggaacccccccagcagagagctggacaagccccccctgctgccccccaagaaggagaagatgaagagaaagggctgcgccctgctggtgaagctgttcaacggctgccccctgagaatccacagcaccgccgcctggacccaccccagcaccaaggaccagcacctgctgctgggcgccgaggagggcatcttcatcctgaacagaaacgaccaggaggccaccctggagatgctgttccccagcagaaccacctgggtgtacagcatcaacaacgtgctgatgagcctgagcggcaagaccccccacctgtacagccacagcatcctgggcctgctggagagaaaggagaccagagccggcaaccccatcgcccacatcagcccccacagactgctggccagaaagaacatggtgagcaccaagatccaggacaccaagggctgcagagcctgctgcgtggccgagggcgccagcagcggcggccccttcctgtgcggcgccctggagaccagcgtggtgctgctgcagtggtaccagcccatgaacaagttcctgctggtgagacaggtgctgttccccctgcccacccccctgagcgtgttcgccctgctgaccggccccggcagcgagctgcccgccgtgtgcatcggcgtgagccccggcagacccggcaagagcgtgctgttccacaccgtgagattcggcgccctgagctgctggctgggcgagatgagcaccgagcacagaggccccgtgcaggtgacccaggtggaggaggacatggtgatggtgctgatggacggcagcgtgaagctggtgacccccgagggcagccccgtgagaggcctgagaacccccgagatccccatgaccgaggccgtggaggccgtggccatggtgggcggccagctgcaggccttctggaagcacggcgtgcaggtgtgggccctgggcagcgaccagctgctgcaggagctgagagaccccaccctgaccttcagactgctgggcagccccagacccgtggtggtggagaccagacccgtggacgaccccaccgcccccagcaacctgtacatccaggagtag

SEQ ID NO: 89407 - DNA, 720 bp, Artificial Sequence
  Description of Artificial Sequence: Synthetic coding sequence
atggagttcagaaagctgagaggcatggagaccagaccccccgccaacaccgccagactgcagccccccagagacctgagaagcagcagccccagaaagcagctgagcgagagcagcgacgacgactacgacgacgtggacatccccacccccgccgaggacacccccccccccctgccccccaagcccaagttcagaagccccagcgacgagggccccggcagcatgggcgacgacggccagctgagccccggcgtgctggtgagatgcgccagcggccccccccccaacagccccagacccggccccccccccagcaccagcagcccccacctgaccgcccacagcgagcccagcctgtggaacccccccagcagagagctggacaagccccccctgctgccccccaagaaggagaagatgaagagaaagggctgcgccctgctggtgaagctgttcaacggctgccccctgagaatccacagcaccgccgcctggacccaccccagcaccaaggaccagcacctgctgctgggcgccgaggagggcatcttcatcctgaacagaaacgaccaggaggccaccctggagatggagagaccccccacctgcatcctgatcgccagcctggcctgctggaacggcaagagacccgagcaggagacccccagcctgaccctggcccccaccgcctactggcagggcaccagcagccagtag

SEQ ID NO: 89408 - DNA, 2502 bp, Artificial Sequence
  Description of Artificial Sequence: Synthetic coding sequence
atggacgtggtggaccccgacatcttcaacagagaccccagagaccactacgacctgctgcagagactgggcggcggcacctacggcgaggtgttcaaggccagagacaaggtgagcggcgacctggtggccctgaagatggtgaagatggagcccgacgacgacgtgagcaccctgcagaaggagatcctgatcctgaagacctgcagacacgccaacatcgtggcctaccacggcagctacctgtggctgcagaagctgtggatctgcatggagttctgcggcgccggcagcctgcaggacatctaccaggtgaccggcagcctgagcgagctgcagatcagctacgtgtgcagagaggtgctgcagggcctggcctacctgcacagccagaagaagatccacagagacatcaagggcgccaacatcctgatcaacgacgccggcgaggtgagactggccgacttcggcatcagcgcccagatcggcgccaccctggccagaagactgagcttcatcggcaccccctactggatggcccccgaggtggccgccgtggccctgaagggcggctacaacgagctgtgcgacatctggagcctgggcatcaccgccatcgagctggccgagctgcagccccccctgttcgacgtgcaccccctgagagtgctgttcctgatgaccaagagcggctaccagccccccagactgaaggagaagggcaagtggagcgccgccttccacaacttcatcaaggtgaccctgaccaagagccccaagaagagacccagcgccaccaagatgctgagccaccagctggtgagccagcccggcctgaacagaggcctgatcctggacctgctggacaagctgaagaaccccggcaagggccccagcatcggcgacatcgaggacgaggagcccgagctgccccccgccatccccagaagaatcagaagcacccacagaagcagcagcctgggcatccccgacgccgactgctgcagaagacacatggagttcagaaagctgagaggcatggagaccagaccccccgccaacaccgccagactgcagccccccagagacctgagaagcagcagccccagaaagcagctgagcgagagcagcgacgacgactacgacgacgtggacatccccacccccgccgaggacacccccccccccctgccccccaagcccaagttcagaagccccagcgacgagggccccggcagcatgggcgacgacggccagctgagccccggcgtgctggtgagatgcgccagcggccccccccccaacagccccagacccggccccccccccagcaccagcagcccccacctgaccgcccacagcgagcccagcctgtggaacccccccagcagagagctggacaagccccccctgctgccccccaagaaggagaagatgaagagaaagggctgcgccctgctggtgaagctgttcaacggctgccccctgagaatccacagcaccgccgcctggacccaccccagcaccaaggaccagcacctgctgctgggcgccgaggagggcatcttcatcctgaacagaaacgaccaggaggccaccctggagatgctgttccccagcagaaccacctgggtgtacagcatcaacaacgtgctgatgagcctgagcggcaagaccccccacctgtacagccacagcatcctgggcctgctggagagaaaggagaccagagccggcaaccccatcgcccacatcagcccccacagactgctggccagaaagaacatggtgagcaccaagatccaggacaccaagggctgcagagcctgctgcgtggccgagggcgccagcagcggcggccccttcctgtgcggcgccctggagaccagcgtggtgctgctgcagtggtaccagcccatgaacaagttcctgctggtgagacaggtgctgttccccctgcccacccccctgagcgtgttcgccctgctgaccggccccggcagcgagctgcccgccgtgtgcatcggcgtgagccccggcagacccggcaagagcgtgctgttccacaccgtgagattcggcgccctgagctgctggctgggcgagatgagcaccgagcacagaggccccgtgcaggtgacccaggtggaggaggacatggtgatggtgctgatggacggcagcgtgaagctggtgacccccgagggcagccccgtgagaggcctgagaacccccgagatccccatgaccgaggccgtggaggccgtggccatggtgggcggccagctgcaggccttctggaagcacggcgtgcaggtgtgggccctgggcagcgaccagctgctgcaggagctgagagaccccaccctgaccttcagactgctgggcagccccagactggagtgcagcggcaccatcagcccccactgcaacctgctgctgcccggcagcagcaacagccccgccagcgccagcagagtggccggcatcaccggcctgtag

SEQ ID NO: 89409 - DNA, 2463 bp, Artificial Sequence
  Description of Artificial Sequence: Synthetic coding sequence
atggccctgctgagagacgtgagcctgcaggaccccagagacagattcgagctgctgcagagagtgggcgccggcacctacggcgacgtgtacaaggccagagacaccgtgaccagcgagctggccgccgtgaagatcgtgaagctggaccccggcgacgacatcagcagcctgcagcaggagatcaccatcctgagagagtgcagacaccccaacgtggtggcctacatcggcagctacctgagaaacgacagactgtggatctgcatggagttctgcggcggcggcagcctgcaggagatctaccacgccaccggccccctggaggagagacagatcgcctacgtgtgcagagaggccctgaagggcctgcaccacctgcacagccagggcaagatccacagagacatcaagggcgccaacctgctgctgaccctgcagggcgacgtgaagctggccgacttcggcgtgagcggcgagctgaccgccagcgtggccaagagaagaagcttcatcggcaccccctactggatggcccccgaggtggccgccgtggagagaaagggcggctacaacgagctgtgcgacgtgtgggccctgggcatcaccgccatcgagctgggcgagctgcagccccccctgttccacctgcaccccatgagagccctgatgctgatgagcaagagcagcttccagccccccaagctgagagacaagaccagatggacccagaacttccaccacttcctgaagctggccctgaccaagaaccccaagaagagacccaccgccgagaagctgctgcagcaccccttcaccacccagcagctgcccagagccctgctgacccagctgctggacaaggccagcgacccccacctgggcacccccagccccgaggactgcgagctggagacctacgacatgttccccgacaccatccacagcagaggccagcacggccccgccgagagaacccccagcgagatccagttccaccaggtgaagttcggcgcccccagaagaaaggagaccgaccccctgaacgagccctgggaggaggagtggaccctgctgggcaaggaggagctgagcggcagcctgctgcagagcgtgcaggaggccctggaggagagaagcctgaccatcagaagcgccagcgagttccaggagctggacagccccgacgacaccatgggcaccatcaagagagcccccttcctgggccccctgcccaccgacccccccgccgaggagcccctgagcagcccccccggcaccctgccccccccccccagcggccccaacagcagccccctgctgcccaccgcctgggccaccatgaagcagagagaggaccccgagagaagcagctgccacggcctgccccccacccccaaggtgcacatgggcgcctgcttcagcaaggtgttcaacggctgccccctgagaatccacgccgccgtgacctggatccaccccgtgaccagagaccagttcctggtggtgggcgccgaggagggcatctacaccctgaacctgcacgagctgcacgaggacaccctggagaagctgatcagccacagatgcagctggctgtactgcgtgaacaacgtgctgctgagcctgagcggcaagagcacccacatctgggcccacgacctgcccggcctgttcgagcagagaagactgcagcagcaggtgcccctgagcatccccaccaacagactgacccagagaatcatccccagaagattcgccctgagcaccaagatccccgacaccaagggctgcctgcagtgcagagtggtgagaaacccctacaccggcgccaccttcctgctggccgccctgcccaccagcctgctgctgctgcagtggtacgagcccctgcagaagttcctgctgctgaagaacttcagcagccccctgcccagccccgccggcatgctggagcccctggtgctggacggcaaggagctgccccaggtgtgcgtgggcgccgagggccccgagggccccggctgcagagtgctgttccacgtgctgcccctggaggccggcctgacccccgacatcctgatcccccccgagggcatccccggcagcgcccagcaggtgatccaggtggacagagacaccatcctggtgagcttcgagagatgcgtgagaatcgtgaacatgcagggcgagcccaccgccaccctggcccccgagctgaccttcgacttccccatcgagaccgtggtgtgcctgcaggacagcgtgctggccttctggagccacggcatgcagggcagaagcctggacaccaacgaggtgacccaggagatcaccgacgagaccagaatcttcagagtgctgggcgcccacagagacatcatcctggagagcatccccaccgacaaccccgaggcccacagcaacctgtacatcctgaccggccaccagagcacctactag

SEQ ID NO: 89410 - DNA, 2541 bp, Artificial Sequence
  Description of Artificial Sequence: Synthetic coding sequence
atggaggcccccctgagacccgccgccgacatcctgagaagaaacccccagcaggactacgagctggtgcagagagtgggcagcggcacctacggcgacgtgtacaaggccagaaacgtgcacaccggcgagctggccgccgtgaagatcatcaagctggagcccggcgacgacttcagcctgatccagcaggagatcttcatggtgaaggagtgcaagcactgcaacatcgtggcctacttcggcagctacctgagcagagagaagctgtggatctgcatggagtactgcggcggcggcagcctgcaggacatctaccacgtgaccggccccctgagcgagctgcagatcgcctacgtgtgcagagagaccctgcagggcctggcctacctgcacaccaagggcaagatgcacagagacatcaagggcgccaacatcctgctgaccgaccacggcgacgtgaagctggccgacttcggcgtggccgccaagatcaccgccaccatcgccaagagaaagagcttcatcggcaccccctactggatggcccccgaggtggccgccgtggagaagaacggcggctacaaccagctgtgcgacatctgggccgtgggcatcaccgccatcgagctgggcgagctgcagccccccatgttcgacctgcaccccatgagagccctgttcctgatgagcaagagcaacttccagccccccaagctgaaggacaagaccaagtggagcagcaccttccacaacttcgtgaagatcgccctgaccaagaaccccaagaagagacccaccgccgagagactgctgacccacaccttcgtggcccagcccggcctgagcagagccctggccgtggagctgctggacaaggtgaacaaccccgacaaccacgcccactacaccgaggccgacgacgacgacttcgagccccacgccatcatcagacacaccatcagaagcaccaacagaaacgccagagccgagagaaccgccagcgagatcaacttcgacaagctgcagttcgagccccccctgagaaaggagaccgaggccagagacgagatgggcctgagcagcgaccccaacttcatgctgcagtggaaccccttcgtggacggcgccaacaccggcaagagcaccagcaagagagccatccccccccccctgccccccaagcccagaatcagcagctaccccgaggacaacttccccgacgaggagaaggccagcaccatcaagcactgccccgacagcgagagcagagccccccagatcctgagaagacagagcagccccagctgcggccccgtggccgagaccagcagcatcggcaacggcgacggcatcagcaagctgatgagcgagaacaccgagggcagcgcccaggccccccagctgcccagaaagaaggacaagagagacttccccaagcccgccatcaacggcctgccccccacccccaaggtgctgatgggcgcctgcttcagcaaggtgttcgacggctgccccctgaagatcaactgcgccaccagctggatccaccccgacaccaaggaccagtacatcatcttcggcaccgaggacggcatctacaccctgaacctgaacgagctgcacgaggccaccatggagcagctgttccccagaaagtgcacctggctgtacgtgatcaacaacaccctgatgagcctgagcgtgggcaagaccttccagctgtacagccacaacctgatcgccctgttcgagcacgccaagaagcccggcctggccgcccacatccagacccacagattccccgacagaatcctgcccagaaagttcgccctgaccaccaagatccccgacaccaagggctgccacaagtgctgcatcgtgagaaacccctacaccggccacaagtacctgtgcggcgccctgcagagcggcatcgtgctgctgcagtggtacgagcccatgcagaagttcatgctgatcaagcacttcgacttccccctgcccagccccctgaacgtgttcgagatgctggtgatccccgagcaggagtaccccatggtgtgcgtggccatcagcaagggcaccgagagcaaccaggtggtgcagttcgagaccatcaacctgaacagcgccagcagctggttcaccgagatcggcgccggcagccagcagctggacagcatccacgtgacccagctggagagagacaccgtgctggtgtgcctggacaagttcgtgaagatcgtgaacctgcagggcaagctgaagagcagcaagaagctggccagcgagctgagcttcgacttcagaatcgagagcgtggtgtgcctgcaggacagcgtgctggccttctggaagcacggcatgcagggcaagagcttcaagagcgacgaggtgacccaggagatcagcgacgagaccagagtgttcagactgctgggcagcgacagagtggtggtgctggagagcagacccaccgagaaccccaccgcccacagcaacctgtacatcctggccggccacgagaacagctactag

SEQ ID NO: 89411 - DNA, 699 bp, Artificial Sequence
  Description of Artificial Sequence: Synthetic coding sequence
atggccaccgccgagagcagagccctgcagttcgccgagggcgccgccttccccgcctacagagccccccacgccggcggcgccctgctgcccccccccagccccgccgccgccctgctgcccgccccccccgccggccccggccccgccaccttcgccggcttcctgggcagagaccccggccccgccccccccccccccgccagcctgggcagccccgccccccccaagggcgccgccgcccccagcgccagccagagaagaaagagaaccagcttcagcgccgagcagctgcagctgctggagctggtgttcagaagaaccagataccccgacatccacctgagagagagactggccgccctgaccctgctgcccgagagcagaatccaggtgtggttccagaacagaagagccaagagcagaagacagagcggcaagagcttccagcccctggccagacccgagatcatcctgaaccactgcgcccccggcaccgagaccaagtgcctgaagccccagctgcccctggaggtggacgtgaactgcctgcccgagcccaacggcgtgggcggcggcatcagcgacagcagcagccagggccagaacttcgagacctgcagccccctgagcgaggacatcggcagcaagctggacagctgggaggagcacatcttcagcgccttcggcaacttctag

SEQ ID NO: 89412 - DNA, 723 bp, Artificial Sequence
  Description of Artificial Sequence: Synthetic coding sequence
atggccaccgccgagagcagagccctgcagttcgccgagggcgccgccttccccgcctacagagccccccacgccggcggcgccctgctgcccccccccagccccgccgccgccctgctgcccgccccccccgccggccccggccccgccaccttcgccggcttcctgggcagagaccccggccccgccccccccccccccgccagcctgggcagccccgccccccccaagggcgccgccgcccccagcgccagccagagaagaaagagaaccagcttcagcgccgagcagctgcagctgctggagctggtgttcagaagaaccagataccccgacatccacctgagagagagactggccgccctgaccctgctgcccgagagcagaatccagctgctgttcagccccctgttccaggtgtggttccagaacagaagagccaagagcagaagacagagcggcaagagcttccagcccctggccagacccgagatcatcctgaaccactgcgcccccggcaccgagaccaagtgcctgaagccccagctgcccctggaggtggacgtgaactgcctgcccgagcccaacggcgtgggcggcggcatcagcgacagcagcagccagggccagaacttcgagacctgcagccccctgagcgaggacatcggcagcaagctggacagctgggaggagcacatcttcagcgccttcggcaacttctag

SEQ ID NO: 89413 - DNA, 882 bp, Artificial Sequence
  Description of Artificial Sequence: Synthetic coding sequence
atggccaccttcagcggccccgccggccccatcctgagcctgaacccccaggaggacgtggagttccagaaggaggtggcccaggtgagaaagagaatcacccagagaaagaagcaggagcagctgacccccggcgtggtgtacgtgagacacctgcccaacctgctggacgagacccagatcttcagctacttcagccagttcggcaccgtgaccagattcagactgagcagaagcaagagaaccggcaacagcaagggctacgccttcgtggagttcgagagcgaggacgtggccaagatcgtggccgagaccatgaacaactacctgttcggcgagagactgctggagtgccacttcatgccccccgagaaggtgcacaaggagctgttcaaggactggaacatccccttcaagcagcccagctaccccagcgtgaagagatacaacagaaacagaaccctgacccagaagctgagaatggaggagagattcaagaagaaggagagactgctgagaaagaagctggccaagaagggcatcgactacgacttccccagcctgatcctgcagaagaccgagagcatcagcaagaccaacagacagaccagcaccaagggccaggtgctgagaaagaagaagaagaaggtgagcggcaccctggacacccccgagaagaccgtggacagccagggccccacccccgtgtgcacccccaccttcctggagagaagaaagagccaggtggccgagctgaacgacgacgacaaggacgacgagatcgtgttcaagcagcccatcagctgcgtgaaggaggagatccaggagacccagacccccacccacagcagaaagaagagaagaagaagcagcaaccagtag

SEQ ID NO: 89414 - DNA, 1257 bp, Artificial Sequence
  Description of Artificial Sequence: Synthetic coding sequence
atggcccccagaggcagaagaagacccagaccccacagaagcgagggcgccagaagaagcaagaacaccctggagagaacccacagcatgaaggacaaggccggccagaagtgcaagcccatcgacgtgttcgacttccccgacaacagcgacgtgagcagcatcggcagactgggcgagaacgagaaggacgaggagacctacgagaccttcgacccccccctgcacagcaccgccatctacgccgacgaggaggagttcagcaagcactgcggcctgagcctgagcagcaccccccccggcaaggaggccaagagaagcagcgacaccagcggcaacgaggccagcgagatcgagagcgtgaagatcagcgccaagaagcccggcagaaagctgagacccatcagcgacgacagcgagagcatcgaggagagcgacaccagaagaaaggtgaagagcgccgagaagatcagcacccagagacacgaggtgatcagaaccaccgccagcagcgagctgagcgagaagcccgccgagagcgtgaccagcaagaagaccggccccctgagcgcccagcccagcgtggagaaggagaacctggccatcgagagccagagcaagacccagaagaagggcaagatcagccacgacaagagaaagaagagcagaagcaaggccatcggcagcgacaccagcgacatcgtgcacatctggtgccccgagggcatgaagaccagcgacatcaaggagctgaacatcgtgctgcccgagttcgagaagacccacctggagcaccagcagagaatcgagagcaaggtgtgcaaggccgccatcgccaccttctacgtgaacgtgaaggagcagttcatcaagatgctgaaggagagccagatgctgaccaacctgaagagaaagaacgccaagatgatcagcgacatcgagaagaagagacagagaatgatcgaggtgcaggacgagctgctgagactggagccccagctgaagcagctgcagaccaagtacgacgagctgaaggagagaaagagcagcctgagaaacgccgcctacttcctgagcaacctgaagcagctgtaccaggactacagcgacgtgcaggcccaggagcccaacgtgaaggagacctacgacagcagcagcctgcccgccctgctgttcaaggccagaaccctgctgggcgccgagagccacctgagaaacatcaaccaccagctggagaagctgctggaccagggctag

SEQ ID NO: 89415 - DNA, 963 bp, Artificial Sequence
  Description of Artificial Sequence: Synthetic coding sequence
atggcccccagaggcagaagaagacccagaccccacagaagcgagggcgccagaagaagcaagaacaccctggagagaacccacagcatgaaggacaaggccggccagaagtgcaagcccatcgacgtgttcgacttccccgacaacagcgacgtgagcagcatcggcagactgggcgagaacgagaaggacgaggagacctacgagaccttcgacccccccctgcacagcaccgccatctacgccgacgaggaggagttcagcaagcactgcggcctgagcctgagcagcaccccccccggcaaggaggccaagagaagcagcgacaccagcggcaacgaggccagcgagatcgagagcgtgaagatcagcgccaagaagcccggcagaaagctgagacccatcagcgacgacagcgagagcatcgaggagagcgacaccagaagaaaggtgaagagcgccgagaagatcagcacccagagacacgaggtgatcagaaccaccgccagcagcgagctgagcgagaagcccgccgagagcgtgaccagcaagaagaccggccccctgagcgcccagcccagcgtggagaaggagaacctggccatcgagagccagagcaagacccagaagaagggcaagatcagccacgacaagagaaagaagagcagaagcaaggccatcggcagcgacaccagcgacatcgtgcacatctggtgccccgagggcatgaagaccagcgacatcaaggagctgaacatcgtgctgcccgagttcgagaagacccacctggagcaccagcagagaatcgagagcaaggtgtgcaaggccgccatcgccaccttctacgtgaacgtgaaggagcagttcatcaagatgctgaaggagagccagatgctgaccaacctgaagagaaagaacgccaaggtgagagccaccgccgagaccaccaccaacaagatctag

SEQ ID NO: 89416 - DNA, 963 bp, Artificial Sequence
  Description of Artificial Sequence: Synthetic coding sequence
atggcccccagaggcagaagaagacccagaccccacagaagcgagagcgccagaagaagcaagaacaccctggagagaacccacagcatgaaggacaaggccggccagaagtgcaagcccatcgacgtgttcgacttccccgacaacagcgacgtgagcagcatcggcagactgggcgagaacgagaaggacgaggagacctacgagaccttcgacccccccctgcacagcaccgccatctacgccgacgaggaggagttcagcaagcactgcggcctgagcctgagcagcaccccccccggcaaggaggccaagagaagcagcgacaccagcggcaacgaggccagcgagatcgagagcgtgaagatcagcgccaagaagcccggcagaaagctgagacccatcagcgacgacagcgagagcatcgaggagagcgacaccagaagaaaggtgaagagcgccgagaagatcagcacccagagacacgaggtgatcagaaccaccgccagcagcgagctgagcgagaagcccgccgagagcgtgaccagcaagaagaccggccccctgagcgcccagcccagcgtggagaaggagaacctggccatcgagagccagagcaagacccagaagaagggcaagatcagccacgacaagagaaagaagagcagaagcaaggccatcggcagcgacaccagcgacatcgtgcacatctggtgccccgagggcatgaagaccagcgacatcaaggagctgaacatcgtgctgcccgagttcgagaagacccacctggagcaccagcagagaatcgagagcaaggtgtgcaaggccgccatcgccaccttctacgtgaacgtgaaggagcagttcatcaagatgctgaaggagagccagatgctgaccaacctgaagagaaagaacgccaaggtgagagccaccgccgagaccaccaccaacaagatctag

SEQ ID NO: 89417 - DNA, 1014 bp, Artificial Sequence
  Description of Artificial Sequence: Synthetic coding sequence
atggcccccagaggcagaagaagacccagaccccacagaagcgagggcgccagaagaagcaagaacaccctggagagaacccacagcatgaaggacaaggccggccagaagtgcaagcccatcgacgtgttcgacttccccgacaacagcgacgtgagcagcatcggcagactgggcgagaacgagaaggacgaggagacctacgagaccttcgacccccccctgcacagcaccgccatctacgccgacgaggaggagttcagcaagcactgcggcctgagcctgagcagcaccccccccggcaaggaggccaagagaagcagcgacaccagcggcaacgaggccagcgagatcgagagcgtgaagatcagcgccaagaagcccggcagaaagctgagacccatcagcgacgacagcgagagcatcgaggagagcgacaccagaagaaaggtgaagagcgccgagaagatcagcacccagagacacgaggtgatcagaaccaccgccagcagcgagctgagcgagaagcccgccgagagcgtgaccagcaagaagaccggccccctgagcgcccagcccagcgtggagaaggagaacctggccatcgagagccagagcaagacccagaagaagggcaagatcagccacgacaagagaaagaagagcagaagcaaggccatcggcagcgacaccagcgacatcgtgcacatctggtgccccgagggcatgaagaccagcgacatcaaggagctgaacatcgtgctgcccgagttcgagaagacccacctggagcaccagcagagaatcgagagcaaggtgtgcaaggccgccatcgccaccttctacgtgaacgtgaaggagcagttcatcaagatgctgaaggagagccagatgctgaccaacctgaagagaaagaacgccaagatgatcagcgacatcgagaagaagagacagagaatgatcgaggtgcaggacgagctgctgagactgtggaccggcgccggcctgtggtag

SEQ ID NO: 89418 - DNA, 2760 bp, Artificial Sequence
  Description of Artificial Sequence: Synthetic coding sequence
atggccgccgacgtgttcatgtgcagccccagaagacccagaagcagaggcagacaggtgctgctgaagccccaggtgagcgaggacgacgacgacagcgacaccgacgagcccagccccccccccgccagcggcgccgccacccccgccagagcccacgccagcgccgccccccccccccccagagccggccccggcagagaggagccccccagaagacagcagatcatccacagcggccacttcatggtgagcagcccccacagagagcacccccccaagaagggctacgacttcgacaccgtgaacaagcagacctgccagacctacagcttcggcaagaccagcagctgccacctgagcatcgacgccagcctgaccaagctgttcgagtgcatgaccctggcctacagcggcaagctggtgagccccaagtggaagaacttcaagggcctgaagctgcagtggagagacaagatcagactgaacaacgccatctggagagcctggtacatgcagtacctggagaagagaaagaaccccgtgtgccacttcgtgacccccctggacggcagcgtggacgtggacgagcacagaagacccgaggccatcaccaccgagggcaagtactggaagagcagaatcgagatcgtgatcagagagtaccacaagtggagaacctacttcaagaagagactgcagcagcacaaggacgaggacctgagcagcctggtgcaggacgacgacatgctgtactggcacaagcacggcgacggctggaagacccccgtgcccatggaggaggaccccctgctggacaccgacatgctgatgagcgagttcagcgacaccctgttcagcaccctgagcagccaccagcccgtggcctggcccaaccccagagagatcgcccacctgggcaacgccgacatgatccagcccggcctgatccccctgcagcccaacctggacttcatggacaccttcgagcccttccaggacctgttcagcagcagcagaagcatcttcggcagcatgctgcccgccagcgccagcgcccccgtgcccgaccccaacaacccccccgcccaggagagcatcctgcccaccaccgccctgcccaccgtgagcctgcccgacagcctgatcgccccccccaccgcccccagcctggcccacatggacgagcagggctgcgagcacaccagcagaaccgaggaccccttcatccagcccaccgacttcggccccagcgagccccccctgagcgtgccccagcccttcctgcccgtgttcaccatgcccctgctgagccccagccccgcccccccccccatcagccccgtgctgcccctggtgcccccccccgccaccgccctgaacccccccgccccccccaccttccaccagccccagaagttcgccggcgtgaacaaggcccccagcgtgatcacccacaccgccagcgccaccctgacccacgacgcccccgccaccaccttcagccagagccagggcctggtgatcaccacccaccaccccgcccccagcgccgccccctgcggcctggccctgagccccgtgaccagacccccccagcccagactgaccttcgtgcaccccaagcccgtgagcctgaccggcggcagacccaagcagccccacaagatcgtgcccgcccccaagcccgagcccgtgagcctggtgctgaagaacgccagaatcgcccccgccgccttcagcggccagccccaggccgtgatcatgaccagcggccccctgaagagagagggcatgctggccagcaccgtgagccagagcaacgtggtgatcgcccccgccgccatcgccagagcccccggcgtgcccgagttccacagcagcatcctggtgaccgacctgggccacggcaccagcagcccccccgcccccgtgagcagactgttccccagcaccgcccaggaccccctgggcaagggcgagcaggtgcccctgcacggcggcagcccccaggtgaccgtgaccggccccagcagagactgccccaacagcggccaggccagcccctgcgccagcgagcagagccccagcccccagagcccccagaacaactgcagcggcaagagcgaccccaagaacgtggccgccctgaagaacagacagatgaagcacatcagcgccgagcagaagagaagattcaacatcaagatgtgcttcgacatgctgaacagcctgatcagcaacaacagcaagctgaccagccacgccatcaccctgcagaagaccgtggagtacatcaccaagctgcagcaggagagaggccagatgcaggaggaggccagaagactgagagaggagatcgaggagctgaacgccaccatcatcagctgccagcagctgctgcccgccaccggcgtgcccgtgaccagaagacagttcgaccacatgaaggacatgttcgacgagtacgtgaagaccagaaccctgcagaactggaagttctggatcttcagcatcatcatcaagcccctgttcgagagcttcaagggcatggtgagcaccagcagcctggaggagctgcacagaaccgccctgagctggctggaccagcactgcagcctgcccatcctgagacccatggtgctgagcaccctgagacagctgagcaccagcaccagcatcctgaccgaccccgcccagctgcccgagcaggccagcaaggccgtgaccagaatcggcaagagactgggcgagagctag

SEQ ID NO: 89419 - DNA, 657 bp, Artificial Sequence
  Description of Artificial Sequence: Synthetic coding sequence
atggacgagcagggctgcgagcacaccagcagaaccgaggaccccttcatccagcccaccgacttcggccccagcgagccccccctgagcgtgccccccccccccatcagccccgtgctgcccctggtgcccccccccgccaccgccctgaacccccccgccccccccaccttccaccagccccagaagttcgccggcgtgaacaaggcccccagcgtgatcacccacaccgccagcgccaccctgacccacgacgcccccgccaccaccttcagccagagccagggcctggtgatcaccacccaccaccccgcccccagcgccgccccctgcggcctggccctgagccccgtgaccagacccccccagcccagactgaccttcgtgcaccccaagcccgtgagcctgaccggcggcagacccaagcagccccacaagatcgtgcccgcccccaagcccgagcccgtgagcctggtgctgaagaacgccagaatcgcccccggcgagcccggcggcgagacccagtgcggcgccccccccgaccccgagggctgcttccccatccccaaggccttcaagctggtgaccaccaccaccaccctggtgtgcacctgcatgagaacccacatccacctgaacgagaccaaggtgagctag

SEQ ID NO: 89420 - DNA, 1581 bp, Artificial Sequence
  Description of Artificial Sequence: Synthetic coding sequence
atggacgagcagggctgcgagcacaccagcagaaccgaggaccccttcatccagcccaccgacttcggccccagcgagccccccctgagcgtgccccagcccttcctgcccgtgttcaccatgcccctgctgagccccagccccgcccccccccccatcagccccgtgctgcccctggtgcccccccccgccaccgccctgaacccccccgccccccccaccttccaccagccccagaagttcgccggcgtgaacaaggcccccagcgtgatcacccacaccgccagcgccaccctgacccacgacgcccccgccaccaccttcagccagagccagggcctggtgatcaccacccaccaccccgcccccagcgccgccccctgcggcctggccctgagccccgtgaccagacccccccagcccagactgaccttcgtgcaccccaagcccgtgagcctgaccggcggcagacccaagcagccccacaagatcgtgcccgcccccaagcccgagcccgtgagcctggtgctgaagaacgccagaatcgcccccgccgccttcagcggccagccccaggccgtgatcatgaccagcggccccctgaagagagagggcatgctggccagcaccgtgagccagagcaacgtggtgatcgcccccgccgccatcgccagagcccccggcgtgcccgagttccacagcagcatcctggtgaccgacctgggccacggcaccagcagcccccccgcccccgtgagcagactgttccccagcaccgcccaggaccccctgggcaagggcgagcaggtgcccctgcacggcggcagcccccaggtgaccgtgaccggccccagcagagactgccccaacagcggccaggccagcccctgcgccagcgagcagagccccagcccccagagcccccagaacaactgcagcggcaagagcgaccccaagaacgtggccgccctgaagaacagacagatgaagcacatcagcgccgagcagaagagaagattcaacatcaagatgtgcttcgacatgctgaacagcctgatcagcaacaacagcaagctgaccagccacgccatcaccctgcagaagaccgtggagtacatcaccaagctgcagcaggagagaggccagatgcaggaggaggccagaagactgagagaggagatcgaggagctgaacgccaccatcatcagctgccagcagctgctgcccgccaccggcgtgcccgtgaccagaagacagttcgaccacatgaaggacatgttcgacgagtacgtgaagaccagaaccctgcagaactggaagttctggatcttcagcatcatcatcaagcccctgttcgagagcttcaagggcatggtgagcaccagcagcctggaggagctgcacagaaccgccctgagctggctggaccagcactgcagcctgcccatcctgagacccatggtgctgagcaccctgagacagctgagcaccagcaccagcatcctgaccgaccccgcccagctgcccgagcaggccagcaaggccgtgaccagaatcggcaagagactgggcgagagctag

SEQ ID NO: 89421 - DNA, 2559 bp, Artificial Sequence
  Description of Artificial Sequence: Synthetic coding sequence
atggccggcgccctggccggcctggccgccggcctgcaggtgcccagagtggcccccagccccgacagcgacagcgacaccgacagcgaggaccccagcctgagaagaagcgccggcggcctgctgagaagccaggtgatccacagcggccacttcatggtgagcagcccccacagcgacagcctgcccagaagaagagaccaggagggcagcgtgggccccagcgacttcggccccagaagcatcgaccccaccctgaccagactgttcgagtgcctgagcctggcctacagcggcaagctggtgagccccaagtggaagaacttcaagggcctgaagctgctgtgcagagacaagatcagactgaacaacgccatctggagagcctggtacatccagtacgtgaagagaagaaagagccccgtgtgcggcttcgtgacccccctgcagggccccgaggccgacgcccacagaaagcccgaggccgtggtgctggagggcaactactggaagagaagaatcgaggtggtgatgagagagtaccacaagtggagaatctactacaagaagagactgagaaagcccagcagagaggacgacctgctggcccccaagcaggccgagggcagatggcccccccccgagcagtggtgcaagcagctgttcagcagcgtggtgcccgtgctgctgggcgaccccgaggaggagcccggcggcagacagctgctggacctgaactgcttcctgagcgacatcagcgacaccctgttcaccatgacccagagcggccccagccccctgcagctgccccccgaggacgcctacgtgggcaacgccgacatgatccagcccgacctgacccccctgcagcccagcctggacgacttcatggacatcagcgacttcttcaccaacagcagactgccccagccccccatgcccagcaacttccccgagccccccagcttcagccccgtggtggacagcctgttcagcagcggcaccctgggccccgaggtgccccccgccagcagcgccatgacccacctgagcggccacagcagactgcaggccagaaacagctgccccggccccctggacagcagcgccttcctgagcagcgacttcctgctgcccgaggaccccaagcccagactgccccccccccccgtgcccccccccctgctgcactaccccccccccgccaaggtgcccggcctggagccctgcccccccccccccttcccccccatggccccccccaccgccctgctgcaggaggagcccctgttcagccccagattccccttccccaccgtgccccccgcccccggcgtgagccccctgcccgcccccgccgccttcccccccaccccccagagcgtgcccagccccgcccccacccccttccccatcgagctgctgcccctgggctacagcgagcccgccttcggcccctgcttcagcatgcccagaggcaagccccccgcccccagccccagaggccagaaggccagcccccccaccctggcccccgccaccgccagcccccccaccaccgccggcagcaacaacccctgcctgacccagctgctgaccgccgccaagcccgagcaggccctggagccccccctggtgagcagcaccctgctgagaagccccggcagcccccaggagaccgtgcccgagttcccctgcaccttcctgccccccacccccgcccccaccccccccagacccccccccggccccgccaccctggcccccagcagacccctgctggtgcccaaggccgagagactgagcccccccgcccccagcggcagcgagagaagactgagcggcgacctgagcagcatgcccggccccggcaccctgagcgtgagagtgagccccccccagcccatcctgagcagaggcagacccgacagcaacaagaccgagaacagaagaatcacccacatcagcgccgagcagaagagaagattcaacatcaagctgggcttcgacaccctgcacggcctggtgagcaccctgagcgcccagcccagcctgaaggtgagcaaggccaccaccctgcagaagaccgccgagtacatcctgatgctgcagcaggagagagccggcctgcaggaggaggcccagcagctgagagacgagatcgaggagctgaacgccgccatcaacctgtgccagcagcagctgcccgccaccggcgtgcccatcacccaccagagattcgaccagatgagagacatgttcgacgactacgtgagaaccagaaccctgcacaactggaagttctgggtgttcagcatcctgatcagacccctgttcgagagcttcaacggcatggtgagcaccgccagcgtgcacaccctgagacagaccagcctggcctggctggaccagtactgcagcctgcccgccctgagacccaccgtgctgaacagcctgagacagctgggcaccagcaccagcatcctgaccgaccccggcagaatccccgagcaggccaccagagccgtgaccgagggcaccctgggcaagcccctgtag

SEQ ID NO: 89422 - DNA, 2496 bp, Artificial Sequence
  Description of Artificial Sequence: Synthetic coding sequence
atggccggcgccctggccggcctggccgccggcctgcaggtgcccagagtggcccccagccccgacagcgacagcgacaccgacagcgaggaccccagcctgagaagaagcgccggcggcctgctgagaagccaggtgatccacagcggccacttcatggtgagcagcccccacagcgacagcctgcccagaagaagagaccaggagggcagcgtgggccccagcgacttcggccccagaagcatcgaccccaccctgaccagactgttcgagtgcctgagcctggcctacagcggcaagctggtgagccccaagtggaagaacttcaagggcctgaagctgctgtgcagagacaagatcagactgaacaacgccatctggagagcctggtacatccagtacgtgaagagaagaaagagccccgtgtgcggcttcgtgacccccctgcagggccccgaggccgacgcccacagaaagcccgaggccgtggtgctggagggcaactactggaagagaagaatcgaggtggtgatgagagagtaccacaagtggagaatctactacaagaagagactgagaaagcccagcagagaggacgacctgctggcccccaagcaggccgagggcagatggcccccccccgagcagtggtgcaagcagctgttcagcagcgtggtgcccgtgctgctgggcgaccccgaggaggagcccggcggcagacagctgctggacctgaactgcttcctgagcgacatcagcgacaccctgttcaccatgacccagagcggccccagccccctgcagctgccccccgaggacgcctacgtgggcaacgccgacatgatccagcccgacctgacccccctgcagcccagcctggacgacttcatggacatcagcgacttcttcaccaacagcagactgccccagccccccatgcccagcaacttccccgagccccccagcttcagccccgtggtggacagcctgttcagcagcggcaccctgggccccgaggtgccccccgccagcagcgccatgacccacctgagcggccacagcagactgcaggccagaaacagctgccccggccccctggacagcagcgccttcctgagcagcgacttcctgctgcccgaggaccccaagcccagactgccccccccccccgtgcccccccccctgctgcactaccccccccccgccaaggtgcccggcctggagccctgcccccccccccccttcccccccatggccccccccaccgccctgctgcaggaggagcccctgttcagccccagattccccttccccaccgtgccccccgcccccggcgtgagccccctgcccgcccccgccgccttcccccccaccccccagagcgtgcccagccccgcccccacccccttccccatcgagctgctgcccctgggctacagcgagcccgccttcggcccctgcttcagcatgcccagaggcaagccccccgcccccagccccagaggccagaaggccagcccccccaccctggcccccgccaccgccagcccccccaccaccgccggcagcaacaacccctgcctgacccagctgctgaccgccgccaagcccgagcaggccctggagccccccctggtgagcagcaccctgctgagaagccccggcagcccccaggagaccgtgcccgagttcccctgcaccttcctgccccccacccccgcccccaccccccccagacccccccccggccccgccaccctggcccccagcagacccctgctggtgcccaaggccgagagactgagcccccccgcccccagcggcagcgagagaagactgagcggcgacctgagcagcatgcccggccccggcaccctgagcgtgagagtgagccccccccagcccatcctgagcagaggcagacccgacagcaacaagaacagaagaatcacccacatcagcgccgagcagaagagaagattcaacatcaagctgggcttcgacaccctgcacggcctggtgagcaccctgagcgcccagcccagcctgaaggagagagccggcctgcaggaggaggcccagcagctgagagacgagatcgaggagctgaacgccgccatcaacctgtgccagcagcagctgcccgccaccggcgtgcccatcacccaccagagattcgaccagatgagagacatgttcgacgactacgtgagaaccagaaccctgcacaactggaagttctgggtgttcagcatcctgatcagacccctgttcgagagcttcaacggcatggtgagcaccgccagcgtgcacaccctgagacagaccagcctggcctggctggaccagtactgcagcctgcccgccctgagacccaccgtgctgaacagcctgagacagctgggcaccagcaccagcatcctgaccgaccccggcagaatccccgagcaggccaccagagccgtgaccgagggcaccctgggcaagcccctgtag

SEQ ID NO: 89423 - DNA, 2280 bp, Artificial Sequence
  Description of Artificial Sequence: Synthetic coding sequence
atggccggcgccctggccggcctggccgccggcctgcaggtgcccagagtggcccccagccccgacagcgacagcgacaccgacagcgaggaccccagcctgagaagaagcgccggcggcctgctgagaagccaggtgatccacagcggccacttcatggtgagcagcccccacagcgacagcctgcccagaagaagagaccaggagggcagcgtgggccccagcgacttcggccccagaagcatcgaccccaccctgaccagactgttcgagtgcctgagcctggcctacagcggcaagctggtgagccccaagtggaagaacttcaagggcctgaagctgctgtgcagagacaagatcagactgaacaacgccatctggagagcctggtacatccagtacgtgaagagaagaaagagccccgtgtgcggcttcgtgacccccctgcagggccccgaggccgacgcccacagaaagcccgaggccgtggtgctggagggcaactactggaagagaagaatcgagctgccccccgaggacgcctacgtgggcaacgccgacatgatccagcccgacctgacccccctgcagcccagcctggacgacttcatggacatcagcgacttcttcaccaacagcagactgccccagccccccatgcccagcaacttccccgagccccccagcttcagccccgtggtggacagcctgttcagcagcggcaccctgggccccgaggtgccccccgccagcagcgccatgacccacctgagcggccacagcagactgcaggccagaaacagctgccccggccccctggacagcagcgccttcctgagcagcgacttcctgctgcccgaggaccccaagcccagactgccccccccccccgtgcccccccccctgctgcactaccccccccccgccaaggtgcccggcctggagccctgcccccccccccccttcccccccatggccccccccaccgccctgctgcaggaggagcccctgttcagccccagattccccttccccaccgtgccccccgcccccggcgtgagccccctgcccgcccccgccgccttcccccccaccccccagagcgtgcccagccccgcccccacccccttccccatcgagctgctgcccctgggctacagcgagcccgccttcggcccctgcttcagcatgcccagaggcaagccccccgcccccagccccagaggccagaaggccagcccccccaccctggcccccgccaccgccagcccccccaccaccgccggcagcaacaacccctgcctgacccagctgctgaccgccgccaagcccgagcaggccctggagccccccctggtgagcagcaccctgctgagaagccccggcagcccccaggagaccgtgcccgagttcccctgcaccttcctgccccccacccccgcccccaccccccccagacccccccccggccccgccaccctggcccccagcagacccctgctggtgcccaaggccgagagactgagcccccccgcccccagcggcagcgagagaagactgagcggcgacctgagcagcatgcccggccccggcaccctgagcgtgagagtgagccccccccagcccatcctgagcagaggcagacccgacagcaacaagaccgagaacagaagaatcacccacatcagcgccgagcagaagagaagattcaacatcaagctgggcttcgacaccctgcacggcctggtgagcaccctgagcgcccagcccagcctgaaggtgagcaaggccaccaccctgcagaagaccgccgagtacatcctgatgctgcagcaggagagagccggcctgcaggaggaggcccagcagctgagagacgagatcgaggagctgaacgccgccatcaacctgtgccagcagcagctgcccgccaccggcgtgcccatcacccaccagagattcgaccagatgagagacatgttcgacgactacgtgagaaccagaaccctgcacaactggaagttctgggtgttcagcatcctgatcagacccctgttcgagagcttcaacggcatggtgagcaccgccagcgtgcacaccctgagacagaccagcctggcctggctggaccagtactgcagcctgcccgccctgagacccaccgtgctgaacagcctgagacagctgggcaccagcaccagcatcctgaccgaccccggcagaatccccgagcaggccaccagagccgtgaccgagggcaccctgggcaagcccctgtag

SEQ ID NO: 89424 - DNA, 2553 bp, Artificial Sequence
  Description of Artificial Sequence: Synthetic coding sequence
atggccggcgccctggccggcctggccgccggcctgcaggtgcccagagtggcccccagccccgacagcgacagcgacaccgacagcgaggaccccagcctgagaagaagcgccggcggcctgctgagaagccaggtgatccacagcggccacttcatggtgagcagcccccacagcgacagcctgcccagaagaagagaccaggagggcagcgtgggccccagcgacttcggccccagaagcatcgaccccaccctgaccagactgttcgagtgcctgagcctggcctacagcggcaagctggtgagccccaagtggaagaacttcaagggcctgaagctgctgtgcagagacaagatcagactgaacaacgccatctggagagcctggtacatccagtacgtgaagagaagaaagagccccgtgtgcggcttcgtgacccccctgcagggccccgaggccgacgcccacagaaagcccgaggccgtggtgctggagggcaactactggaagagaagaatcgaggtggtgatgagagagtaccacaagtggagaatctactacaagaagagactgagaaagcccagcagagaggacgacctgctggcccccaagcaggccgagggcagatggcccccccccgagcagtggtgcaagcagctgttcagcagcgtggtgcccgtgctgctgggcgaccccgaggaggagcccggcggcagacagctgctggacctgaactgcttcctgagcgacatcagcgacaccctgttcaccatgacccagagcggccccagccccctgcagctgccccccgaggacgcctacgtgggcaacgccgacatgatccagcccgacctgacccccctgcagcccagcctggacgacttcatggacatcagcgacttcttcaccaacagcagactgccccagccccccatgcccagcaacttccccgagccccccagcttcagccccgtggtggacagcctgttcagcagcggcaccctgggccccgaggtgccccccgccagcagcgccatgacccacctgagcggccacagcagactgcaggccagaaacagctgccccggccccctggacagcagcgccttcctgagcagcgacttcctgctgcccgaggaccccaagcccagactgccccccccccccgtgcccccccccctgctgcactaccccccccccgccaaggtgcccggcctggagccctgcccccccccccccttcccccccatggccccccccaccgccctgctgcaggaggagcccctgttcagccccagattccccttccccaccgtgccccccgcccccggcgtgagccccctgcccgcccccgccgccttcccccccaccccccagagcgtgcccagccccgcccccacccccttccccatcgagctgctgcccctgggctacagcgagcccgccttcggcccctgcttcagcatgcccagaggcaagccccccgcccccagccccagaggccagaaggccagcccccccaccctggcccccgccaccgccagcccccccaccaccgccggcagcaacaacccctgcctgacccagctgctgaccgccgccaagcccgagcaggccctggagccccccctggtgagcagcaccctgctgagaagccccggcagcccccaggagaccgtgcccgagttcccctgcaccttcctgccccccacccccgcccccaccccccccagacccccccccggccccgccaccctggcccccagcagacccctgctggtgcccaaggccgagagactgagcccccccgcccccagcggcagcgagagaagactgagcggcgacctgagcagcatgcccggccccggcaccctgagcgtgagagtgagccccccccagcccatcctgagcagaggcagacccgacagcaacaagaacagaagaatcacccacatcagcgccgagcagaagagaagattcaacatcaagctgggcttcgacaccctgcacggcctggtgagcaccctgagcgcccagcccagcctgaaggtgagcaaggccaccaccctgcagaagaccgccgagtacatcctgatgctgcagcaggagagagccggcctgcaggaggaggcccagcagctgagagacgagatcgaggagctgaacgccgccatcaacctgtgccagcagcagctgcccgccaccggcgtgcccatcacccaccagagattcgaccagatgagagacatgttcgacgactacgtgagaaccagaaccctgcacaactggaagttctgggtgttcagcatcctgatcagacccctgttcgagagcttcaacggcatggtgagcaccgccagcgtgcacaccctgagacagaccagcctggcctggctggaccagtactgcagcctgcccgccctgagacccaccgtgctgaacagcctgagacagctgggcaccagcaccagcatcctgaccgaccccggcagaatccccgagcaggccaccagagccgtgaccgagggcaccctgggcaagcccctgtag

SEQ ID NO: 89425 - DNA, 2502 bp, Artificial Sequence
  Description of Artificial Sequence: Synthetic coding sequence
atggccggcgccctggccggcctggccgccggcctgcaggtgcccagagtggcccccagccccgacagcgacagcgacaccgacagcgaggaccccagcctgagaagaagcgccggcggcctgctgagaagccaggtgatccacagcggccacttcatggtgagcagcccccacagcgacagcctgcccagaagaagagaccaggagggcagcgtgggccccagcgacttcggccccagaagcatcgaccccaccctgaccagactgttcgagtgcctgagcctggcctacagcggcaagctggtgagccccaagtggaagaacttcaagggcctgaagctgctgtgcagagacaagatcagactgaacaacgccatctggagagcctggtacatccagtacgtgaagagaagaaagagccccgtgtgcggcttcgtgacccccctgcagggccccgaggccgacgcccacagaaagcccgaggccgtggtgctggagggcaactactggaagagaagaatcgaggtggtgatgagagagtaccacaagtggagaatctactacaagaagagactgagaaagcccagcagagaggacgacctgctggcccccaagcaggccgagggcagatggcccccccccgagcagtggtgcaagcagctgttcagcagcgtggtgcccgtgctgctgggcgaccccgaggaggagcccggcggcagacagctgctggacctgaactgcttcctgagcgacatcagcgacaccctgttcaccatgacccagagcggccccagccccctgcagctgccccccgaggacgcctacgtgggcaacgccgacatgatccagcccgacctgacccccctgcagcccagcctggacgacttcatggacatcagcgacttcttcaccaacagcagactgccccagccccccatgcccagcaacttccccgagccccccagcttcagccccgtggtggacagcctgttcagcagcggcaccctgggccccgaggtgccccccgccagcagcgccatgacccacctgagcggccacagcagactgcaggccagaaacagctgccccggccccctggacagcagcgccttcctgagcagcgacttcctgctgcccgaggaccccaagcccagactgccccccccccccgtgcccccccccctgctgcactaccccccccccgccaaggtgcccggcctggagccctgcccccccccccccttcccccccatggccccccccaccgccctgctgcaggaggagcccctgttcagccccagattccccttccccaccgtgccccccgcccccggcgtgagccccctgcccgcccccgccgccttcccccccaccccccagagcgtgcccagccccgcccccacccccttccccatcgagctgctgcccctgggctacagcgagcccgccttcggcccctgcttcagcatgcccagaggcaagccccccgcccccagccccagaggccagaaggccagcccccccaccctggcccccgccaccgccagcccccccaccaccgccggcagcaacaacccctgcctgacccagctgctgaccgccgccaagcccgagcaggccctggagccccccctggtgagcagcaccctgctgagaagccccggcagcccccaggagaccgtgcccgagttcccctgcaccttcctgccccccacccccgcccccaccccccccagacccccccccggccccgccaccctggcccccagcagacccctgctggtgcccaaggccgagagactgagcccccccgcccccagcggcagcgagagaagactgagcggcgacctgagcagcatgcccggccccggcaccctgagcgtgagagtgagccccccccagcccatcctgagcagaggcagacccgacagcaacaagaccgagaacagaagaatcacccacatcagcgccgagcagaagagaagattcaacatcaagctgggcttcgacaccctgcacggcctggtgagcaccctgagcgcccagcccagcctgaaggagagagccggcctgcaggaggaggcccagcagctgagagacgagatcgaggagctgaacgccgccatcaacctgtgccagcagcagctgcccgccaccggcgtgcccatcacccaccagagattcgaccagatgagagacatgttcgacgactacgtgagaaccagaaccctgcacaactggaagttctgggtgttcagcatcctgatcagacccctgttcgagagcttcaacggcatggtgagcaccgccagcgtgcacaccctgagacagaccagcctggcctggctggaccagtactgcagcctgcccgccctgagacccaccgtgctgaacagcctgagacagctgggcaccagcaccagcatcctgaccgaccccggcagaatccccgagcaggccaccagagccgtgaccgagggcaccctgggcaagcccctgtag

SEQ ID NO: 89426 - DNA, 1059 bp, Artificial Sequence
  Description of Artificial Sequence: Synthetic coding sequence
atgaacaccatcgtgttcaacaagctgagcggcgccgtgctgttcgaggacggcggcgccagcgagagagagagaggcggcagaccctacagcggcgtgctggacagcccccacgccagacccgaggtgggcatccccgacggcccccccctgaaggacaacctgggcctgagacacagaagaaccggcgccagacagaacggcggcaaggtgagacacaagagacaggccctgcaggacatggccagacccctgaagcagtggctgtacaagcacagagacaacccctaccccaccaagaccgagaagatcctgctggccctgggcagccagatgaccctggtgcaggtgagcaactggttcgccaacgccagaagaagactgaagaacaccgtgagacagcccgacctgagctgggccctgagaatcaagctgtacaacaagtacgtgcagggcaacgccgagagactgagcgtgagcagcgacgacagctgcagcgaggacggcgagaacccccccagaacccacatgaacgagggcggctacaacacccccgtgcaccaccccgtgatcaagagcgagaacagcgtgatcaaggccggcgtgagacccgagagcagagccagcgaggactacgtggccccccccaagtacaagagcagcctgctgaacagatacctgaacgacagcctgagacacgtgatggccaccaacaccaccatgatgggcaagaccagacagagaaaccacagcggcagcttcagcagcaacgagttcgaggaggagctggtgagccccagcagcagcgagaccgagggcaacttcgtgtacagaaccgacaccctggagaacggcagcaacaagggcgagagcgccgccaacagaaagggccccagcaaggacgacacctactggaaggagatcaacgccgccatggccctgaccaacctggcccagggcaaggacaagctgcagggcaccaccagctgcatcatccagaagagcagccacatcgccgaggtgaagaccgtgaaggtgcccctggtgcagcagttctag

SEQ ID NO: 89427 - DNA, 1059 bp, Artificial Sequence; identical to SEQ ID NO: 89426
  Description of Artificial Sequence: Synthetic coding sequence

SEQ ID NO: 89428 - DNA, 177 bp, Artificial Sequence
  Description of Artificial Sequence: Synthetic coding sequence
atgaacaccatcgtgttcaacaagctgagcggcgccgtgctgttcgaggacggcggcgccagcgagagagagagaggcggcagaccctacagcggcgtgctggacagcccccacgccagacccgaggtgggcatccccgacggcccccccctgaaggacaacctgggcctgagatag

SEQ ID NO: 89429 - DNA, 288 bp, Artificial Sequence
  Description of Artificial Sequence: Synthetic coding sequence
atgaacttcgacttccccttcaagaagggcagcggcatccccctgctgaccaccaacctgagcccccagtgcctgagcctgctgcacgccatggtggcctacgaccccgacgagagaatcgccgcccaccaggccctgcagcacccctacttccaggagcagagaacccagaacggcagcgaggacgaggccagcgccgtgctgctgcccatccagaccagaagcagcctgaaccccctgctgagcacctgcatgctgcccggcagaagcgtgaccctgctggtgtag

SEQ ID NO: 89430 - DNA, 1260 bp, Artificial Sequence
  Description of Artificial Sequence: Synthetic coding sequence
atgaagaactacaaggccatcggcaagatcggcgagggcaccttcagcgaggtgatgaagatgcagagcctgagagacggcaactactacgcctgcaagcagatgaagcagagattcgagagcatcgagcaggtgaacaacctgagagagatccaggccctgagaagactgaacccccaccccaacatcctgatgctgcacgaggtggtgttcgacagaaagagcggcagcctggccctgatctgcgagctgatggacatgaacatctacgagctgatcagaggcagaagataccccctgagcgagaagaagatcatgcactacatgtaccagctgtgcaagagcctggaccacatccacagaaacggcatcttccacagagacgtgaagcccgagaacatcctgatcaagcaggacgtgctgaagctgggcgacttcggcagctgcagaagcgtgtacagcaagcagccctacaccgagtacatcagcaccagatggtacagagcccccgagtgcctgctgaccgacggcttctacacctacaagatggacctgtggagcgccggctgcgtgttctacgagatcgccagcctgcagcccctgttccccggcgtgaacgagctggaccagatcagcaagatccacgacgtgatcggcacccccgcccagaagatcctgaccaagttcaagcagagcagagccatgaacttcgacttccccttcaagaagggcagcggcatccccctgctgaccaccaacctgagcccccagtgcctgagcctgctgcacgccatggtggcctacgaccccgacgagagaatcgccgcccaccaggccctgcagcacccctacttccaggagcagagaaagaccgagaagagagccctgggcagccacagaaaggccggcttccccgagcaccccgtggcccccgagcccctgagcaacagctgccagatcagcaaggagggcagaaagcagaagcagagcctgaagcaggaggaggacagacccaagagaagaggccccgcctacgtgatggagctgcccaagctgaagctgagcggcgtggtgagactgagcagctacagcagccccaccctgcagagcgtgctgggcagcggcaccaacggcagagtgcccgtgctgagacccctgaagtgcatccccgccagcaagaagaccgacccccagaaggacctgaagcccgccccccagcagtgcagactgcccaccatcgtgagaaagggcggcagatag

SEQ ID NO: 89431 - DNA, 2667 bp, Artificial Sequence
  Description of Artificial Sequence: Synthetic coding sequence
atggccggcgccgccgccgagagcggcagagagctgtggaccttcgccggcagcagagaccccagcgcccccagactggcctacggctacggccccggcagcctgagagagctgagagccagagagttcagcagactggccggcaccgtgtacctggaccacgccggcgccaccctgttcagccagagccagctggagagcttcaccagcgacctgatggagaacacctacggcaacccccacagccagaacatcagcagcaagctgacccacgacaccgtggagcaggtgagatacagaatcctggcccacttccacaccaccgccgaggactacaccgtgatcttcaccgccggcagcaccgccgccctgaagctggtggccgaggccttcccctgggtgagccagggccccgagagcagcggcagcagattctgctacctgaccgacagccacaccagcgtggtgggcatgagaaacgtgaccatggccatcaacgtgatcagcacccccgtgagacccgaggacctgtggagcgccgaggagagaagcgccagcgccagcaaccccgactgccagctgccccacctgttctgctaccccgcccagagcaacttcagcggcgtgagataccccctgagctggatcgaggaggtgaagagcggcagactgcaccccgtgagcacccccggcaagtggttcgtgctgctggacgccgccagctacgtgagcaccagccccctggacctgagcgcccaccaggccgacttcgtgcccatcagcttctacaagatcttcggcttccccaccggcctgggcgccctgctggtgcacaacagagccgcccccctgctgagaaagacctacttcggcggcggcaccgccagcgcctacctggccggcgaggacttctacatccccagacagagcgtggcccagagattcgaggacggcaccatcagcttcctggacgtgatcgccctgaagcacggcttcgacaccctggagagactgaccggcggcatggagaacatcaagcagcacaccttcaccctggcccagtacacctacgtggccctgagcagcctgcagtaccccaacggcgcccccgtggtgagaatctacagcgacagcgagttcagcagccccgaggtgcagggccccatcatcaacttcaacgtgctggacgacaagggcaacatcatcggctacagccaggtggacaagatggccagcctgtacaacatccacctgagaaccggctgcttctgcaacaccggcgcctgccagagacacctgggcatcagcaacgagatggtgagaaagcacttccaggccggccacgtgtgcggcgacaacatggacctgatcgacggccagcccaccggcagcgtgagaatcagcttcggctacatgagcaccctggacgacgtgcaggccttcctgagattcatcatcgacaccagactgcacagcagcggcgactggcccgtgccccaggcccacgccgacaccggcgagaccggcgcccccagcgccgacagccaggccgacgtgatccccgccgtgatgggcagaagaagcctgagcccccaggaggacgccctgaccggcagcagagtgtggaacaacagcagcaccgtgaacgccgtgcccgtggccccccccgtgtgcgacgtggccagaacccagcccacccccagcgagaaggccgccggcgtgctggagggcgccctgggcccccacgtggtgaccaacctgtacctgtaccccatcaagagctgcgccgccttcgaggtgaccagatggcccgtgggcaaccagggcctgctgtacgacagaagctggatggtggtgaaccacaacggcgtgtgcctgagccagaagcaggagcccagactgtgcctgatccagcccttcatcgacctgagacagagaatcatggtgatcaaggccaagggcatggagcccatcgaggtgcccctggaggagaacagcgagagaacccagatcagacagagcagagtgtgcgccgacagagtgagcacctacgactgcggcgagaagatcagcagctggctgagcaccttcttcggcagaccctgccacctgatcaagcagagcagcaacagccagagaaacgccaagaagaagcacggcaaggaccagctgcccggcaccatggccaccctgagcctggtgaacgaggcccagtacctgctgatcaacaccagcagcatcctggagctgcacagacagctgaacaccagcgacgagaacggcaaggaggagctgttcagcctgaaggacctgagcctgagattcagagccaacatcatcatcaacggcaagagagccttcgaggaggagaagtgggacgagatcagcatcggcagcctgagattccaggtgctgggcccctgccacagatgccagatgatctgcatcgaccagcagaccggccagagaaaccagcacgtgttccagaagctgagcgagagcagagagaccaaggtgaacttcggcatgtacctgatgcacgccagcctggacctgagcagcccctgcttcctgagcgtgggcagccaggtgctgcccgtgctgaaggagaacgtggagggccacgacctgcccgccagcgagaagcaccaggacgtgaccagctag

SEQ ID NO: 89432 - DNA, 1863 bp, Artificial Sequence
  Description of Artificial Sequence: Synthetic coding sequence
atggccgccagacccctgagcagaatgctgagaagactgctgagaagcagcgccagaagctgcagcagcggcgcccccgtgacccagccctgccccggcgagagcgccagagccgccagcgaggaggtgagcagaagaagacagttcctgagagagcacgccgcccccttcagcgccttcctgaccgacagcttcggcagacagcacagctacctgagaatcagcctgaccgagaagtgcaacctgagatgccagtactgcatgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccgagctgttcctgatgttccccaacagcccccccgccaaccccagcatcttcagctgggaccccctgcacgtgcagggcctgagacccagaatgagcttcagcagccaggtggccaccctgtggaagggctgcagagtgccccagaccccccccctggcccagcagagactgggcagcggcagcttccagagacactacaccagcagagccgacagcgacgccaacagcaagtgcctgagccccggcagctgggccagcgccgcccccagcggcccccagctgaccagcgagcagctgacccacgtggacagcgagggcagagccgccatggtggacgtgggcagaaagcccgacaccgagagagtggccgtggccagcgccgtggtgctgctgggccccgtggccttcaagctggtgcagcagaaccagctgaagaagggcgacgccctggtggtggcccagctggccggcgtgcaggccgccaaggtgaccagccagctgatccccctgtgccaccacgtggccctgagccacatccaggtgcagctggagctggacagcaccagacacgccgtgaagatccaggccagctgcagagccagaggccccaccggcgtggagatggaggccctgaccagcgccgccgtggccgccctgaccctgtacgacatgtgcaaggccgtgagcagagacatcgtgctggaggagatcaagctgatcagcaagaccggcggccagagaggcgacttccacagagcctag

SEQ ID NO: 89433 - DNA, 1911 bp, Artificial Sequence
  Description of Artificial Sequence: Synthetic coding sequence
atggccgccagacccctgagcagaatgctgagaagactgctgagaagcagcgccagaagctgcagcagcggcgcccccgtgacccagccctgccccggcgagagcgccagagccgccagcgaggaggtgagcagaagaagacagttcctgagagagcacgccgcccccttcagcgccttcctgaccgacagcttcggcagacagcacagctacctgagaatcagcctgaccgagaagtgcaacctgagatgccagtactgcatgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccggcatgttcagcatcagccagatgaagaacagacccatgatcctgatcgagctgttcctgatgttccccaacagcccccccgccaaccccagcatcttcagctgggaccccctgcacgtgcagggcctgagacccagaatgagcttcagcagccaggtggccaccctgtggaagggctgcagagtgccccagaccccccccctggcccagcagagactgggcagcggcagcttccagagacactacaccagcagagccgacagcgacgccaacagcaagtgcctgagccccggcagctgggccagcgccgcccccagcggcccccagctgaccagcgagcagctgacccacgtggacagcgagggcagagccgccatggtggacgtgggcagaaagcccgacaccgagagagtggccgtggccagcgccgtggtgctgctgggccccgtggccttcaagctggtgcagcagaaccagctgaagaagggcgacgccctggtggtggcccagctggccggcgtgcaggccgccaaggtgaccagccagctgatccccctgtgccaccacgtggccctgagccacatccaggtgcagctggagctggacagcaccagacacgccgtgaagatccaggccagctgcagagccagaggccccaccggcgtggagatggaggccctgaccagcgccgccgtggccgccctgaccctgtacgacatgtgcaaggccgtgagcagagacatcgtgctggaggagatcaagctgatcagcaagaccggcggccagagaggcgacttccacagagcctag

SEQ ID NO: 89434 - DNA, 456 bp, Artificial Sequence
  Description of Artificial Sequence: Synthetic coding sequence
atgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatcctgaccgtggccagaagctgctggcccctgttcctgtggccccccagcagcgagaccggctgcgcccacatgggccacagccccaaggacagctgccagaccacccagcccacccccggccccgtgcacggctgcagcacccaccccagcctgttctggagcatcagcggcaaggagaagctgatgatcgactgcctgcacccccacagcgcccagatcaagctgagatgccagctgtgcagatgcaagaacgaggacaccgtgtgggtgggccactag

SEQ ID NO: 89435 - DNA, 1071 bp, Artificial Sequence
  Description of Artificial Sequence: Synthetic coding sequence
atgtggaagagctggaagctgagaaccgacgtgagagaggtgagcagaagaagacagttcctgagagagcacgccgcccccttcagcgccttcctgaccgacagcttcggcagacagcacagctacctgagaatcagcctgaccgagaagtgcaacctgagatgccagtactgcatgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccggcatgttcagcatcagccagatgaagaacagacccatgatcctgatcggcggctag

SEQ ID NO: 89436 - DNA, 1158 bp, Artificial Sequence
  Description of Artificial Sequence: Synthetic coding sequence
atgtggaagagctggaagctgagaaccgacgtgagagtgagagagggcgccggcggcagcccctgcgccagcagccagcccggcagcagaggcccctgcttcctgcccggcctgagcagccaggaggtgagcagaagaagacagttcctgagagagcacgccgcccccttcagcgccttcctgaccgacagcttcggcagacagcacagctacctgagaatcagcctgaccgagaagtgcaacctgagatgccagtactgcatgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccggcatgttcagcatcagccagatgaagaacagacccatgatcctgatcggcggctag

SEQ ID NO: 89437 - DNA, 1158 bp, Artificial Sequence
  Description of Artificial Sequence: Synthetic coding sequence
atggccgccagacccctgagcagaatgctgagaagactgctgagaagcagcgccagaagctgcagcagcggcgcccccgtgacccagccctgccccggcgagagcgccagagccgccagcgaggaggtgagcagaagaagacagttcctgagagagcacgccgcccccttcagcgccttcctgaccgacagcttcggcagacagcacagctacctgagaatcagcctgaccgagaagtgcaacctgagatgccagtactgcatgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccggcatgttcagcatcagccagatgaagaacagacccatgatcctgatcggcggctag

SEQ ID NO: 89438 - DNA, 1602 bp, Artificial Sequence
  Description of Artificial Sequence: Synthetic coding sequence
atgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccgagctgttcctgatgttccccaacagcccccccgccaaccccagcatcttcagctgggaccccctgcacgtgcagggcctgagacccagaatgagcttcagcagccaggtggccaccctgtggaagggctgcagagtgccccagaccccccccctggcccagcagagactgggcagcggcagcttccagagacactacaccagcagagccgacagcgacgccaacagcaagtgcctgagccccggcagctgggccagcgccgcccccagcggcccccagctgaccagcgagcagctgacccacgtggacagcgagggcagagccgccatggtggacgtgggcagaaagcccgacaccgagagagtggccgtggccagcgccgtggtgctgctgggccccgtggccttcaagctggtgcagcagaaccagctgaagaagggcgacgccctggtggtggcccagctggccggcgtgcaggccgccaaggtgaccagccagctgatccccctgtgccaccacgtggccctgagccacatccaggtgcagctggagctggacagcaccagacacgccgtgaagatccaggccagctgcagagccagaggccccaccggcgtggagatggaggccctgaccagcgccgccgtggccgccctgaccctgtacgacatgtgcaaggccgtgagcagagacatcgtgctggaggagatcaagctgatcagcaagaccggcggccagagaggcgacttccacagagcctag

SEQ ID NO: 89439 - DNA, 1911 bp, Artificial Sequence
  Description of Artificial Sequence: Synthetic coding sequence
atgtggaagagctggaagctgagaaccgacgtgagagtgagagagggcgccggcggcagcccctgcgccagcagccagcccggcagcagaggcccctgcttcctgcccggcctgagcagccaggaggtgagcagaagaagacagttcctgagagagcacgccgcccccttcagcgccttcctgaccgacagcttcggcagacagcacagctacctgagaatcagcctgaccgagaagtgcaacctgagatgccagtactgcatgcccgaggagggcgtgcccctgacccccaaggccaacctgctgaccaccgaggagatcctgaccctggccagactgttcgtgaaggagggcatcgacaagatcagactgaccggcggcgagcccctgatcagacccgacgtggtggacatcgtggcccagctgcagagactggagggcctgagaaccatcggcgtgaccaccaacggcatcaacctggccagactgctgccccagctgcagaaggccggcctgagcgccatcaacatcagcctggacaccctggtgcccgccaagttcgagttcatcgtgagaagaaagggcttccacaaggtgatggagggcatccacaaggccatcgagctgggctacaaccccgtgaaggtgaactgcgtggtgatgagaggcctgaacgaggacgagctgctggacttcgccgccctgaccgagggcctgcccctggacgtgagattcatcgagtacatgcccttcgacggcaacaagtggaacttcaagaagatggtgagctacaaggagatgctggacaccgtgagacagcagtggcccgagctggagaaggtgcccgaggaggagagcagcaccgccaaggccttcaagatccccggcttccagggccagatcagcttcatcaccagcatgagcgagcacttctgcggcacctgcaacagactgagaatcaccgccgacggcaacctgaaggtgtgcctgttcggcaacagcgaggtgagcctgagagaccacctgagagccggcgccagcgagcaggagctgctgagaatcatcggcgccgccgtgggcagaaagaagagacagcacgccggcatgttcagcatcagccagatgaagaacagacccatgatcctgatcgagctgttcctgatgttccccaacagcccccccgccaaccccagcatcttcagctgggaccccctgcacgtgcagggcctgagacccagaatgagcttcagcagccaggtggccaccctgtggaagggctgcagagtgccccagaccccccccctggcccagcagagactgggcagcggcagcttccagagacactacaccagcagagccgacagcgacgccaacagcaagtgcctgagccccggcagctgggccagcgccgcccccagcggcccccagctgaccagcgagcagctgacccacgtggacagcgagggcagagccgccatggtggacgtgggcagaaagcccgacaccgagagagtggccgtggccagcgccgtggtgctgctgggccccgtggccttcaagctggtgcagcagaaccagctgaagaagggcgacgccctggtggtggcccagctggccggcgtgcaggccgccaaggtgaccagccagctgatccccctgtgccaccacgtggccctgagccacatccaggtgcagctggagctggacagcaccagacacgccgtgaagatccaggccagctgcagagccagaggccccaccggcgtggagatggaggccctgaccagcgccgccgtggccgccctgaccctgtacgacatgtgcaaggccgtgagcagagacatcgtgctggaggagatcaagctgatcagcaagaccggcggccagagaggcgacttccacagagcctag

SEQ ID NO: 89440 - DNA, 1071 bp, Artificial Sequence; identical to SEQ ID NO: 89435
  Description of Artificial Sequence: Synthetic coding sequence

SEQ ID NO: 89441 - DNA, 267 bp, Artificial Sequence
  Description of Artificial Sequence: Synthetic coding sequence
atggtgcccctgtgccaggtggaggtgctgtacttcgccaagagcgccgagatcaccggcgtgagaagcgagaccatcagcgtgccccaggagatcaaggccctgcagctgtggaaggagatcgagaccagacaccccggcctggccgacgtgagaaaccagatcatcttcgccgtgagacaggagtacgtggagctgggcgaccagctgctggtgctgcagcccggcgacgagatcgccgtgatcccccccatcagcggcggctag

SEQ ID NO: 89442 - DNA, 567 bp, Artificial Sequence
  Description of Artificial Sequence: Synthetic coding sequence
atgagcagcctggagatcagcagcagctgcttcagcctggagaccaagctgcccctgagcccccccctggtggaggacagcgccttcgagcccagcagaaaggacatggacgaggtggaggagaagagcaaggacgtgatcaacttcaccgccgagaagctgagcgtggacgaggtgagccagctggtgatcagccccctgtgcggcgccatcagcctgttcgtgggcaccaccagaaacaacttcgagggcaagaaggtgatcagcctggagtacgaggcctacctgcccatggccgagaacgaggtgagaaagatctgcagcgacatcagacagaagtggcccgtgaagcacatcgccgtgttccacagactgggcctggtgcccgtgagcgaggccagcatcatcatcgccgtgagcagcgcccacagagccgccagcctggaggccgtgagctacgccatcgacaccctgaaggccaaggtgcccatctggaagaaggagatctacgaggagagcagcacctggaagggcaacaaggagtgcttctgggccagcaacagctag

SEQ ID NO: 89443 - DNA, 267 bp, Artificial Sequence; identical to SEQ ID NO: 89441
  Description of Artificial Sequence: Synthetic coding sequence

SEQ ID NO: 89444 - DNA, 267 bp, Artificial Sequence; identical to SEQ ID NO: 89441
  Description of Artificial Sequence: Synthetic coding sequence

SEQ ID NO: 89445 - DNA, 267 bp, Artificial Sequence; identical to SEQ ID NO: 89441
  Description of Artificial Sequence: Synthetic coding sequence

SEQ ID NO: 89446 - DNA, 462 bp, Artificial Sequence
  Description of Artificial Sequence: Synthetic coding sequence
atgagcagcctggagatcagcagcagctgcttcagcctggagaccaagctgcccctgagcccccccctggtggaggacagcgccttcgagcccagcagaaaggacatggacgaggtggaggagaagagcaaggacgtgatcaacttcaccgccgagaagctgagcgtggacgaggtgagccagctggtgatcagccccctgtgcggcgccatcagcctgttcgtgggcaccaccagaaacaacttcgagggcaagaaggtgatcagcctggagtacgaggcctacctgcccatggccgagaacgaggtgagaaagatctgcagcgacatcagacagaagtggcccgtgaagcacatcgccgtgttccacagactgggcctggtgcccgtgagcgaggccagcatcatcatcgccgtgagcagcgcccacagagccgccagcctggaggccgtgagctactag

SEQ ID NO: 89447 - DNA, 1644 bp, Artificial Sequence
  Description of Artificial Sequence: Synthetic coding sequence
atggaggtgggcggcgacaccgccgcccccgcccccggcggcgccgaggacctggaggacacccagttccccagcgaggaggccagagagggcggcggcgtgcacgccgtgccccccgaccccgaggacgagggcctggaggagaccggcagcaaggacaaggaccagccccccagccccagcccccccccccagagcgaggccctgagcagcaccagcagactgtggagccccgccgcccccgagaacagccccacctgcagccccgagagcagcagcggcggccagggcggcgaccccagcgacgaggagtggagaagccagagaaagcacgtgttcgtgctgagcgaggccggcaagcccatctacagcagatacggcagcgtggaggccctgagcgccaccatgggcgtgatgaccgccctggtgagcttcgtgcagagcgccggcgacgccatcagagccatctacgccgaggaccacaagctggtgttcctgcagcagggccccctgctgctggtggccatgagcagaaccagccagagcgccgcccagctgagaggcgagctgctggccgtgcacgcccagatcgtgagcaccctgaccagagccagcgtggccagaatcttcgcccacaagcagaactacgacctgagaagactgctggccggcagcgagagaaccctggacagactgctggacagcatggagcaggaccccggcgccctgctgctgggcgccgtgagatgcgtgcccctggccagacccctgagagacgccctgggcgccctgctgagaagatgcaccgcccccggcctggccctgagcgtgctggccgtgggcggcagactgatcaccgccgcccaggagagaaacgtgctggccgagtgcagactggaccccgccgacctgcagctgctgctggactgggtgggcgcccccgccttcgccgccggcgaggcctgggcccccgtgtgcctgcccagattcaaccccgacggcttcttctacgcctacgtggccagactggacgccatgcccgtgtgcctgctgctgctgggcacccagagagaggccttccacgccatggccgcctgcagaagactggtggaggacggcatgcacgccctgggcgccatgagagccctgggcgaggccgccagcttcagcaacgccagcagcgccagcgcccccgcctacagcgtgcaggccgtgggcgcccccggcctgagacacttcctgtacaagcccctggacatccccgaccaccacagacagctgccccagttcaccagccccgagctggaggccccctacagcagagaggaggagagacagagactgagcgacctgtaccacagactgcacgccagactgcacagcaccagcagacccctgagactgatctaccacgtggccgagaaggagaccctgctggcctgggtgaccagcaagttcgagctgtacacctgcctgagccccctggtgaccaaggccggcgccatcctggtggtgaccaagctgctgagatgggtgaagaaggaggaggacagactgttcatcagatacccccccaagtacagcaccccccccgccaccagcaccgaccaggccgcccacaacggcctgttcaccggcctgtag

SEQ ID NO: 89448 - DNA, 438 bp, Artificial Sequence
  Description of Artificial Sequence: Synthetic coding sequence
atggaggtgggcggcgacaccgccgcccccgcccccggcggcgccgaggacctggaggacacccagttccccagcgaggaggccagagagggcggcggcgtgcacgccgtgccccccgaccccgaggacgagggcctggaggagaccggcagcaaggacaaggaccagccccccagccccagcccccccccccagagcgaggccctgagcagcaccagcagactgtggagccccgccgcccccgagaacagccccacctgcagccccgagagcagcagcggcggccagggcggcgaccccagcgacgaggagtggagaagccagagaaacggctgcagaacctgcaccaccgcctgcatgctggtgagcaccgccccccccgacccctgcgccagcttcaccacctggctgagaagaagacactactggcccggctag

SEQ ID NO: 89449 - DNA, 1317 bp, Artificial Sequence
  Description of Artificial Sequence: Synthetic coding sequence
atggaggtgggcggcgacaccgccgcccccgcccccggcggcgccgaggacctggaggacacccagttccccagcgaggaggccagagagggcggcggcgtgcacgccgtgccccccgaccccgaggacgagggcctggaggagaccgaggaccacaagctggtgttcctgcagcagggccccctgctgctggtggccatgagcagaaccagccagagcgccgcccagctgagaggcgagctgctggccgtgcacgcccagatcgtgagcaccctgaccagagccagcgtggccagaatcttcgcccacaagcagaactacgacctgagaagactgctggccggcagcgagagaaccctggacagactgctggacagcatggagcaggaccccggcgccctgctgctgggcgccgtgagatgcgtgcccctggccagacccctgagagacgccctgggcgccctgctgagaagatgcaccgcccccggcctggccctgagcgtgctggccgtgggcggcagactgatcaccgccgcccaggagagaaacgtgctggccgagtgcagactggaccccgccgacctgcagctgctgctggactgggtgggcgcccccgccttcgccgccggcgaggcctgggcccccgtgtgcctgcccagattcaaccccgacggcttcttctacgcctacgtggccagactggacgccatgcccgtgtgcctgctgctgctgggcacccagagagaggccttccacgccatggccgcctgcagaagactggtggaggacggcatgcacgccctgggcgccatgagagccctgggcgaggccgccagcttcagcaacgccagcagcgccagcgcccccgcctacagcgtgcaggccgtgggcgcccccggcctgagacacttcctgtacaagcccctggacatccccgaccaccacagacagctgccccagttcaccagccccgagctggaggccccctacagcagagaggaggagagacagagactgagcgacctgtaccacagactgcacgccagactgcacagcaccagcagacccctgagactgatctaccacgtggccgagaaggagaccctgctggcctgggtgaccagcaagttcgagctgtacacctgcctgagccccctggtgaccaaggccggcgccatcctggtggtgaccaagctgctgagatgggtgaagaaggaggaggacagactgttcatcagatacccccccaagtacagcaccccccccgccaccagcaccgaccaggccgcccacaacggcctgttcaccggcctgtag

SEQ ID NO: 89450 - DNA, 1206 bp, Artificial Sequence
  Description of Artificial Sequence: Synthetic coding sequence
atggtgagcggccagctgagattcggcgtgaagaccgaggaccacaagctggtgttcctgcagcagggccccctgctgctggtggccatgagcagaaccagccagagcgccgcccagctgagaggcgagctgctggccgtgcacgcccagatcgtgagcaccctgaccagagccagcgtggccagaatcttcgcccacaagcagaactacgacctgagaagactgctggccggcagcgagagaaccctggacagactgctggacagcatggagcaggaccccggcgccctgctgctgggcgccgtgagatgcgtgcccctggccagacccctgagagacgccctgggcgccctgctgagaagatgcaccgcccccggcctggccctgagcgtgctggccgtgggcggcagactgatcaccgccgcccaggagagaaacgtgctggccgagtgcagactggaccccgccgacctgcagctgctgctggactgggtgggcgcccccgccttcgccgccggcgaggcctgggcccccgtgtgcctgcccagattcaaccccgacggcttcttctacgcctacgtggccagactggacgccatgcccgtgtgcctgctgctgctgggcacccagagagaggccttccacgccatggccgcctgcagaagactggtggaggacggcatgcacgccctgggcgccatgagagccctgggcgaggccgccagcttcagcaacgccagcagcgccagcgcccccgcctacagcgtgcaggccgtgggcgcccccggcctgagacacttcctgtacaagcccctggacatccccgaccaccacagacagctgccccagttcaccagccccgagctggaggccccctacagcagagaggaggagagacagagactgagcgacctgtaccacagactgcacgccagactgcacagcaccagcagacccctgagactgatctaccacgtggccgagaaggagaccctgctggcctgggtgaccagcaagttcgagctgtacacctgcctgagccccctggtgaccaaggccggcgccatcctggtggtgaccaagctgctgagatgggtgaagaaggaggaggacagactgttcatcagatacccccccaagtacagcaccccccccgccaccagcaccgaccaggccgcccacaacggcctgttcaccggcctgtag

SEQ ID NO: 89451 - DNA, 1584 bp, Artificial Sequence
  Description of Artificial Sequence: Synthetic coding sequence
atggagaaccaggagaaggccagcatcgccggccacatgttcgacgtggtggtgatcggcggcggcatcagcggcctgagcgccgccaagctgctgaccgagtacggcgtgagcgtgctggtgctggaggccagagacagagtgggcggcagaacctacaccatcagaaacgagcacgtggactacgtggacgtgggcggcgcctacgtgggccccacccagaacagaatcctgagactgagcaaggagctgggcatcgagacctacaaggtgaacgtgagcgagagactggtgcagtacgtgaagggcaagacctaccccttcagaggcgccttcccccccgtgtggaaccccatcgcctacctggactacaacaacctgtggagaaccatcgacaacatgggcaaggagatccccaccgacgccccctgggaggcccagcacgccgacaagtgggacaagatgaccatgaaggagctgatcgacaagatctgctggaccaagaccgccagaagattcgcctacctgttcgtgaacatcaacgtgaccagcgagccccacgaggtgagcgccctgtggttcctgtggtacgtgaagcagtgcggcggcaccaccagaatcttcagcgtgaccaacggcggccaggagagaaagttcgtgggcggcagcggccaggtgagcgagagaatcatggacctgctgggcgaccaggtgaagctgaaccaccccgtgacccacgtggaccagagcagcgacaacatcatcatcgagaccctgaaccacgagcactacgagtgcaagtacgtgatcaacgccatcccccccaccctgaccgccaagatccacttcagacccgagctgcccgccgagagaaaccagctgatccagagactgcccatgggcgccgtgatcaagtgcatgatgtactacaaggaggccttctggaagaagaaggactactgcggctgcatgatcatcgaggacgaggacgcccccatcagcatcaccctggacgacaccaagcccgacggcagcctgcccgccatcatgggcttcatcctggccagaaaggccgacagactggccaagctgcacaaggagatcagaaagaagaagatctgcgagctgtacgccaaggtgctgggcagccaggaggccctgcaccccgtgcactacgaggagaagaactggtgcgaggagcagtacagcggcggctgctacaccgcctacttcccccccggcatcatgacccagtacggcagagtgatcagacagcccgtgggcagaatcttcttcgccggcaccgagaccgccaccaagtggagcggctacatggagggcgccgtggaggccggcgagagagccgccagagaggtgctgaacggcctgggcaaggtgaccgagaaggacatctgggtgcaggagcccgagagcaaggacgtgcccgccgtggagatcacccacaccttctgggagagaaacctgcccagcgtgagcggcctgctgaagatcatcggcttcagcaccagcgtgaccgccctgggcttcgtgctgtacaagtacaagctgctgcccagaagctag

SEQ ID NO: 89452 - DNA, 1185 bp, Artificial Sequence
  Description of Artificial Sequence: Synthetic coding sequence
atgggcaaggagatccccaccgacgccccctgggaggcccagcacgccgacaagtgggacaagatgaccatgaaggagctgatcgacaagatctgctggaccaagaccgccagaagattcgcctacctgttcgtgaacatcaacgtgaccagcgagccccacgaggtgagcgccctgtggttcctgtggtacgtgaagcagtgcggcggcaccaccagaatcttcagcgtgaccaacggcggccaggagagaaagttcgtgggcggcagcggccaggtgagcgagagaatcatggacctgctgggcgaccaggtgaagctgaaccaccccgtgacccacgtggaccagagcagcgacaacatcatcatcgagaccctgaaccacgagcactacgagtgcaagtacgtgatcaacgccatcccccccaccctgaccgccaagatccacttcagacccgagctgcccgccgagagaaaccagctgatccagagactgcccatgggcgccgtgatcaagtgcatgatgtactacaaggaggccttctggaagaagaaggactactgcggctgcatgatcatcgaggacgaggacgcccccatcagcatcaccctggacgacaccaagcccgacggcagcctgcccgccatcatgggcttcatcctggccagaaaggccgacagactggccaagctgcacaaggagatcagaaagaagaagatctgcgagctgtacgccaaggtgctgggcagccaggaggccctgcaccccgtgcactacgaggagaagaactggtgcgaggagcagtacagcggcggctgctacaccgcctacttcccccccggcatcatgacccagtacggcagagtgatcagacagcccgtgggcagaatcttcttcgccggcaccgagaccgccaccaagtggagcggctacatggagggcgccgtggaggccggcgagagagccgccagagaggtgctgaacggcctgggcaaggtgaccgagaaggacatctgggtgcaggagcccgagagcaaggacgtgcccgccgtggagatcacccacaccttctgggagagaaacctgcccagcgtgagcggcctgctgaagatcatcggcttcagcaccagcgtgaccgccctgggcttcgtgctgtacaagtacaagctgctgcccagaagctag

SEQ ID NO: 89453 - DNA, 1563 bp, Artificial Sequence
  Description of Artificial Sequence: Synthetic coding sequence
atgagcaacaagtgcgacgtggtggtggtgggcggcggcatcagcggcatggccgccgccaagctgctgcacgacagcggcctgaacgtggtggtgctggaggccagagacagagtgggcggcagaacctacaccctgagaaaccagaaggtgaagtacgtggacctgggcggcagctacgtgggccccacccagaacagaatcctgagactggccaaggagctgggcctggagacctacaaggtgaacgaggtggagagactgatccaccacgtgaagggcaagagctaccccttcagaggccccttcccccccgtgtggaaccccatcacctacctggaccacaacaacttctggagaaccatggacgacatgggcagagagatccccagcgacgccccctggaaggcccccctggccgaggagtgggacaacatgaccatgaaggagctgctggacaagctgtgctggaccgagagcgccaagcagctggccaccctgttcgtgaacctgtgcgtgaccgccgagacccacgaggtgagcgccctgtggttcctgtggtacgtgaagcagtgcggcggcaccaccagaatcatcagcaccaccaacggcggccaggagagaaagttcgtgggcggcagcggccaggtgagcgagagaatcatggacctgctgggcgacagagtgaagctggagagacccgtgatctacatcgaccagaccagagagaacgtgctggtggagaccctgaaccacgagatgtacgaggccaagtacgtgatcagcgccatcccccccaccctgggcatgaagatccacttcaacccccccctgcccatgatgagaaaccagatgatcaccagagtgcccctgggcagcgtgatcaagtgcatcgtgtactacaaggagcccttctggagaaagaaggactactgcggcaccatgatcatcgacggcgaggaggcccccgtggcctacaccctggacgacaccaagcccgagggcaactacgccgccatcatgggcttcatcctggcccacaaggccagaaagctggccagactgaccaaggaggagagactgaagaagctgtgcgagctgtacgccaaggtgctgggcagcctggaggccctggagcccgtgcactacgaggagaagaactggtgcgaggagcagtacagcggcggctgctacaccacctacttcccccccggcatcctgacccagtacggcagagtgctgagacagcccgtggacagaatctacttcgccggcaccgagaccgccacccactggagcggctacatggagggcgccgtggaggccggcgagagagccgccagagagatcctgcacgccatgggcaagatccccgaggacgagatctggcagagcgagcccgagagcgtggacgtgcccgcccagcccatcaccaccaccttcctggagagacacctgcccagcgtgcccggcctgctgagactgatcggcctgaccaccatcttcagcgccaccgccctgggcttcctggcccacaagagaggcctgctggtgagagtgtag

SEQ ID NO: 89454 - DNA, 1515 bp, Artificial Sequence
  Description of Artificial Sequence: Synthetic coding sequence
atggccgccgccaagctgctgcacgacagcggcctgaacgtggtggtgctggaggccagagacagagtgggcggcagaacctacaccctgagaaaccagaaggtgaagtacgtggacctgggcggcagctacgtgggccccacccagaacagaatcctgagactggccaaggagctgggcctggagacctacaaggtgaacgaggtggagagactgatccaccacgtgaagggcaagagctaccccttcagaggccccttcccccccgtgtggaaccccatcacctacctggaccacaacaacttctggagaaccatggacgacatgggcagagagatccccagcgacgccccctggaaggcccccctggccgaggagtgggacaacatgaccatgaaggagctgctggacaagctgtgctggaccgagagcgccaagcagctggccaccctgttcgtgaacctgtgcgtgaccgccgagacccacgaggtgagcgccctgtggttcctgtggtacgtgaagcagtgcggcggcaccaccagaatcatcagcaccaccaacggcggccaggagagaaagttcgtgggcggcagcggccaggtgagcgagagaatcatggacctgctgggcgacagagtgaagctggagagacccgtgatctacatcgaccagaccagagagaacgtgctggtggagaccctgaaccacgagatgtacgaggccaagtacgtgatcagcgccatcccccccaccctgggcatgaagatccacttcaacccccccctgcccatgatgagaaaccagatgatcaccagagtgcccctgggcagcgtgatcaagtgcatcgtgtactacaaggagcccttctggagaaagaaggactactgcggcaccatgatcatcgacggcgaggaggcccccgtggcctacaccctggacgacaccaagcccgagggcaactacgccgccatcatgggcttcatcctggcccacaaggccagaaagctggccagactgaccaaggaggagagactgaagaagctgtgcgagctgtacgccaaggtgctgggcagcctggaggccctggagcccgtgcactacgaggagaagaactggtgcgaggagcagtacagcggcggctgctacaccacctacttcccccccggcatcctgacccagtacggcagagtgctgagacagcccgtggacagaatctacttcgccggcaccgagaccgccacccactggagcggctacatggagggcgccgtggaggccggcgagagagccgccagagagatcctgcacgccatgggcaagatccccgaggacgagatctggcagagcgagcccgagagcgtggacgtgcccgcccagcccatcaccaccaccttcctggagagacacctgcccagcgtgcccggcctgctgagactgatcggcctgaccaccatcttcagcgccaccgccctgggcttcctggcccacaagagaggcctgctggtgagagtgtag

SEQ ID NO: 89455 - DNA, 1236 bp, Artificial Sequence
  Description of Artificial Sequence: Synthetic coding sequence
atggccgccgccaagctgctgcacgacagcggcctgaacgtggtggtgctggaggccagagacagagtgggcggcagaacctacaccctgagaaaccagaaggtgaagtacgtggacctgggcggcagctacgtgggccccacccagaacagaatcctgagactggccaaggagctgggcctggagacctacaaggtgaacgaggtggagagactgatccaccacgtgaagggcaagagctaccccttcagaggccccttcccccccgtgtggaaccccatcacctacctggaccacaacaacttctggagaaccatggacgacatgggcagagagatccccagcgacgccccctggaaggcccccctggccgaggagtgggacaacatgaccatgaaggagctgctggacaagctgtgctggaccgagagcgccaagcagctggccaccctgttcgtgaacctgtgcgtgaccgccgagacccacgaggtgagcgccctgtggttcctgtggtacgtgaagcagtgcggcggcaccaccagaatcatcagcaccaccaacggcggccaggagagaaagttcgtgggcggcagcggccaggtgagcgagagaatcatggacctgctgggcgacagagtgaagctggagagacccgtgatctacatcgaccagaccagagagaacgtgctggtggagaccctgaaccacgagatgtacgaggccaagtacgtgatcagcgccatcccccccaccctgggcatgaagatccacttcaacccccccctgcccatgatgagaaaccagatgatcaccagagtgcccctgggcagcgtgatcaagtgcatcgtgtactacaaggagcccttctggagaaagaaggactactgcggcaccatgatcatcgacggcgaggaggcccccgtggcctacaccctggacgacaccaagcccgagggcaactacgccgccatcatgggcttcatcctggcccacaaggccagaaagctggccagactgaccaaggaggagagactgaagaagctgtgcgagctgtacgccaaggtgctgggcagcctggaggccctggagggcagcacccccgccagcggccaggacctgctgtgcagacacagagactgccacaccctggagagactgcacggcggcggctgcagaggcagaggcgagagcagccccagagaccccgcctgccacggcgaggacagcagaggctag

SEQ ID NO: 89456 - DNA, 741 bp, Artificial Sequence
  Description of Artificial Sequence: Synthetic coding sequence
atgttcgcccccagactgctggacttccagaagaccaagtacgccagattcatgaaccacagagtgcccgcccacaagagataccagcccaccgagtacgagcacgccgccaactgcgccacccacgccttctggatcatccccagcatcctgggcagcagcaacctgtacttcctgagcgacgacgactgggagaccatcagcgcctggatctacggcctgggcctgtgcggcctgttcgtggtgagcaccgtgttccacaccatcagctggaagaagagccacctgagaatggtggagcactgcctgcacatgttcgacagaatggtgatctacttcttcatcgccgccagctacgccccctggctgaacctgagagagctgggcccctgggccagccacatgagatggctggtgtggatcatggccagcgtgggcaccatctacgtgttcttcttccacgagagatacaagctggtggagctgctgtgctacgtggtgatgggcttcttccccgccctggtgatcctgagcatgcccaacaccgagggcatctgggagctggtgaccggcggcgtgttctactgcctgggcatggtgttcttcaagagcgacggcagaatccccttcgcccacgccatctggcacctgttcgtggccttcggcgccggcacccactactacgccatctggagatacctgtacctgcccagcaccctgcagaccaaggtgagcaagtag

SEQ ID NO: 89457 - DNA, 813 bp, Artificial Sequence
  Description of Artificial Sequence: Synthetic coding sequence
atgttcgcccccagactgctggacttccagaagaccaagtacgccagattcatgaaccacagagtgcccgcccacaagagataccagcccaccgagtacgagcacgccgccaactgcgccacccacgccttctggatcatccccagcatcctgggcagcagcaacctgtacttcctgagcgacgacgactgggagaccatcagcgcctggatctacggcctgggcctgtgcggcctgttcgtggtgagcaccgtgttccacaccatcagctggaagaagagccacctgagaatggtggagcactgcctgcacatgttcgacagaatggtgatctacttcttcatcgccgccagctacgccccctggctgaacctgagagagctgggcccctgggccagccacatgagatggctggtgtggatcatggccagcgtgggcaccatctacgtgttcttcttccacgagagaaccggcagctgcgtgcagttcctgagaggcgaggcctgccccaaggccggcaccgcctgcctgcccgccagatacaagctggtggagctgctgtgctacgtggtgatgggcttcttccccgccctggtgatcctgagcatgcccaacaccgagggcatctgggagctggtgaccggcggcgtgttctactgcctgggcatggtgttcttcaagagcgacggcagaatccccttcgcccacgccatctggcacctgttcgtggccttcggcgccggcacccactactacgccatctggagatacctgtacctgcccagcaccctgcagaccaaggtgagcaagtag

SEQ ID NO: 89458 - DNA, 582 bp, Artificial Sequence
  Description of Artificial Sequence: Synthetic coding sequence
atgttcgcccccagactgctggacttccagaagaccaagtacgccagattcatgaaccacagagtgcccgcccacaagagataccagcccaccgagtacgagcacgccgccaactgcgccacccacgccttctggatcatccccagcatcctgggcagcagcaacctgtacttcctgagcgacgacgactgggagaccatcagcgcctggatctacggcctgggcctgtgcggcctgttcgtggtgagcaccgtgttccacaccatcagctggaagaagagccacctgagaatggtggagcactgcctgcacatgttcgacagaatggtgatctacttcttcatcgccgccagctacgccccctggctgaacctgagagagctgggcccctgggccagccacatgagatggctggtgtggatcatggccagcgtgggcaccatctacgtgttcttcttccacgagagatacaagctggtggagctgctgtgctacgtggtgatgggcttcttccccgccctggtgatcctgagcatggccggcaagctgagacccggcatgacctgcctgaagagacagtag

SEQ ID NO: 89459 - DNA, 942 bp, Artificial Sequence
  Description of Artificial Sequence: Synthetic coding sequence
atggagaccggccccgaggaccccagcagcatgcccgaggagagcagccccagaagaaccccccagagcatcccctaccaggacctgccccacctggtgaacgccgacggccagtacctgttctgcagatactggaagcccaccggcacccccaaggccctgatcttcgtgagccacggcgccggcgagcacagcggcagatacgaggagctggccagaatgctgatgggcctggacctgctggtgttcgcccacgaccacgtgggccacggccagagcgagggcgagagaatggtggtgagcgacttccacgtgttcgtgagagacgtgctgcagcacgtggacagcatgcagaaggactaccccggcctgcccgtgttcctgctgggccacagcatgggcggcgccatcgccatcctgaccgccgccgagagacccggccacttcgccggcatggtgctgatcagccccctggtgctggccaaccccgagagcgccaccaccttcaaggtgctggccgccaaggtgctgaacctggtgctgcccaacctgagcctgggccccatcgacagcagcgtgctgagcagaaacaagaccgaggtggacatctacaacagcgaccccctgatctgcagagccggcctgaaggtgtgcttcggcatccagctgctgaacgccgtgagcagagtggagagagccctgcccaagctgaccgtgcccttcctgctgctgcagggcagcgccgacagactgtgcgacagcaagggcgcctacctgctgatggagctggccaagagccaggacaagaccctgaagatctacgagggcgcctaccacgtgctgcacaaggagctgcccgaggtgaccaacagcgtgttccacgagatcaacatgtgggtgagccagagaaccgccaccgccggcaccgccagccccccctag

SEQ ID NO: 89460 - DNA, 912 bp, Artificial Sequence
  Description of Artificial Sequence: Synthetic coding sequence
atgcccgaggagagcagccccagaagaaccccccagagcatcccctaccaggacctgccccacctggtgaacgccgacggccagtacctgttctgcagatactggaagcccaccggcacccccaaggccctgatcttcgtgagccacggcgccggcgagcacagcggcagatacgaggagctggccagaatgctgatgggcctggacctgctggtgttcgcccacgaccacgtgggccacggccagagcgagggcgagagaatggtggtgagcgacttccacgtgttcgtgagagacgtgctgcagcacgtggacagcatgcagaaggactaccccggcctgcccgtgttcctgctgggccacagcatgggcggcgccatcgccatcctgaccgccgccgagagacccggccacttcgccggcatggtgctgatcagccccctggtgctggccaaccccgagagcgccaccaccttcaaggtgctggccgccaaggtgctgaacctggtgctgcccaacctgagcctgggccccatcgacagcagcgtgctgagcagaaacaagaccgaggtggacatctacaacagcgaccccctgatctgcagagccggcctgaaggtgtgcttcggcatccagctgctgaacgccgtgagcagagtggagagagccctgcccaagctgaccgtgcccttcctgctgctgcagggcagcgccgacagactgtgcgacagcaagggcgcctacctgctgatggagctggccaagagccaggacaagaccctgaagatctacgagggcgcctaccacgtgctgcacaaggagctgcccgaggtgaccaacagcgtgttccacgagatcaacatgtgggtgagccagagaaccgccaccgccggcaccgccagccccccctag

SEQ ID NO: 89461 - DNA, 912 bp, Artificial Sequence; identical to SEQ ID NO: 89460
  Description of Artificial Sequence: Synthetic coding sequence

SEQ ID NO: 89462 - DNA, 852 bp, Artificial Sequence
  Description of Artificial Sequence: Synthetic coding sequence
atggagaccggccccgaggaccccagcagcatgcccgaggagagcagccccagaagaaccccccagagcatcccctaccaggacctgccccacctggtgaacgccgacggccagtacctgttctgcagatactggaagcccaccggcacccccaaggccctgatcttcgtgagccacggcgccggcgagcacagcggcagatacgaggagctggccagaatgctgatgggcctggacctgctggtgttcgcccacgaccacgtgggccacggccagagcgagggcgagagaatggtggtgagcgacttccacgtgttcgtgagagacgtgctgcagcacgtggacagcatgcagaaggactaccccggcctgcccgtgttcctgctgggccacagcatgggcggcgccatcgccatcctgaccgccgccgagagacccggccacttcgccggcatggtgctgatcagccccctggtgctggccaaccccgagagcgccaccaccttcaaggtggacatctacaacagcgaccccctgatctgcagagccggcctgaaggtgtgcttcggcatccagctgctgaacgccgtgagcagagtggagagagccctgcccaagctgaccgtgcccttcctgctgctgcagggcagcgccgacagactgtgcgacagcaagggcgcctacctgctgatggagctggccaagagccaggacaagaccctgaagatctacgagggcgcctaccacgtgctgcacaaggagctgcccgaggtgaccaacagcgtgttccacgagatcaacatgtgggtgagccagagaaccgccaccgccggcaccgccagccccccctag

SEQ ID NO: 89463 - DNA, 234 bp, Artificial Sequence
  Description of Artificial Sequence: Synthetic coding sequence
atgcccgaggagagcagccccagaagaaccccccagagcatcccctaccaggacctgccccacctggtgaacgccgacggccagtacctgttctgcagatactggaagcccaccggcacccccaaggccctgatcttcgtgagccacggcgccggcgagcacagcggcagatacgaggagctggccagaatgctgatgggcctggacctgctggtgttcgcccacgaccactag

SEQ ID NO: 89464 - DNA, 942 bp, Artificial Sequence
  Description of Artificial Sequence: Synthetic coding sequence
atgaagaccagacccgaggaccccagcagcatgcccgaggagagcagccccagaagaaccccccagagcatcccctaccaggacctgccccacctggtgaacgccgacggccagtacctgttctgcagatactggaagcccaccggcacccccaaggccctgatcttcgtgagccacggcgccggcgagcacagcggcagatacgaggagctggccagaatgctgatgggcctggacctgctggtgttcgcccacgaccacgtgggccacggccagagcgagggcgagagaatggtggtgagcgacttccacgtgttcgtgagagacgtgctgcagcacgtggacagcatgcagaaggactaccccggcctgcccgtgttcctgctgggccacagcatgggcggcgccatcgccatcctgaccgccgccgagagacccggccacttcgccggcatggtgctgatcagccccctggtgctggccaaccccgagagcgccaccaccttcaaggtgctggccgccaaggtgctgaacctggtgctgcccaacctgagcctgggccccatcgacagcagcgtgctgagcagaaacaagaccgaggtggacatctacaacagcgaccccctgatctgcagagccggcctgaaggtgtgcttcggcatccagctgctgaacgccgtgagcagagtggagagagccctgcccaagctgaccgtgcccttcctgctgctgcagggcagcgccgacagactgtgcgacagcaagggcgcctacctgctgatggagctggccaagagccaggacaagaccctgaagatctacgagggcgcctaccacgtgctgcacaaggagctgcccgaggtgaccaacagcgtgttccacgagatcaacatgtgggtgagccagagaaccgccaccgccggcaccgccagccccccctag

SEQ ID NO: 89465 - DNA, 1842 bp, Artificial Sequence
  Description of Artificial Sequence: Synthetic coding sequence
atgtgctgctggcccctgctgctgctgtggggcctgctgcccggcaccgccgccggcggcagcggcagaacctacccccacagaaccctgctggacagcgagggcaagtactggctgggctggagccagagaggcagccagatcgccttcagactgcaggtgagaaccgccggctacgtgggcttcggcttcagccccaccggcgccatggccagcgccgacatcgtggtgggcggcgtggcccacggcagaccctacctgcaggactacttcaccaacgccaacagagagctgaagaaggacgcccagcaggactaccacctggagtacgccatggagaacagcacccacaccatcatcgagttcaccagagagctgcacacctgcgacatcaacgacaagagcatcaccgacagcaccgtgagagtgatctgggcctaccaccacgaggacgccggcgaggccggccccaagtaccacgacagcaacagaggcaccaagagcctgagactgctgaaccccgagaagaccagcgtgctgagcaccgccctgccctacttcgacctggtgaaccaggacgtgcccatccccaacaaggacaccacctactggtgccagatgttcaagatccccgtgttccaggagaagcaccacgtgatcaaggtggagcccgtgatccagagaggccacgagagcctggtgcaccacatcctgctgtaccagtgcagcaacaacttcaacgacagcgtgctggagagcggccacgagtgctaccaccccaacatgcccgacgccttcctgacctgcgagaccgtgatcttcgcctgggccatcggcggcgagggcttcagctaccccccccacgtgggcctgagcctgggcacccccctggacccccactacgtgctgctggaggtgcactacgacaaccccacctacgaggagggcctgatcgacaacagcggcctgagactgttctacaccatggacatcagaaagtacgacgccggcgtgatcgaggccggcctgtgggtgagcctgttccacaccatcccccccggcatgcccgagttccagagcgagggccactgcaccctggagtgcctggaggaggccctggaggccgagaagcccagcggcatccacgtgttcgccgtgctgctgcacgcccacctggccggcagaggcatcagactgagacacttcagaaagggcaaggagatgaagctgctggcctacgacgacgacttcgacttcaacttccaggagttccagtacctgaaggaggagcagaccatcctgcccggcgacaacctgatcaccgagtgcagatacaacaccaaggacagagccgagatgacctggggcggcctgagcaccagaagcgagatgtgcctgagctacctgctgtactaccccagaatcaacctgaccagatgcgccagcatccccgacatcatggagcagctgcagttcatcggcgtgaaggagatctacagacccgtgaccacctggcccttcatcatcaagagccccaagcagtacaagaacctgagcttcatggacgccatgaacaagttcaagtggaccaagaaggagggcctgagcttcaacaagctggtgctgagcctgcccgtgaacgtgagatgcagcaagaccgacaacgccgagtggagcatccagggcatgaccgccctgccccccgacatcgagagaccctacaaggccgagcccctggtgtgcggcaccagcagcagcagcagcctgcacagagacttcagcatcaacctgctggtgtgcctgctgctgctgagctgcaccctgagcaccaagagcctgtag

SEQ ID NO: 89466 - DNA, 1023 bp, Artificial Sequence; identical to SEQ ID NO: 83891
  Description of Artificial Sequence: Synthetic coding sequence

SEQ ID NO: 89467 - DNA, 1089 bp, Artificial Sequence
  Description of Artificial Sequence: Synthetic coding sequence
atggcccccaagcaggaccccaagcccaagttccaggagggcgagagagtgctgtgcttccacggccccctgctgtacgaggccaagtgcgtgaaggtggccatcaaggacaagcaggtgaagtacttcatccactacagcggctggaacaagaagagcgccgtgagacccagaagaagcgagaagagcctgaagacccacgaggacatcgtggccctgttccccgtgcccgagggcgcccccagcgtgcaccaccccctgctgaccagcagctgggacgagtgggtgcccgagagcagagtgctgaagtacgtggacaccaacctgcagaagcagagagagctgcagaaggccaaccaggagcagtacgccgagggcaagatgagaggcgccgcccccggcaagaagaccagcggcctgcagcagaagaacgtggaggtgaagaccaagaagaacaagcagaagacccccggcaacggcgacggcggcagcaccagcgagaccccccagccccccagaaagaagagagccagagtggaccccaccgtggagaacgaggagaccttcatgaacagagtggaggtgaaggtgaagatccccgaggagctgaagccctggctggtggacgactgggacctgatcaccagacagaagcagctgttctacctgcccgccaagaagaacgtggacagcatcctggaggactacgccaactacaagaagagcagaggcaacaccgacaacaaggagtacgccgtgaacgaggtggtggccggcatcaaggagtacttcaacgtgatgctgggcacccagctgctgtacaagttcgagagaccccagtacgccgagatcctggccgaccaccccgacgcccccatgagccaggtgtacggcgccccccacctgctgagactgttcgtgagaatcggcgccatgctggcctacacccccctggacgagaagagcctggccctgctgctgaactacctgcacgacttcctgaagtacctggccaagaacagcgccaccctgttcagcgccagcgactacgaggtggccccccccgagtaccacagaaaggccgtgtag

SEQ ID NO: 89468 - DNA, 1047 bp, Artificial Sequence
  Description of Artificial Sequence: Synthetic coding sequence
atgatccccttcccccacccccaggtgaccgacgccctgggcagatacagcaactacatcctgagcagcaccgtggagagccccagcctgagaagcatgaacttcgagaagcagggcgagagagtgctgtgcttccacggccccctgctgtacgaggccaagtgcgtgaaggtggccatcaaggacaagcaggtgaagtacttcatccactacagcggctggaacaagaactgggacgagtgggtgcccgagagcagagtgctgaagtacgtggacaccaacctgcagaagcagagagagctgcagaaggccaaccaggagcagtacgccgagggcaagatgagaggcgccgcccccggcaagaagaccagcggcctgcagcagaagaacgtggaggtgaagaccaagaagaacaagcagaagacccccggcaacggcgacggcggcagcaccagcgagaccccccagccccccagaaagaagagagccagagtggaccccaccgtggagaacgaggagaccttcatgaacagagtggaggtgaaggtgaagatccccgaggagctgaagccctggctggtggacgactgggacctgatcaccagacagaagcagctgttctacctgcccgccaagaagaacgtggacagcatcctggaggactacgccaactacaagaagagcagaggcaacaccgacaacaaggagtacgccgtgaacgaggtggtggccggcatcaaggagtacttcaacgtgatgctgggcacccagctgctgtacaagttcgagagaccccagtacgccgagatcctggccgaccaccccgacgcccccatgagccaggtgtacggcgccccccacctgctgagactgttcgtgagaatcggcgccatgctggcctacacccccctggacgagaagagcctggccctgctgctgaactacctgcacgacttcctgaagtacctggccaagaacagcgccaccctgttcagcgccagcgactacgaggtggccccccccgagtaccacagaaaggccgtgtag

SEQ ID NO: 89469 - DNA, 972 bp, Artificial Sequence
  Description of Artificial Sequence: Synthetic coding sequence
atggcccccaagcaggaccccaagcccaagttccaggagggcgagagagtgctgtgcttccacggccccctgctgtacgaggccaagtgcgtgaaggtggccatcaaggacaagcaggtgaagtacttcatccactacagcggctggaacaagaactgggacgagtgggtgcccgagagcagagtgctgaagtacgtggacaccaacctgcagaagcagagagagctgcagaaggccaaccaggagcagtacgccgagggcaagatgagaggcgccgcccccggcaagaagaccagcggcctgcagcagaagaacgtggaggtgaagaccaagaagaacaagcagaagacccccggcaacggcgacggcggcagcaccagcgagaccccccagccccccagaaagaagagagccagagtggaccccaccgtggagaacgaggagaccttcatgaacagagtggaggtgaaggtgaagatccccgaggagctgaagccctggctggtggacgactgggacctgatcaccagacagaagcagctgttctacctgcccgccaagaagaacgtggacagcatcctggaggactacgccaactacaagaagagcagaggcaacaccgacaacaaggagtacgccgtgaacgaggtggtggccggcatcaaggagtacttcaacgtgatgctgggcacccagctgctgtacaagttcgagagaccccagtacgccgagatcctggccgaccaccccgacgcccccatgagccaggtgtacggcgccccccacctgctgagactgttcgtgagaatcggcgccatgctggcctacacccccctggacgagaagagcctggccctgctgctgaactacctgcacgacttcctgaagtacctggccaagaacagcgccaccctgttcagcgccagcgactacgaggtggccccccccgagtaccacagaaaggccgtgtag

SEQ ID NO: 89470 - DNA, 708 bp, Artificial Sequence
  Description of Artificial Sequence: Synthetic coding sequence
atgagaggcgccgcccccggcaagaagaccagcggcctgcagcagaagaacgtggaggtgaagaccaagaagaacaagcagaagacccccggcaacggcgacggcggcagcaccagcgagaccccccagccccccagaaagaagagagccagagtggaccccaccgtggagaacgaggagaccttcatgaacagagtggaggtgaaggtgaagatccccgaggagctgaagccctggctggtggacgactgggacctgatcaccagacagaagcagctgttctacctgcccgccaagaagaacgtggacagcatcctggaggactacgccaactacaagaagagcagaggcaacaccgacaacaaggagtacgccgtgaacgaggtggtggccggcatcaaggagtacttcaacgtgatgctgggcacccagctgctgtacaagttcgagagaccccagtacgccgagatcctggccgaccaccccgacgcccccatgagccaggtgtacggcgccccccacctgctgagactgttcgtgagaatcggcgccatgctggcctacacccccctggacgagaagagcctggccctgctgctgaactacctgcacgacttcctgaagtacctggccaagaacagcgccaccctgttcagcgccagcgactacgaggtggccccccccgagtaccacagaaaggccgtgtag

SEQ ID NO: 89471 - DNA, 708 bp, Artificial Sequence; identical to SEQ ID NO: 89470
  Description of Artificial Sequence: Synthetic coding sequence

SEQ ID NO: 89472 - DNA, 345 bp, Artificial Sequence
  Description of Artificial Sequence: Synthetic coding sequence
atggtgagcagaaaggccgtggccgccctgctggtggtgcacgtggccgccatgctggccagccagaccgaggccttcgtgcccatcttcacctacggcgagctgcagagaatgcaggagaaggagagaaacaagggccagaagaagagcctgagcgtgtggcagagaagcggcgaggagggccccgtggaccccgccgagcccatcagagaggaggagaacgagatgatcaagctgaccgcccccctggagatcggcatgagaatgaacagcagacagctggagaagtaccccgccaccctggagggcctgctgagcgagatgctgccccagcacgccaagtag

SEQ ID NO: 89473 - DNA, 348 bp, Artificial Sequence
  Description of Artificial Sequence: Synthetic coding sequence
atggtgagcagaaaggccgtggccgccctgctggtggtgcacgtggccgccatgctggccagccagaccgaggccttcgtgcccatcttcacctacggcgagctgcagagaatgcaggagaaggagagaaacaagggccagaagaagagcctgagcgtgtggcagagaagcggcgaggagggccccgtggaccccgccgagcccatcagagaggaggagaacgagatgatcaagctgaccgcccccctggagatcggcatgagaatgaacagcagacagctggagaagtaccccgccaccctggagggcctgctgagcgagatgctgccccagcacgccgccaagtag

SEQ ID NO: 89474 - DNA, 327 bp, Artificial Sequence
  Description of Artificial Sequence: Synthetic coding sequence
atggtgagcagaaaggccgtggccgccctgctggtggtgcacgtggccgccatgctggccagccagaccgaggccttcgtgcccatcttcacctacggcgagctgcagagaatgcaggagaaggagagaaacaagggccagaagaagagcctgagcgtgtggcagagaagcggcgaggagggccccgtggaccccgccgagcccatcagagaggaggagaacgagatgatcaagctgaccgcccccctggagatcggcatgagaatgaacagcagacagctggagaagtaccccgccaccctggagggcctgctgaccgccaagtag

SEQ ID NO: 89475 - DNA, 1011 bp, Artificial Sequence
  Description of Artificial Sequence: Synthetic coding sequence
atggccagaagaagaagccagagagtgtgcgccagcggccccagcatgctgaacagcgccagaggcgcccccgagctgctgagaggcaccgccaccaacgccgaggtgagcgccgccgccgccggcgccaccggcagcgaggagctgccccccggcgacagaggctgcagaaacggcggcggcagaggccccgccgccaccaccagcagcaccggcgtggccgtgggcgccgagcacggcgaggacagcctgagcagaaagcccgaccccgagcccggcagaatggaccaccaccagcccggcaccggcagataccaggtgctgctgaacgaggaggacaacagcgagagcagcgccatcgagcagccccccaccagcaaccccgccccccagatcgtgcaggccgccagcagcgcccccgccctggagaccgacagcagcccccccccctacagcagcatcaccgtggaggtgcccaccaccagcgacaccgaggtgtacggcgagttctaccccgtgccccccccctacagcgtggccaccagcctgcccacctacgacgaggccgagaaggccaaggccgccgccatggccgccgccgccgccgagaccagccagagaatccaggaggaggagtgcccccccagagacgacttcagcgacgccgaccagctgagagtgggcaacgacggcatcttcatgctggccttcttcatggccttcatcttcaactggctgggcttctgcctgagcttctgcatcaccaacaccatcgccggcagatacggcgccatctgcggcttcggcctgagcctgatcaagtggatcctgatcgtgagattcagcgactacttcaccggctacttcaacggccagtactggctgtggtggatcttcctggtgctgggcctgctgctgttcttcagaggcttcgtgaactacctgaaggtgagaaacatgagcgagagcatggccgccgcccacagaaccagatacttcttcctgctgtag

SEQ ID NO: 89476 - DNA, 1161 bp, Artificial Sequence
  Description of Artificial Sequence: Synthetic coding sequence
atgggcagcccctggaacggcagcgacggccccgagggcgccagagagcccccctggcccgccctgcccccctgcgacgagagaagatgcagccccttccccctgggcgccctggtgcccgtgaccgccgtgtgcctgtgcctgttcgtggtgggcgtgagcggcaacgtggtgaccgtgatgctgatcggcagatacagagacatgagaaccaccaccaacctgtacctgggcagcatggccgtgagcgacctgctgatcctgctgggcctgcccttcgacctgtacagactgtggagaagcagaccctgggtgttcggccccctgctgtgcagactgagcctgtacgtgggcgagggctgcacctacgccaccctgctgcacatgaccgccctgagcgtggagagatacctggccatctgcagacccctgagagccagagtgctggtgaccagaagaagagtgagagccctgatcgccgtgctgtgggccgtggccctgctgagcgccggccccttcctgttcctggtgggcgtggagcaggaccccggcatcagcgtggtgcccggcctgaacggcaccgccagaatcgccagcagccccctggccagcagcccccccctgtggctgagcagagcccccccccccagcccccccagcggccccgagaccgccgaggccgccgccctgttcagcagagagtgcagacccagccccgcccagctgggcgccctgagagtgatgctgtgggtgaccaccgcctacttcttcctgcccttcctgtgcctgagcatcctgtacggcctgatcggcagagagctgtggagcagcagaagacccctgagaggccccgccgccagcggcagagagagaggccacagacagaccgtgagagtgctgagaaagtggagcagaagaggcagcaaggacgcctgcctgcagagcgccccccccggcaccgcccagaccctgggccccctgcccctgctggcccagctgtgggcccccctgcccgcccccttccccatcagcatccccgccagcaccagaagaggcggcggcagcggcatctacaacctgctggtggccctgcccagatggcagaaccacctgcacaagcacggcagattcgccgacgacgtgctgctgagcgtgctgtag

SEQ ID NO: 89477 - DNA, 1206 bp, Artificial Sequence
  Description of Artificial Sequence: Synthetic coding sequence
atggagaagagcaagaacttcagaatcgacgccctgctggccgtggacccccccagagccgccagcgcccagagcgcccccctggccctggtgaccagcctggccgccgccgccagcggcaccggcggcggcggcggcggcggcggcgccagcggcggcaccagcggcagctgcagccccgccagcagcgagccccccgccgcccccgccgacagactgagagccgagagccccagcccccccagactgctggccgcccactgcgccctgctgcccaagcccggcttcctgggcgccggcggcggcggcggcggcaccggcggcggccacggcggcccccaccaccacgcccaccccggcgccgccgccgccgccgccgccgccgccgccgccgccgccgccggcggcctggccctgggcctgcaccccggcggcgcccagggcggcgccggcctgcccgcccaggccgccctgtacggccaccccgtgtacggctacagcgccgccgccgccgccgccgccctggccggccagcaccccgccctgagctacagctacccccaggtgcagggcgcccaccccgcccaccccgccgaccccatcaagctgggcgccggcaccttccagctggaccagtggctgagagccagcaccgccggcatgatcctgcccaagatgcccgacttcaacagccaggcccagagcaacctgctgggcaagtgcagaagacccagaaccgccttcaccagccagcagctgctggagctggagcaccagttcaagctgaacaagtacctgagcagacccaagagattcgaggtggccaccagcctgatgctgaccgagacccaggtgaagatctggttccagaacagaagaatgaagtggaagagaagcaagaaggccaaggagcaggccgcccaggaggccgagaagcagaagggcggcggcggcggcgccggcaagggcggcgccgaggagcccggcgccgaggagctgctgggcccccccgcccccggcgacaagggcagcggcagaagactgagagacctgagagacagcgaccccgaggaggacgaggacgaggacgacgaggaccacttcccctacagcaacggcgccagcgtgcacgccgccagcagcgactgcagcagcgaggacgacagccccccccccagacccagccaccagcccgccccccagtag

SEQ ID NO: 89478 - DNA, 696 bp, Artificial Sequence
  Description of Artificial Sequence: Synthetic coding sequence
gccgccgccgccctggccggccagcaccccgccctgagctacagctacccccaggtgcagggcgcccaccccgcccaccccgccgaccccatcaagctgggcgccggcaccttccagctggaccagtggctgagagccagcaccgccggcatgatcctgcccaagatgcccgacttcaacagccaggcccagagcaacctgctgggcaagtgcagaagacccagaaccgccttcaccagccagcagctgctggagctggagcaccagttcaagctgaacaagtacctgagcagacccaagagattcgaggtggccaccagcctgatgctgaccgagacccaggtgaagatctggttccagaacagaagaatgaagtggaagagaagcaagaaggccaaggagcaggccgcccaggaggccgagaagcagaagggcggcggcggcggcgccggcaagggcggcgccgaggagcccggcgccgaggagctgctgggcccccccgcccccggcgacaagggcagcggcagaagactgagagacctgagagacagcgaccccgaggaggacgaggacgaggacgacgaggaccacttcccctacagcaacggcgccagcgtgcacgccgccagcagcgactgcagcagcgaggacgacagccccccccccagacccagccaccagcccgccccccagtag

SEQ ID NO: 89479 - DNA, 570 bp, Artificial Sequence
  Description of Artificial Sequence: Synthetic coding sequence
atgggcggcctgagcaccgtgggcgcctgccccggcatcctgggcgcccagcaggcccaggcccagagcaacctgctgggcaagtgcagaagacccagaaccgccttcaccagccagcagctgctggagctggagcaccagttcaagctgaacaagtacctgagcagacccaagagattcgaggtggccaccagcctgatgctgaccgagacccaggtgaagatctggttccagaacagaagaatgaagtggaagagaagcaagaaggccaaggagcaggccgcccaggaggccgagaagcagaagggcggcggcggcggcgccggcaagggcggcgccgaggagcccggcgccgaggagctgctgggcccccccgcccccggcgacaagggcagcggcagaagactgagagacctgagagacagcgaccccgaggaggacgaggacgaggacgacgaggaccacttcccctacagcaacggcgccagcgtgcacgccgccagcagcgactgcagcagcgaggacgacagccccccccccagacccagccaccagcccgccccccagtag

SEQ ID NO: 89480 - DNA, 1692 bp, Artificial Sequence
  Description of Artificial Sequence: Synthetic coding sequence
atgcccagcaagttcagctgcagacagctgagagaggccggccagtgcttcgagagcttcctggtggtgagaggcctggacatggagaccgacagagagagactgagaaccatctacaacagagacttcaagatcagcttcggcacccccgcccccggcttcagcagcatgctgtacggcatgaagatcgccaacctggcctacgtgaccaagaccagagtgagattcttcagactggacagatgggccgacgtgagattccccgagaagagaagaatgaagctgggcagcgacatcagcaagcaccacaagagcctgctggccaagatcttctacgacagagccgagtacctgcacggcaagcacggcgtggacgtggaggtgcagggcccccacgaggccagagacggccagctgctgatcagactggacctgaacagaaaggaggtgctgaccctgagactgagaaacggcggcacccagagcgtgaccctgacccacctgttccccctgtgcagaaccccccagttcgccttctacaacgaggaccaggagctgccctgccccctgggccccggcgagtgctacgagctgcacgtgcactgcaagaccagcttcgtgggctacttccccgccaccgtgctgtgggagctgctgggccccggcgagagcggcagcgagggcgccggcaccttctacatcgccagattcctggccgccgtggcccacagccccctggccgcccagctgaagcccatgacccccttcaagagaaccagaatcaccggcaaccccgtggtgaccaacagaatcgaggagggcgagagacccgacagagccaagggctacgacctggagctgagcatggccctgggcacctactaccccccccccagactgagacagctgctgcccatgctgctgcagggcaccagcatcttcaccgcccccaaggagatcgccgagatcaaggcccagctggagaccgccctgaagtggagaaactacgaggtgaagctgagactgctgctgcacctggaggagctgcagatggagcacgacatcagacactacgacctggagagcgtgcccatgacctgggaccccgtggaccagaaccccagactgctgaccctggaggtgcccggcgtgaccgagagcagacccagcgtgctgagaggcgaccacctgttcgccctgctgagcagcgagacccaccaggaggaccccatcacctacaagggcttcgtgcacaaggtggagctggacagagtgaagctgagcttcagcatgagcctgctgagcagattcgtggacggcctgaccttcaaggtgaacttcaccttcaacagacagcccctgagagtgcagcacagagccctggagctgaccggcagatggctgctgtggcccatgctgttccccgtggcccccagagacgtgcccctgctgcccagcgacgtgaagctgaagctgtacgacagaagcctggagagcaaccccgagcagctgcaggccatgagacacatcgtgaccggcaccaccagacccgccctgaccgcctgcctgaccctgaaccagaaccccgccgagctgcccctgcagggcaccggcagactgggcgagggcgtgtacaaccccagccacagcacccccagccccgccggcgagaacgacaccagcagctgctag

SEQ ID NO: 89481 - DNA, 3012 bp, Artificial Sequence
  Description of Artificial Sequence: Synthetic coding sequence
atgcccagcaagttcagctgcagacagctgagagaggccggccagtgcttcgagagcttcctggtggtgagaggcctggacatggagaccgacagagagagactgagaaccatctacaacagagacttcaagatcagcttcggcacccccgcccccggcttcagcagcatgctgtacggcatgaagatcgccaacctggcctacgtgaccaagaccagagtgagattcttcagactggacagatgggccgacgtgagattccccgagaagagaagaatgaagctgggcagcgacatcagcaagcaccacaagagcctgctggccaagatcttctacgacagagccgagtacctgcacggcaagcacggcgtggacgtggaggtgcagggcccccacgaggccagagacggccagctgctgatcagactggacctgaacagaaaggaggtgctgaccctgagactgagaaacggcggcacccagagcgtgaccctgacccacctgttccccctgtgcagaaccccccagttcgccttctacaacgaggaccaggagctgccctgccccctgggccccggcgagtgctacgagctgcacgtgcactgcaagaccagcttcgtgggctacttccccgccaccgtgctgtgggagctgctgggccccggcgagagcggcagcgagggcgccggcaccttctacatcgccagattcctggccgccgtggcccacagccccctggccgcccagctgaagcccatgacccccttcaagagaaccagaatcaccggcaaccccgtggtgaccaacagaatcgaggagggcgagagacccgacagagccaagggctacgacctggagctgagcatggccctgggcacctactaccccccccccagactgagacagctgctgcccatgctgctgcagggcaccagcatcttcaccgcccccaaggagatcgccgagatcaaggcccagctggagaccgccctgaagtggagaaactacgaggtgaagctgagactgctgctgcacctggaggagctgcagatggagcacgacatcagacactacgacctggagagcgtgcccatgacctgggaccccgtggaccagaaccccagactgctgaccctggaggtgcccggcgtgaccgagagcagacccagcgtgctgagaggcgaccacctgttcgccctgctgagcagcgagacccaccaggaggaccccatcacctacaagggcttcgtgcacaaggtggagctggacagagtgaagctgagcttcagcatgagcctgctgagcagattcgtggacggcctgaccttcaaggtgaacttcaccttcaacagacagcccctgagagtgcagcacagagccctggagctgaccggcagatggctgctgtggcccatgctgttccccgtggcccccagagacgtgcccctgctgcccagcgacgtgaagctgaagctgtacgacagaagcctggagagcaaccccgagcagctgcaggccatgagacacatcgtgaccggcaccaccagacccgccccctacatcatcttcggcccccccggcaccggcaagaccgtgaccctggtggaggccatcaagcaggtggtgaagcacctgcccaaggcccacatcctggcctgcgcccccagcaacagcggcgccgacctgctgtgccagagactgagagtgcacctgcccagcagcatctacagactgctggcccccagcagagacatcagaatggtgcccgaggacatcaagccctgctgcaactgggacgccaagaagggcgagtacgtgttccccgccaagaagaagctgcaggagtacagagtgctgatcaccaccctgatcaccgccggcagactggtgagcgcccagttccccatcgaccacttcacccacatcttcatcgacgaggccggccactgcatggagcccgagagcctggtggccatcgccggcctgatggaggtgaaggagaccggcgaccccggcggccagctggtgctggccggcgaccccagacagctgggccccgtgctgagaagccccctgacccagaagcacggcctgggctacagcctgctggagagactgctgacctacaacagcctgtacaagaagggccccgacggctacgacccccagttcatcaccaagctgctgagaaactacagaagccaccccaccatcctggacatccccaaccagctgtactacgagggcgagctgcaggcctgcgccgacgtggtggacagagagagattctgcagatgggccggcctgcccagacagggcttccccatcatcttccacggcgtgatgggcaaggacgagagagagggcaacagccccagcttcttcaaccccgaggaggccgccaccgtgaccagctacctgaagctgctgctggcccccagcagcaagaagggcaaggccagactgagccccagaagcgtgggcgtgatcagcccctacagaaagcaggtggagaagatcagatactgcatcaccaagctggacagagagctgagaggcctggacgacatcaaggacctgaaggtgggcagcgtggaggagttccagggccaggagagaagcgtgatcctgatcagcaccgtgagaagcagccagagcttcgtgcagctggacctggacttcaacctgggcttcctgaagaaccccaagagattcaacgtggccgtgaccagagccaaggccctgctgatcatcgtgggcaaccccctgctgctgggccacgaccccgactggaaggtgttcctggagttctgcaaggagaacggcggctacaccggctgccccttccccgccaagctggacctgcagcagggccagaacctgctgcagggcctgagcaagctgagccccagcaccagcggcccccacagccacgactacctgccccaggagagagagggcgagggcggcctgagcctgcaggtggagcccgagtggagaaacgagctgtag

SEQ ID NO: 89482 - DNA, 2844 bp, Artificial Sequence
  Description of Artificial Sequence: Synthetic coding sequence
atgctgtacggcatgaagatcgccaacctggcctacgtgaccaagaccagagtgagattcttcagactggacagatgggccgacgtgagattccccgagaagagaagaatgaagctgggcagcgacatcagcaagcaccacaagagcctgctggccaagatcttctacgacagagccgagtacctgcacggcaagcacggcgtggacgtggaggtgcagggcccccacgaggccagagacggccagctgctgatcagactggacctgaacagaaaggaggtgctgaccctgagactgagaaacggcggcacccagagcgtgaccctgacccacctgttccccctgtgcagaaccccccagttcgccttctacaacgaggaccaggagctgccctgccccctgggccccggcgagtgctacgagctgcacgtgcactgcaagaccagcttcgtgggctacttccccgccaccgtgctgtgggagctgctgggccccggcgagagcggcagcgagggcgccggcaccttctacatcgccagattcctggccgccgtggcccacagccccctggccgcccagctgaagcccatgacccccttcaagagaaccagaatcaccggcaaccccgtggtgaccaacagaatcgaggagggcgagagacccgacagagccaagggctacgacctggagctgagcatggccctgggcacctactaccccccccccagactgagacagctgctgcccatgctgctgcagggcaccagcatcttcaccgcccccaaggagatcgccgagatcaaggcccagctggagaccgccctgaagtggagaaactacgaggtgaagctgagactgctgctgcacctggaggagctgcagatggagcacgacatcagacactacgacctggagagcgtgcccatgacctgggaccccgtggaccagaaccccagactgctgaccctggaggtgcccggcgtgaccgagagcagacccagcgtgctgagaggcgaccacctgttcgccctgctgagcagcgagacccaccaggaggaccccatcacctacaagggcttcgtgcacaaggtggagctggacagagtgaagctgagcttcagcatgagcctgctgagcagattcgtggacggcctgaccttcaaggtgaacttcaccttcaacagacagcccctgagagtgcagcacagagccctggagctgaccggcagatggctgctgtggcccatgctgttccccgtggcccccagagacgtgcccctgctgcccagcgacgtgaagctgaagctgtacgacagaagcctggagagcaaccccgagcagctgcaggccatgagacacatcgtgaccggcaccaccagacccgccccctacatcatcttcggcccccccggcaccggcaagaccgtgaccctggtggaggccatcaagcaggtggtgaagcacctgcccaaggcccacatcctggcctgcgcccccagcaacagcggcgccgacctgctgtgccagagactgagagtgcacctgcccagcagcatctacagactgctggcccccagcagagacatcagaatggtgcccgaggacatcaagccctgctgcaactgggacgccaagaagggcgagtacgtgttccccgccaagaagaagctgcaggagtacagagtgctgatcaccaccctgatcaccgccggcagactggtgagcgcccagttccccatcgaccacttcacccacatcttcatcgacgaggccggccactgcatggagcccgagagcctggtggccatcgccggcctgatggaggtgaaggagaccggcgaccccggcggccagctggtgctggccggcgaccccagacagctgggccccgtgctgagaagccccctgacccagaagcacggcctgggctacagcctgctggagagactgctgacctacaacagcctgtacaagaagggccccgacggctacgacccccagttcatcaccaagctgctgagaaactacagaagccaccccaccatcctggacatccccaaccagctgtactacgagggcgagctgcaggcctgcgccgacgtggtggacagagagagattctgcagatgggccggcctgcccagacagggcttccccatcatcttccacggcgtgatgggcaaggacgagagagagggcaacagccccagcttcttcaaccccgaggaggccgccaccgtgaccagctacctgaagctgctgctggcccccagcagcaagaagggcaaggccagactgagccccagaagcgtgggcgtgatcagcccctacagaaagcaggtggagaagatcagatactgcatcaccaagctggacagagagctgagaggcctggacgacatcaaggacctgaaggtgggcagcgtggaggagttccagggccaggagagaagcgtgatcctgatcagcaccgtgagaagcagccagagcttcgtgcagctggacctggacttcaacctgggcttcctgaagaaccccaagagattcaacgtggccgtgaccagagccaaggccctgctgatcatcgtgggcaaccccctgctgctgggccacgaccccgactggaaggtgttcctggagttctgcaaggagaacggcggctacaccggctgccccttccccgccaagctggacctgcagcagggccagaacctgctgcagggcctgagcaagctgagccccagcaccagcggcccccacagccacgactacctgccccaggagagagagggcgagggcggcctgagcctgcaggtggagcccgagtggagaaacgagctgtag

SEQ ID NO: 89483 - DNA, 3012 bp, Artificial Sequence; identical to SEQ ID NO: 89481
  Description of Artificial Sequence: Synthetic coding sequence

SEQ ID NO: 89484 - DNA, 2826 bp, Artificial Sequence
  Description of Artificial Sequence: Synthetic coding sequence
atggagaccgacagagagagactgagaaccatctacaacagagacttcaagatcagcttcggcacccccgcccccggcttcagcagcatgctgtacggcatgaagatcgccaacctggcctacgtgaccaagaccagagtgagattcttcagactggacagatgggccgacgtgagattccccgagaagagaagaatgaagctgggcagcgacatcagcaagcaccacaagagcctgctggccaagatcttctacgacagagccgagtacctgcacggcaagcacggcggcacccagagcgtgaccctgacccacctgttccccctgtgcagaaccccccagttcgccttctacaacgaggaccaggagctgccctgccccctgggccccggcgagtgctacgagctgcacgtgcactgcaagaccagcttcgtgggctacttccccgccaccgtgctgtgggagctgctgggccccggcgagagcggcagcgagggcgccggcaccttctacatcgccagattcctggccgccgtggcccacagccccctggccgcccagctgaagcccatgacccccttcaagagaaccagaatcaccggcaaccccgtggtgaccaacagaatcgaggagggcgagagacccgacagagccaagggctacgacctggagctgagcatggccctgggcacctactaccccccccccagactgagacagctgctgcccatgctgctgcagggcaccagcatcttcaccgcccccaaggagatcgccgagatcaaggcccagctggagaccgccctgaagtggagaaactacgaggtgaagctgagactgctgctgcacctggaggagctgcagatggagcacgacatcagacactacgacctggagagcgtgcccatgacctgggaccccgtggaccagaaccccagactgctgaccctggaggtgcccggcgtgaccgagagcagacccagcgtgctgagaggcgaccacctgttcgccctgctgagcagcgagacccaccaggaggaccccatcacctacaagggcttcgtgcacaaggtggagctggacagagtgaagctgagcttcagcatgagcctgctgagcagattcgtggacggcctgaccttcaaggtgaacttcaccttcaacagacagcccctgagagtgcagcacagagccctggagctgaccggcagatggctgctgtggcccatgctgttccccgtggcccccagagacgtgcccctgctgcccagcgacgtgaagctgaagctgtacgacagaagcctggagagcaaccccgagcagctgcaggccatgagacacatcgtgaccggcaccaccagacccgccccctacatcatcttcggcccccccggcaccggcaagaccgtgaccctggtggaggccatcaagcaggtggtgaagcacctgcccaaggcccacatcctggcctgcgcccccagcaacagcggcgccgacctgctgtgccagagactgagagtgcacctgcccagcagcatctacagactgctggcccccagcagagacatcagaatggtgcccgaggacatcaagccctgctgcaactgggacgccaagaagggcgagtacgtgttccccgccaagaagaagctgcaggagtacagagtgctgatcaccaccctgatcaccgccggcagactggtgagcgcccagttccccatcgaccacttcacccacatcttcatcgacgaggccggccactgcatggagcccgagagcctggtggccatcgccggcctgatggaggtgaaggagaccggcgaccccggcggccagctggtgctggccggcgaccccagacagctgggccccgtgctgagaagccccctgacccagaagcacggcctgggctacagcctgctggagagactgctgacctacaacagcctgtacaagaagggccccgacggctacgacccccagttcatcaccaagctgctgagaaactacagaagccaccccaccatcctggacatccccaaccagctgtactacgagggcgagctgcaggcctgcgccgacgtggtggacagagagagattctgcagatgggccggcctgcccagacagggcttccccatcatcttccacggcgtgatgggcaaggacgagagagagggcaacagccccagcttcttcaaccccgaggaggccgccaccgtgaccagctacctgaagctgctgctggcccccagcagcaagaagggcaaggccagactgagccccagaagcgtgggcgtgatcagcccctacagaaagcaggtggagaagatcagatactgcatcaccaagctggacagagagctgagaggcctggacgacatcaaggacctgaaggtgggcagcgtggaggagttccagggccaggagagaagcgtgatcctgatcagcaccgtgagaagcagccagagcttcgtgcagctggacctggacttcaacctgggcttcctgaagaaccccaagagattcaacgtggccgtgaccagagccaaggccctgctgatcatcgtgggcaaccccctgctgctgggccacgaccccgactggaaggtgttcctggagttctgcaaggagaacggcggctacaccggctgccccttccccgccaagctggacctgcagcagggccagaacctgctgcagggcctgagcaagctgagccccagcaccagcggcccccacagccacgactacctgccccaggagagagagggcgagggcggcctgagcctgcaggtggagcccgagtggagaaacgagctgtag

SEQ ID NO: 89485 - DNA, 3012 bp, Artificial Sequence; identical to SEQ ID NO: 89481
  Description of Artificial Sequence: Synthetic coding sequence

SEQ ID NO: 89486 - DNA, 171 bp, Artificial Sequence
  Description of Artificial Sequence: Synthetic coding sequence
atgcccagcaagttcagctgcagacagctgagagaggccggccagtgcttcgagagcttcctggtggtgagaggcctggacatggagaccgacagagagagactgagaaccatctacaacagagacttcaagatcagcctggccagcagcaagagcatcctgcagagctag

SEQ ID NO: 89487 - DNA, 3636 bp, Artificial Sequence
  Description of Artificial Sequence: Synthetic coding sequence
atgctgagcctggccgccaagctggtggccttcttctggagaaccgccgacacccccagagaggaggccggccagctggagcccgagctggccgagggcgacaccaagctgaagaccgtgagaggcgtggtgaccagatactgcagcgactacggcatgatcgacgacatgatctacttcagcagcgacgccgtgaccagcagagtgctgctgaacgtgggccaggaggtgatcgccgtggtggaggagaacaaggtgagcaacggcctgaaggccatcagagtggaggccgtgagcgacaagtgggaggacgacagcagaaaccacggcagccccagcgactgcggccccagagtgctgatcggctgcgtgaccagcctggtggagggcgccggctgcatcagccagaccacctacttcagcctggagagcgtgtgcgagggcttcgagccctgcaagggcgactgggtggaggccgagtacagaatcagacccggcacctggagcagcgaggccaccagcgtgaagcccctgagatacaagagagtggacaaggtgtgcatcagcagcctgtgcggcagaaacggcgtgctggaggagagcatcttcttcaccctggacagcctgaagctgcccgacggctacacccccagaagaggcgacgtggtgaacgccgtggtggtggagagcagccagagctgctacgtgtggagagccctgtgcatgaccctggtgaagagaagagacgccgcccccgtgcacgaggccacccacttctacggcaccatcctgctgaagaacaagggcgacatcgaggtgacccaggtgacccacttcggcaccctgaaggagggcagaagcaagaccatggtgatctggatcgagaacaagggcgacatcccccagaacctggtgagctgcaagctggccggctgggacaagagcaagcagttcagattccagatgctggacaaggaccagatgtgccccgtggtgagcttcgtgagcgtgcccgagaaggagaacagcagcgacgagaacatcaacagcctgaacagccacaccaagaacaagaccagccagatgagcgagagcagcctggtgaacaacagaggcatcagccccggcgactgcacctgcaagggcgagaacggcgagaaggacaacatcctgagcagaaagcagatgaccgagcccgagcccggcggcctggtgccccccggcggcaagaccttcatcgtggtgatctgcgacggcaagaaccccggcagatgcaaggagctgctgctgctgtgcttcagcgacttcctgatcggcagatacctggaggtgaacgtgatcagcggcgaggagagcctgatcgccgccagagagcccttcagctggaagaagctgaagagcagccaggccctgaccagcgccaagaccaccgtggtggtgaccgcccagaagagaaacagcagaagacagctgcccagcttcctgccccagtaccccatccccgacagactgagaaagtgcgtggagcagaagatcgacatcctgaccttccagcccctgctggccgagctgctgaacatgagcaactacaaggagaagttcagcaccctgctgtggctggaggagatctacgccgagatggagctgaaggagtacaacatgagcggcatcatcctgagaagaaacggcgacctgctggtgctggaggtgcccggcctggccgagggcagacccagcctgtacgccggcgacaagctgatcctgaagacccaggagtacaacggccacgccatcgagtacatcagctacgtgaccgagatccacgaggaggacgtgaccctgaagatcaaccccgagttcgagcaggcctacaacttcgagcccatggacgtggagttcacctacaacagaaccaccagcagaagatgccacttcgccctggagcacgtgatccacctgggcgtgaaggtgctgttccccgaggagatcatcctgcagagcccccaggtgaccggcaactggaaccacgcccaggacaccaagagcagcggccagagcaccagcaagaagaacagaaagaccatgaccgaccaggccgagcacggcaccgaggagagaagagtgggcgacaaggacctgcccgtgctggcccccttcaccgccgagatgagcgactgggtggacgagatccagacccccaaggccagaaagatggagttcttcaaccccgtgctgaacgagaaccagaagctggccgtgaagagaatcctgagcggcgactgcagacccctgccctacatcctgttcggcccccccggcaccggcaagaccgtgaccatcatcgaggccgtgctgcaggtgcacttcgccctgcccgacagcagaatcctggtgtgcgcccccagcaacagcgccgccgacctggtgtgcctgagactgcacgagagcaaggtgctgcagcccgccaccatggtgagagtgaacgccacctgcagattcgaggagatcgtgatcgacgccgtgaagccctactgcagagacggcgaggacatctggaaggccagcagattcagaatcatcatcaccacctgcagcagcagcggcctgttctaccagatcggcgtgagagtgggccacttcacccacgtgttcgtggacgaggccggccaggccagcgagcccgagtgcctgatccccctgggcctgatgagcgacatcagcggccagatcgtgctggccggcgaccccatgcagctgggccccgtgatcaagagcagactggccatggcctacggcctgaacgtgagcttcctggagagactgatgagcagacccgcctaccagagagacgagaacgccttcggcgcctgcggcgcccacaaccccctgctggtgaccaagctggtgaagaactacagaagccacgaggccctgctgatgctgcccagcagactgttctaccacagagagctggaggtgtgcgccgaccccaccgtggtgaccagcctgctgggctgggagaagctgcccaagaagggcttccccctgatcttccacggcgtgagaggcagcgaggccagagagggcaagagccccagctggttcaaccccgccgaggccgtgcaggtgctgagatactgctgcctgctggcccacagcatcagcagccaggtgagcgccagcgacatcggcgtgatcaccccctacagaaagcaggtggagaagatcagaatcctgctgagaaacgtggacctgatggacatcaaggtgggcagcgtggaggagttccagggccaggagtacctggtgatcatcatcagcaccgtgagaagcaacgaggacagattcgaggacgacagatacttcctgggcttcctgagcaacagcaagagattcaacgtggccatcaccagacccaaggccctgctgatcgtgctgggcaacccccacgtgctggtgagagacccctgcttcggcgccctgctggagtacagcatcaccaacggcgtgtacatgggctgcgacctgccccccgccctgcagagcctgcagaactgcggcgagggcgtggccgaccccagctaccccgtggtgcccgagagcaccggccccgagaagcaccaggagcccagctag

SEQ ID NO: 89488 - DNA, 378 bp, Artificial Sequence
  Description of Artificial Sequence: Synthetic coding sequence
atgagcgacatcagcggccaggtgaccaagctggtgaagaactacagaagccacgaggccctgctgatgctgcccagcagactgttctaccacagagagctggaggtgtgcgccgaccccaccgtggtgaccagcctgctgggctgggagaagctgcccaagaagggcttccccctgatcttccacggcgtgagaggcagcgaggccagagagggcaagagccccagctggttcaaccccgccgaggccgtgcaggtgctgagatactgctgcctgctggcccacagcatcagcagccaggtgagcgccagcgacatcggcgtgatcaccccctacagaaagcaggtgagacccgcccaggccagactggtgctgtag

SEQ ID NO: 89489 - DNA, 378 bp, Artificial Sequence; identical to SEQ ID NO: 89488
  Description of Artificial Sequence: Synthetic coding sequence

SEQ ID NO: 89490 - DNA, 1017 bp, Artificial Sequence
  Description of Artificial Sequence: Synthetic coding sequence
atgttcagagtgggccacttcacccacgtgttcgtggacgaggccggccaggccagcgagcccgagtgcctgatccccctgggcctgatgagcgacatcagcggccagatcgtgctggccggcgaccccatgcagctgggccccgtgatcaagagcagactggccatggcctacggcctgaacgtgagcttcctggagagactgatgagcagacccgcctaccagagagacgagaacgccttcggcgcctgcggcgcccacaaccccctgctggtgaccaagctggtgaagaactacagaagccacgaggccctgctgatgctgcccagcagactgttctaccacagagagctggaggtgtgcgccgaccccaccgtggtgaccagcctgctgggctgggagaagctgcccaagaagggcttccccctgatcttccacggcgtgagaggcagcgaggccagagagggcaagagccccagctggttcaaccccgccgaggccgtgcaggtgctgagatactgctgcctgctggcccacagcatcagcagccaggtgagcgccagcgacatcggcgtgatcaccccctacagaaagcaggtggagaagatcagaatcctgctgagaaacgtggacctgatggacatcaaggtgggcagcgtggaggagttccagggccaggagtacctggtgatcatcatcagcaccgtgagaagcaacgaggacagattcgaggacgacagatacttcctgggcttcctgagcaacagcaagagattcaacgtggccatcaccagacccaaggccctgctgatcgtgctgggcaacccccacgtgctggtgagagacccctgcttcggcgccctgctggagtacagcatcaccaacggcgtgtacatgggctgcgacctgccccccgccctgcagagcctgcagaactgcggcgagggcgtggccgaccccagctaccccgtggtgcccgagagcaccggccccgagaagcaccaggagcccagctag

SEQ ID NO: 89491 - DNA, 3498 bp, Artificial Sequence
  Description of Artificial Sequence: Synthetic coding sequence
atgctgagcctggccgccaagctggtggccttcttctggagaaccgccgacacccccagagaggaggccggccagctggagcccgagctggccgagggcgacaccaagctgaagaccgtgagaggcgtggtgaccagatactgcagcgactacggcatgatcgacgacatgatctacttcagcagcgacgccgtgaccagcagagtgctgctgaacgtgggccaggaggtgatcgccgtggtggaggagaacaaggtgagcaacggcctgaaggccatcagagtggaggccgtgagcgacaagtgggaggacgacagcagaaaccacggcagccccagcgactgcggccccagagtgctgatcggctgcgtgaccagcctggtggagggcgccggctgcatcagccagaccacctacttcagcctggagagcgtgtgcgagggcttcgagccctgcaagggcgactgggtggaggccgagtacagaatcagacccggcacctggagcagcgaggccaccagcgtgaagcccctgagatacaagagagtggacaaggtgtgcatcagcagcctgtgcggcagaaacggcgtgctggaggagagcatcttcttcaccctggacagcctgaagctgcccgacggctacacccccagaagaggcgacgtggtgaacgccgtggtggtggagagcagccagagctgctacgtgtggagagccctgtgcatgaccctggtgaagagaagagacgccgcccccgtgcacgaggccacccacttctacggcaccatcctgctgaagaacaagggcgacatcgaggtgacccaggtgacccacttcggcaccctgaaggagggcagaagcaagaccatggtgatctggatcgagaacaagggcgacatcccccagaacctggtgagctgcaagctggccggctgggacaagagcaagcagttcagattccagatgctggacaaggaccagatgtgccccgtggtgagcttcgtgagcgtgcccgagaaggagaacagcagcgacgagaacatcaacagcctgaacagccacaccaagaacaagaccagccagatgagcgagagcagcctggtgaacaacagaggcatcagccccggcgactgcacctgcaagggcgagaacggcgagaaggacaacatcctgagcagaaagcagatgaccgagcccgagcccggcggcctggtgccccccggcggcaagaccttcatcgtggtgatctgcgacggcaagaaccccggcagatgcaaggagctgctgctgctgtgcttcagcgacttcctgatcggcagatacctggaggtgaacgtgatcagcggcgaggagagcctgatcgccgccagagagcccttcagctggaagaagctgaagagcagccaggccctgaccagcgccaagaccaccgtggtggtgaccgcccagaagagaaacagcagaagacagctgcccagcttcctgccccagtaccccatccccgacagactgagaaagtgcgtggagcagaagatcgacatcctgaccttccagcccctgctggccgagctgctgaacatgagcaactacaaggagaagttcagcaccctgctgtggctggaggagatctacgccgagatggagctgaaggagtacaacatgagcggcatcatcctgagaagaaacggcgacctgctggtgctggaggtgcccggcctggccgagggcagacccagcctgtacgccggcgacaagctgatcctgaagacccaggagtacaacggccacgccatcgagtacatcagctacgtgaccgagatccacgaggaggacgtgaccctgaagatcaaccccgagttcgagcaggcctacaacttcgagcccatggacgtggagttcacctacaacagaaccaccagcagaagatgccacttcgccctggagcacgtgatccacctgggcgtgaaggtgctgttccccgaggagatcatcctgcagagcccccaggtgaccggcaactggaaccacgcccaggacaccaagagcagcggccagagcaccagcaagaagaacagaaagaccatgaccgaccaggccgagcacggcaccgaggagagaagagtgggcgacaaggacctgcccgtgctggcccccttcaccgccgagatgagcgactgggtggacgagatccagacccccaaggccagaaagatggagttcttcaaccccgtgctgaacgagaaccagaagctggccgtgaagagaatcctgagcggcgactgcagacccctgccctacatcctgttcggcccccccggcaccggcaagaccgtgaccatcatcgaggccgtgctgcaggtgcacttcgccctgcccgacagcagaatcctggtgtgcgcccccagcaacagcgccgccgacctggtgtgcctgagactgcacgagagcaaggtgctgcagcccgccaccatggtgagagtgaacgccacctgcagattcgaggagatcgtgatcgacgccgtgaagccctactgcagagacggcgaggacatctggaaggccagcagattcagaatcatcatcaccacctgcagcagcagcggcctgttctaccagatcggcgtgagagtgggccacttcacccacgtgttcgtggacgaggccggccaggccagcgagcccgagtgcctgatccccctgggcctgatgagcgacatcagcggccagatcgtgctggccggcgaccccatgcagctgggccccgtgatcaagagcagactggccatggcctacggcctgaacgtgagcttcctggagagactgatgagcagacccgcctaccagagagacgagaacgccttcggcgcctgcggcgcccacaaccccctgctggtgaccaagctggtgaagaactacagaagccacgaggccctgctgatgctgcccagcagactgttctaccacagagagctggaggtgtgcgccgaccccaccgtggtgaccagcctgctgggctgggagaagctgcccaagaagggcttccccctgatcttccacggcgtgagaggcagcgaggccagagagggcaagagccccagctggttcaaccccgccgaggccgtgcaggtgctgagatactgctgcctgctggcccacagcatcagcagccaggtgagcgccagcgacatcggcgtgatcaccccctacagaaagcaggtggagaagatcagaatcctgctgagaaacgtggacctgatggacatcaaggtgggcagcgtggaggagttccagggccaggagtacctggtgatcatcatcagcaccgacccctgcttcggcgccctgctggagtacagcatcaccaacggcgtgtacatgggctgcgacctgccccccgccctgcagagcctgcagaactgcggcgagggcgtggccgaccccagctaccccgtggtgcccgagagcaccggccccgagaagcaccaggagcccagctag

SEQ ID NO: 89492 - DNA, 636 bp, Artificial Sequence
  Description of Artificial Sequence: Synthetic coding sequence
atgagcttcctgcccgtgagaagcgtgatcggcggcggcgacaccaagctgaagaccgtgagaggcgtggtgaccagatactgcagcgactacggcatgatcgacgacatgatctacttcagcagcgacgccgtgaccagcagagtgctgctgaacgtgggccaggaggtgatcgccgtggtggaggagaacaaggtgagcaacggcctgaaggccatcagagtggaggccgtgagcgacaagtgggaggacgacagcagaaaccacggcagccccagcgactgcggccccagagtgctgatcggctgcgtgaccagcctggtggagggcgccggctgcatcagccagaccacctacttcagcctggagagcgtgtgcgagggcttcgagccctgcaagggcgactgggtggaggccgagtacagaatcagacccggcacctggagcagcgaggccaccagcgtgaagcccctgagatacaagagagtggacaaggtggcctgcagactggtggcccccctgtgcgccagcggcagacccgccatcagaggcaacctgcacggccccggcttcagctgcatgtgctggaagcccggcaagatcaagctgtgccacggccagagagagaagaagtag

SEQ ID NO: 89493 - DNA, 3498 bp, Artificial Sequence
  Description of Artificial Sequence: Synthetic coding sequence
atgagcttcctgcccgtgagaagcgtgatcggcggcggcgacaccaagctgaagaccgtgagaggcgtggtgaccagatactgcagcgactacggcatgatcgacgacatgatctacttcagcagcgacgccgtgaccagcagagtgctgctgaacgtgggccaggaggtgatcgccgtggtggaggagaacaaggtgagcaacggcctgaaggccatcagagtggaggccgtgagcgacaagtgggaggacgacagcagaaaccacggcagccccagcgactgcggccccagagtgctgatcggctgcgtgaccagcctggtggagggcgccggctgcatcagccagaccacctacttcagcctggagagcgtgtgcgagggcttcgagccctgcaagggcgactgggtggaggccgagtacagaatcagacccggcacctggagcagcgaggccaccagcgtgaagcccctgagatacaagagagtggacaaggtgtgcatcagcagcctgtgcggcagaaacggcgtgctggaggagagcatcttcttcaccctggacagcctgaagctgcccgacggctacacccccagaagaggcgacgtggtgaacgccgtggtggtggagagcagccagagctgctacgtgtggagagccctgtgcatgaccctggtgaagagaagagacgccgcccccgtgcacgaggccacccacttctacggcaccatcctgctgaagaacaagggcgacatcgaggtgacccaggtgacccacttcggcaccctgaaggagggcagaagcaagaccatggtgatctggatcgagaacaagggcgacatcccccagaacctggtgagctgcaagctggccggctgggacaagagcaagcagttcagattccagatgctggacaaggaccagatgtgccccgtggtgagcttcgtgagcgtgcccgagaaggagaacagcagcgacgagaacatcaacagcctgaacagccacaccaagaacaagaccagccagatgagcgagagcagcctggtgaacaacagaggcatcagccccggcgactgcacctgcaagggcgagaacggcgagaaggacaacatcctgagcagaaagcagatgaccgagcccgagcccggcggcctggtgccccccggcggcaagaccttcatcgtggtgatctgcgacggcaagaaccccggcagatgcaaggagctgctgctgctgtgcttcagcgacttcctgatcggcagatacctggaggtgaacgtgatcagcggcgaggagagcctgatcgccgccagagagcccttcagctggaagaagctgaagagcagccaggccctgaccagcgccaagaccaccgtggtggtgaccgcccagaagagaaacagcagaagacagctgcccagcttcctgccccagtaccccatccccgacagactgagaaagtgcgtggagcagaagatcgacatcctgaccttccagcccctgctggccgagctgctgaacatgagcaactacaaggagaagttcagcaccctgctgtggctggaggagatctacgccgagatggagctgaaggagtacaacatgagcggcatcatcctgagaagaaacggcgacctgctggtgctggaggtgcccggcctggccgagggcagacccagcctgtacgccggcgacaagctgatcctgaagacccaggagtacaacggccacgccatcgagtacatcagctacgtgaccgagatccacgaggaggacgtgaccctgaagatcaaccccgagttcgagcaggcctacaacttcgagcccatggacgtggagttcacctacaacagaaccaccagcagaagatgccacttcgccctggagcacgtgatccacctgggcgtgaaggtgctgttccccgaggagatcatcctgcagagcccccaggtgaccggcaactggaaccacgcccaggacaccaagagcagcggccagagcaccagcaagaagaacagaaagaccatgaccgaccaggccgagcacggcaccgaggagagaagagtgggcgacaaggacctgcccgtgctggcccccttcaccgccgagatgagcgactgggtggacgagatccagacccccaaggccagaaagatggagttcttcaaccccgtgctgaacgagaaccagaagctggccgtgaagagaatcctgagcggcgactgcagacccctgccctacatcctgttcggcccccccggcaccggcaagaccgtgaccatcatcgaggccgtgctgcaggtgcacttcgccctgcccgacagcagaatcctggtgtgcgcccccagcaacagcgccgccgacctggtgtgcctgagactgcacgagagcaaggtgctgcagcccgccaccatggtgagagtgaacgccacctgcagattcgaggagatcgtgatcgacgccgtgaagccctactgcagagacggcgaggacatctggaaggccagcagattcagaatcatcatcaccacctgcagcagcagcggcctgttctaccagatcggcgtgagagtgggccacttcacccacgtgttcgtggacgaggccggccaggccagcgagcccgagtgcctgatccccctgggcctgatgagcgacatcagcggccagatcgtgctggccggcgaccccatgcagctgggccccgtgatcaagagcagactggccatggcctacggcctgaacgtgagcttcctggagagactgatgagcagacccgcctaccagagagacgagaacgccttcggcgcctgcggcgcccacaaccccctgctggtgaccaagctggtgaagaactacagaagccacgaggccctgctgatgctgcccagcagactgttctaccacagagagctggaggtgtgcgccgaccccaccgtggtgaccagcctgctgggctgggagaagctgcccaagaagggcttccccctgatcttccacggcgtgagaggcagcgaggccagagagggcaagagccccagctggttcaaccccgccgaggccgtgcaggtgctgagatactgctgcctgctggcccacagcatcagcagccaggtgagcgccagcgacatcggcgtgatcaccccctacagaaagcaggtggagaagatcagaatcctgctgagaaacgtggacctgatggacatcaaggtgggcagcgtggaggagttccagggccaggagtacctggtgatcatcatcagcaccgtgagaagcaacgaggacagattcgaggacgacagatacttcctgggcttcctgagcaacagcaagagattcaacgtggccatcaccagacccaaggccctgctgatcgtgctgggcaacccccacgtgctggtgagactgtggagaggcggcggcagacccctgctgcccagcggcgccagaatccacagaaccagagaggccagcggcgcccagctgatctgcagcggctag

SEQ ID NO: 89494 - DNA, 3636 bp, Artificial Sequence; identical to SEQ ID NO: 89487
  Description of Artificial Sequence: Synthetic coding sequence

SEQ ID NO: 89495 - DNA, 483 bp, Artificial Sequence
  Description of Artificial Sequence: Synthetic coding sequence
atggccgccgagagaaagaccagactgagcaagaacctgctgagaatgaagttcatgcagagaggcctggacagcgagaccaagaagcagctggaggaggaggagaagaagatcatcagcgaggagcactggtacctggacctgcccgagctgaaggagaaggagagcttcatcatcgaggagcagagcttcctgctgtgcgaggacctgctgtacggcagaatgagcttcagaggcttcaaccccgaggtggagaagctgatgctgcagatgaacgccaagcacaaggccgaggaggtggaggacgagaccgtggagctggacgtgagcgacgaggagatggccagaagatacgagaccctggtgggcaccatcggcaagaagttcgccagaaagagagaccacgccaactacgaggaggacgagaacggcgacatcacccccatcaaggccaagaagatgttcctgaagccccaggactag

SEQ ID NO: 89496 - DNA, 627 bp, Artificial Sequence
  Description of Artificial Sequence: Synthetic coding sequence
atgaaggcctgcaagagaggcaacagcgacatcgtgagactggtgatcgagtgcggcgccgactgcaacatcctgagcaagcaccagaacagcgccctgcacttcgccaagcagagcaacaacgtgctggtgtacgacctgctgaagaaccacctggagaccctgagcagagtggccgaggagaccatcaaggactacttcgaggccagactggccctgctggagcccgtgttccccatcgcctgccacagactgtgcgagggccccgacttcagcaccgacttcaactacaagcccccccagaacatccccgagggcagcggcatcctgctgttcatcttccacgccaacttcctgggcaaggaggtgatcgccagactgtgcggcccctgcagcgtgcaggccgtggtgctgaacgacaagttccagctgcccgtgttcctgaccggcagcagaagcgtggtgcaggccggcgtgcagtggagaggcctgcagctgaccggcgtgctgaccagccaggcccaggccatcctgcccccccagccccccaactacctgggcctgaagatgaccgtgatcctgttcacccacagcgccctgctgcaggtgcccatcaacagcagctag

SEQ ID NO: 89497 - DNA, 2583 bp, Artificial Sequence
  Description of Artificial Sequence: Synthetic coding sequence
atggagcaggtggccgagggcgccagagtgaccgccgtgcccgtgagcgccgccgacagcaccgaggagctggccgaggtggaggagggcgtgggcgtggtgggcgaggacaacgacgccgccgccagaggcgccgaggccttcggcgacagcgaggaggacggcgaggacgtgttcgaggtggagaagatcctggacatgaagaccgagggcggcaaggtgctgtacaaggtgagatggaagggctacaccagcgacgacgacacctgggagcccgagatccacctggaggactgcaaggaggtgctgctggagttcagaaagaagatcgccgagaacaaggccaaggccgtgagaaaggacatccagagactgagcctgaacaacgacatcttcgaggccaacagcgacagcgaccagcagagcgagaccaaggaggacaccagccccaagaagaagaagaagaagctgagacagagagaggagaagagccccgacgacctgaagaagaagaaggccaaggccggcaagctgaaggacaagagcaagcccgacctggagagcagcctggagagcctggtgttcgacctgagaaccaagaagagaatcagcgaggccaaggaggagctgaaggagagcaagaagcccaagaaggacgaggtgaaggagaccaaggagctgaagaaggtgaagaagggcgagatcagagacctgaagaccaagaccagagaggaccccaaggagaacagaaagaccaagaaggagaagttcgtggagagccaggtggagagcgagagcagcgtgctgaacgacagccccttccccgaggacgacagcgagggcctgcacagcgacagcagagaggagaagcagaacaccaagagcgccagagagagagccggccaggacatgggcctggagcacggcttcgagaagcccctggacagcgccatgagcgccgaggaggacaccgacgtgagaggcagaagaaagaagaagacccccagaaaggccgaggacaccagagagaacagaaagctggagaacaagaacgccttcctggagaagaagaccgtgcccaagaagcagagaaaccaggacagaagcaagagcgccgccgagctggagaagctgatgcccgtgagcgcccagacccccaagggcagaagactgagcggcgaggagagaggcctgtggagcaccgacagcgccgaggaggacaaggagaccaagagaaacgagagcaaggagaagtaccagaagagacacgacagcgacaaggaggagaagggcagaaaggagcccaagggcctgaagaccctgaaggagatcagaaacgccttcgacctgttcaagctgacccccgaggagaagaacgacgtgagcgagaacaacagaaagagagaggagatccccctggacttcaagaccatcgacgaccacaagaccaaggagaacaagcagagcctgaaggagagaagaaacaccagagacgagaccgacacctgggcctacatcgccgccgagggcgaccaggaggtgctggacagcgtgtgccaggccgacgagaacagcgacggcagacagcagatcctgagcctgggcatggacctgcagctggagtggatgaagctggaggacttccagaagcacctggacggcaaggacgagaacttcgccgccaccgacgccatccccagcaacgtgctgagagacgccgtgaagaacggcgactacatcaccgtgaaggtggccctgaacagcaacgaggagtacaacctggaccaggaggacagcagcggcatgaccctggtgatgctggccgccgccggcggccaggacgacctgctgagactgctgatcaccaagggcgccaaggtgaacggcagacagaagaacggcaccaccgccctgatccacgccgccgagaagaacttcctgaccaccgtggccatcctgctggaggccggcgccttcgtgaacgtgcagcagagcaacggcgagaccgccctgatgaaggcctgcaagagaggcaacagcgacatcgtgagactggtgatcgagtgcggcgccgactgcaacatcctgagcaagcaccagaacagcgccctgcacttcgccaagcagagcaacaacgtgctggtgtacgacctgctgaagaaccacctggagaccctgagcagagtggccgaggagaccatcaaggactacttcgaggccagactggccctgctggagcccgtgttccccatcgcctgccacagactgtgcgagggccccgacttcagcaccgacttcaactacaagcccccccagaacatccccgagggcagcggcatcctgctgttcatcttccacgccaacttcctgggcaaggaggtgatcgccagactgtgcggcccctgcagcgtgcaggccgtggtgctgaacgacaagttccagctgcccgtgttcctggacagccacttcgtgtacagcttcagccccgtggccggccccaacaagctgttcatcagactgaccgaggcccccagcgccaaggtgaagctgctgatcggcgcctacagagtgcagctgcagtag

SEQ ID NO: 89498 - DNA, 2604 bp, Artificial Sequence
  Description of Artificial Sequence: Synthetic coding sequence
atggagcaggtggccgagggcgccagagtgaccgccgtgcccgtgagcgccgccgacagcaccgaggagctggccgaggtggaggagggcgtgggcgtggtgggcgaggacaacgacgccgccgccagaggcgccgaggccttcggcgacagcgaggaggacggcgaggacgtgttcgaggtggagaagatcctggacatgaagaccgagggcggcaaggtgctgtacaaggtgagatggaagggctacaccagcgacgacgacacctgggagcccgagatccacctggaggactgcaaggaggtgctgctggagttcagaaagaagatcgccgagaacaaggccaaggccgtgagaaaggacatccagagactgagcctgaacaacgacatcttcgaggccaacagcgacagcgaccagcagagcgagaccaaggaggacaccagccccaagaagaagaagaagaagctgagacagagagaggagaagagccccgacgacctgaagaagaagaaggccaaggccggcaagctgaaggacaagagcaagcccgacctggagagcagcctggagagcctggtgttcgacctgagaaccaagaagagaatcagcgaggccaaggaggagctgaaggagagcaagaagcccaagaaggacgaggtgaaggagaccaaggagctgaagaaggtgaagaagggcgagatcagagacctgaagaccaagaccagagaggaccccaaggagaacagaaagaccaagaaggagaagttcgtggagagccaggtggagagcgagagcagcgtgctgaacgacagccccttccccgaggacgacagcgagggcctgcacagcgacagcagagaggagaagcagaacaccaagagcgccagagagagagccggccaggacatgggcctggagcacggcttcgagaagcccctggacagcgccatgagcgccgaggaggacaccgacgtgagaggcagaagaaagaagaagacccccagaaaggccgaggacaccagagagaacagaaagctggagaacaagaacgccttcctggagaagaagaccgtgcccaagaagcagagaaaccaggacagaagcaagagcgccgccgagctggagaagctgatgcccgtgagcgcccagacccccaagggcagaagactgagcggcgaggagagaggcctgtggagcaccgacagcgccgaggaggacaaggagaccaagagaaacgagagcaaggagaagtaccagaagagacacgacagcgacaaggaggagaagggcagaaaggagcccaagggcctgaagaccctgaaggagatcagaaacgccttcgacctgttcaagctgacccccgaggagaagaacgacgtgagcgagaacaacagaaagagagaggagatccccctggacttcaagaccatcgacgaccacaagaccaaggagaacaagcagagcctgaaggagagaagaaacaccagagacgagaccgacacctgggcctacatcgccgccgagggcgaccaggaggtgctggacagcgtgtgccaggccgacgagaacagcgacggcagacagcagatcctgagcctgggcatggacctgcagctggagtggatgaagctggaggacttccagaagcacctggacggcaaggacgagaacttcgccgccaccgacgccatccccagcaacgtgctgagagacgccgtgaagaacggcgactacatcaccgtgaaggtggccctgaacagcaacgaggagtacaacctggaccaggaggacagcagcggcatgaccctggtgatgctggccgccgccggcggccaggacgacctgctgagactgctgatcaccaagggcgccaaggtgaacggcagacagaagaacggcaccaccgccctgatccacgccgccgagaagaacttcctgaccaccgtggccatcctgctggaggccggcgccttcgtgaacgtgcagcagagcaacggcgagaccgccctgatgaaggcctgcaagagaggcaacagcgacatcgtgagactggtgatcgagtgcggcgccgactgcaacatcctgagcaagcaccagaacagcgccctgcacttcgccaagcagagcaacaacgtgctggtgtacgacctgctgaagaaccacctggagaccctgagcagagtggccgaggagaccatcaaggactacttcgaggccagactggccctgctggagcccgtgttccccatcgcctgccacagactgtgcgagggccccgacttcagcaccgacttcaactacaagcccccccagaacatccccgagggcagcggcatcctgctgttcatcttccacgccaacttcctgggcaaggaggtgatcgccagactgtgcggcccctgcagcgtgcaggccgtggtgctgaacgacaagttccagctgcccgtgttcctgaccggcagcagaagcgtggtgcaggccggcgtgcagtggagaggcctgcagctgaccggcgtgctgaccagccaggcccaggccatcctgcccccccagccccccaactacctgggcctgaagatgcacgccaccaccagcggctag

SEQ ID NO: 89499 - DNA, 1812 bp, Artificial Sequence
  Description of Artificial Sequence: Synthetic coding sequence
atggagcaggtggccgagggcgccagagtgaccgccgtgcccgtgagcgccgccgacagcaccgaggagctggccgaggtggaggagggcgtgggcgtggtgggcgaggacaacgacgccgccgccagaggcgccgaggccttcggcgacagcgaggaggacggcgaggacgtgttcgaggtggagaagatcctggacatgaagaccgagggcggcaaggtgctgtacaaggtgagatggaagggctacaccagcgacgacgacacctgggagcccgagatccacctggaggactgcaaggaggtgctgctggagttcagaaagaagatcgccgagaacaaggccaaggccgtgagaaaggacatccagagactgagcctgaacaacgacatcttcgaggccaacagcgacagcgaccagcagagcgagaccaaggaggacaccagccccaagaagaagaagaagaagctgagacagagagaggagaagagccccgacgacctgaagaagaagaaggccaaggccggcaagctgaaggacaagagcaagcccgacctggagagcagcctggagagcctggtgttcgacctgagaaccaagaagagaatcagcgaggccaaggaggagctgaaggagagcaagaagcccaagaaggacgaggtgaaggagaccaaggagctgaagaaggtgaagaagggcgagatcagagacctgaagaccaagaccagagaggaccccaaggagaacagaaagaccaagaaggagaagttcgtggagagccaggtggagagcgagagcagcgtgctgaacgacagccccttccccgaggacgacagcgagggcctgcacagcgacagcagagaggagaagcagaacaccaagagcgccagagagagagccggccaggacatgggcctggagcacggcttcgagaagcccctggacagcgccatgagcgccgaggaggacaccgacgtgagaggcagaagaaagaagaagacccccagaaaggccgaggacaccagagagaacagaaagctggagaacaagaacgccttcctggagaagaagaccgtgcccaagaagcagagaaaccaggacagaagcaagagcgccgccgagctggagaagctgatgcccgtgagcgcccagacccccaagggcagaagactgagcggcgaggagagaggcctgtggagcaccgacagcgccgaggaggacaaggagaccaagagaaacgagagcaaggagaagtaccagaagagacacgacagcgacaaggaggagaagggcagaaaggagcccaagggcctgaagaccctgaaggagatcagaaacgccttcgacctgttcaagctgacccccgaggagaagaacgacgtgagcgagaacaacagaaagagagaggagatccccctggacttcaagaccatcgacgaccacaagaccaaggagaacaagcagagcctgaaggagagaagaaacaccagagacgagaccgacacctgggcctacatcgccgccgagggcgaccaggaggtgctggacagcgtgtgccaggccgacgagaacagcgacggcagacagcagatcctgagcctgggcatggacctgcagctggagtggatgaagctggaggacttccagaagcacctggacggcaaggacgagaacttcgccgccaccgacgccatccccagcaacgtgctgagagacgccgtgaagaagaagaagaagaagaagttcctgggcacctacaccttcttcctgttcttcttcttcgagaagcccgacctggtgcccctgttctag

SEQ ID NO: 89500 - DNA, 3087 bp, Artificial Sequence
  Description of Artificial Sequence: Synthetic coding sequence
atgggcttcttcagcctgagcagcgagagaaacgagagcgtgatccactaccccgagagcaccgagcccgagatccagcaggagatgagcaccagccagcccgactgcaacgtggacagctgcagcgtgagcagcggctacggcaccttctgcatcagcgagctgaacctgtacaagagcaaggaccccaaggagttcatggagcacatcgacgtgcccaagggccagtacgtggcccccgccgtgcccgccgagagcctggtggacggcgtgaagaacgagaacttctacatccagacccccgaggagtgccacgtgagcctgaaggaggacgtgagcatcagccccggcgagttcgagcacaacttcctgggcgagaacaaggtgagcgaggtgtacagcggcaagaccaacagcaacgccatcaccagctgggcccagaagctgaagcagaaccagcccaagagagcccacgtggaggacggcggcagcagaagcaagcagggcaacgagcagagcaagaagacccccatcgagaagagcgacttcgccgccgccacccaccccagagccttctacctgagcaagcccgacgagacccccaacgcctggatgagcgacagcggcaccggcctgacctactggaagctggaggagaaggacatgcaccacagcctgcccgagaccctggagaagaccttcatcagcctgagcagcaccgacgtgagccccaaccagagcaacaccagcaacgagatgaagctgcccagcctgaaggacatctactacaagaagcagagagagaacaagcagctgcccgagagaaacctgaccagcgccagcaaccccaaccacccccccgaggtgctgaccctggaccccaccctgcacatgaagcccaagcagcagatcagcggcatccagccccacggcctgcccaacgccctggacgacagaatcagcttcagccccgacagcgtgctggagcccagcatgagcagccccagcgacatcgacagcttcagccaggccagcaacgtgaccagccagctgcccggcttccccaagtaccccagccacaccaaggccagccccgtggacagctggaagaaccagaccttccagaacgagagcagaaccagcagcaccttccccagcgtgtacaccatcaccagcaacgacatcagcgtgaacaccgtggacgaggagaacaccgtgatggtggccagcgccagcgtgagccagagccagctgcccggcaccgccaacagcgtgcccgagtgcatcagcctgaccagcctggaggaccccgtgatcctgagcaagatcagacagaacctgaaggagaagcacgccagacacatcgccgacctgagagcctactacgagagcgagatcaacagcctgaagcagaagctggaggccaaggagatcagcggcgtggaggactggaagatcaccaaccagatcctggtggacagatgcggccagctggacagcgccctgcacgaggccaccagcagagtgagaaccctggagaacaagaacaacctgctggagatcgaggtgaacgacctgagagagagattcagcgccgccagcagcgccagcaagatcctgcaggagagaatcgaggagatgagaaccagcagcaaggagaaggacaacaccatcatcagactgaagagcagactgcaggacctggaggaggccttcgagaacgcctacaagctgagcgacgacaaggaggcccagctgaagcaggagaacaagatgttccaggacctgctgggcgagtacgagagcctgggcaaggagcacagaagagtgaaggacgccctgaacaccaccgagaacaagctgctggacgcctacacccagatcagcgacctgaagagaatgatcagcaagctggaggcccaggtgaagcaggtggagcacgagaacatgctgagcctgagacacaacagcagaatccacgtgagacccagcagagccaacaccctggccaccagcgacgtgagcagaagaaagtggctgatccccggcgccgagtacagcatcttcaccggccagcccctggacacccaggacagcaacgtggacaaccagctggaggagacctgcagcctgggccacagaagccccctggagaaggacagcagccccggcagcagcagcaccagcctgctgatcaagaagcagagagagaccagcgacacccccatcatgagagccctgaaggagctggacgagggcaagatcttcaagaactggggcacccagaccgagaaggaggacaccagcaacatcaaccccagacagaccgagaccagcgtgaacgccagcagaagccccgagaagtgcgcccagcagagacagaagagactgaacagcgccagccagagaagcagcagcctgccccccagcaacagaaagagcagcacccccaccaagagagagatcatgctgacccccgtgaccgtggcctacagccccaagagaagccccaaggagaacctgagccccggcttcagccacctgctgagcaagaacgagagcagccccatcagattcgacatcctgctggacgacctggacaccgtgcccgtgagcaccctgcagagaaccaaccccagaaagcagctgcagttcctgcccctggacgacagcgaggagaagacctacagcgagaaggccaccgacaaccacgtgaaccacagcagctgccccgagcccgtgcccaacggcgtgaagaaggtgagcgtgagaaccgcctgggagaagaacaagagcgtgagctacgagcagtgcaagcccgtgagcgtgaccccccagggcaacgacttcgagtacaccgccaagatcagaaccctggccgagaccgagagattcttcgacgagctgaccaaggagaaggaccagatcgaggccgccctgagcagaatgcccagccccggcggcagaatcaccctgcagaccagactgaaccagaccccccagatctgcgaggagagcagccacaagtgcgccttcgccggccactacgtgccctgccacctgtacgactacagattccagggctag

SEQ ID NO: 89501 - DNA, 3096 bp, Artificial Sequence
  Description of Artificial Sequence: Synthetic coding sequence
atgggcttcttcagcctgagcagcgagagaaacgagagcgtgatccactaccccgagagcaccgagcccgagatccagcaggagatgagcaccagccagcccgactgcaacgtggacagctgcagcgtgagcagcggctacggcaccttctgcatcagcgagctgaacctgtacaagagcaaggaccccaaggagttcatggagcacatcgacgtgcccaagggccagtacgtggcccccgccgtgcccgccgagagcctggtggacggcgtgaagaacgagaacttctacatccagacccccgaggagtgccacgtgagcctgaaggaggacgtgagcatcagccccggcgagttcgagcacaacttcctgggcgagaacaaggtgagcgaggtgtacagcggcaagaccaacagcaacgccatcaccagctgggcccagaagctgaagcagaaccagcccaagagagcccacgtggaggacggcggcagcagaagcaagcagggcaacgagcagagcaagaagacccccatcgagaagagcgacttcgccgccgccacccaccccagagccttctacctgagcaagcccgacgagacccccaacgcctggatgagcgacagcggcaccggcctgacctactggaagctggaggagaaggacatgcaccacagcctgcccgagaccctggagaagaccttcatcagcctgagcagcaccgacgtgagccccaaccagagcaacaccagcaacgagatgaagctgcccagcctgaaggacatctactacaagaagcagagagagaacaagcagctgcccgagagaaacctgaccagcgccagcaaccccaaccacccccccgaggtgctgaccctggaccccaccctgcacatgaagcccaagcagcagatcagcggcatccagccccacggcctgcccaacgccctggacgacagaatcagcttcagccccgacagcgtgctggagcccagcatgagcagccccagcgacatcgacagcttcagccaggccagcaacgtgaccagccagctgcccggcttccccaagtaccccagccacaccaaggccagccccgtggacagctggaagaaccagaccttccagaacgagagcagaaccagcagcaccttccccagcgtgtacaccatcaccagcaacgacatcagcgtgaacaccgtggacgaggagaacaccgtgatggtggccagcgccagcgtgagccagagccagctgcccggcaccgccaacagcgtgcccgagtgcatcagcctgaccagcctggaggaccccgtgatcctgagcaagatcagacagaacctgaaggagaagcacgccagacacatcgccgacctgagagcctactacgagagcgagatcaacagcctgaagcagaagctggaggccaaggagatcagcggcgtggaggactggaagatcaccaaccagatcctggtggacagatgcggccagctggacagcgccctgcacgaggccaccagcagagtgagaaccctggagaacaagaacaacctgctggagatcgaggtgaacgacctgagagagagattcagcgccgccagcagcgccagcaagatcctgcaggagagaatcgaggagatgagaaccagcagcaaggagaaggacaacaccatcatcagactgaagagcagactgcaggacctggaggaggccttcgagaacgcctacaagctgagcgacgacaaggaggcccagctgaagcaggagaacaagatgttccaggacctgctgggcgagtacgagagcctgggcaaggagcacagaagagtgaaggacgccctgaacaccaccgagaacaagctgctggacgcctacacccagatcagcgacctgaagagaatgatcagcaagctggaggcccaggtgaagcaggtggagcacgagaacatgctgagcctgagacacaacagcagaatccacgtgagacccagcagagccaacaccctggccaccagcgacgtgagcagaagaaagtggctgatccccggcgccgagtacagcatcttcaccggccagcccctggacacccaggacagcaacgtggacaaccagctggaggagacctgcagcctgggccacagaagccccctggagaaggacagcagccccggcagcagcagcaccagcctgctgatcaagaagcagagagagaccagcgacacccccatcatgagagccctgaaggagctggacgagggcaagatcttcaagaactggggcacccagaccgagaaggaggacaccagcaacatcaaccccagacagaccgagaccagcgtgaacgccagcagaagccccgagaagtgcgcccagcagagacagaagagactgaacagcgccagccagagaagcagcagcctgccccccagcaacagaaagagcagcacccccaccaagagagagatcatgctgacccccgtgaccgtggcctacagccccaagagaagccccaaggagaacctgagccccggcttcagccacctgctgagcaagaacgagagcagccccatcagattcgacatcctgctggacgacctggacaccgtgcccgtgagcaccctgcagagaaccaaccccagaaagcagctgcagttcctgcccctggacgacagcgaggagaagacctacagcgagaaggccaccgacaaccacgtgaaccacagcagctgccccgagcccgtgcccaacggcgtgaagaaggtgagcgtgagaaccgcctgggagaagaacaagagcgtgagctacgagcagtgcaagcccgtgagcgtgaccccccagggcaacgacttcgagtacaccgccaagatcagaaccctggccgagaccgagagattcttcgacgagctgaccaaggagaaggaccagatcgaggccgccctgagcagaatgcccagccccggcggcagaatcaccctgcagaccagactgaaccaggaggccctggaggacagactggagagaatcaacagagagctgggcagcgtgagaatgaccctgaagaagttccacgtgctgagaaccagcgccaacctgtag

SEQ ID NO: 89502 - DNA, 1167 bp, Artificial Sequence
  Description of Artificial Sequence: Synthetic coding sequence
atggagcccagccccgccgccggcggcctggagaccaccagactggtgagccccagagacagaggcggcgccggcggcagcctgagactgaagagcctgttcaccgagcccagcgagcccctgcccgaggagagcaagcccgtggagatgcccttccaccactgccacagagaccccctgcccccccccggcctgacccccgagagactgcacgccagaagacagctgtacgccgcctgcgccgtgtgcttcgtgttcatggccggcgaggtggtgggcggctacctggcccacagcctggccatcatgaccgacgccgcccacctgctggccgacgtgggcagcatgatgggcagcctgttcagcctgtggctgagcaccagacccgccaccagaaccatgaccttcggctggcacagaagcgagaccctgggcgccctggccagcgtggtgagcctgtggatggtgaccggcatcctgctgtacctggccttcgtgagactgctgcacagcgactaccacatcgagggcggcgccatgctgctgaccgccagcatcgccgtgtgcgccaacctgctgatggccttcgtgctgcaccaggccggccccccccacagccacggcagcagaggcgccgagtacgcccccctggaggagggccccgaggagcccctgcccctgggcaacaccagcgtgagagccgccttcgtgcacgtgctgggcgacctgctgcagagcttcggcgtgctggccgccagcatcctgatctacttcaagccccagtacaaggccgccgaccccatcagcaccttcctgttcagcatctgcgccctgggcagcaccgcccccaccctgagagacgtgctgagaatcctgatggagggcacccccagaaacgtgggcttcgagcccgtgagagacaccctgctgagcgtgcccggcgtgagagccacccacgagctgcacctgtgggccctgaccctgacctaccacgtggccagcgcccacctggccatcgacagcaccgccgaccccgaggccgtgctggccgaggccagcagcagactgtacagcagattcggcttcagcagctgcaccctgcaggtggagcagtaccagcccgagatggcccagtgcctgagatgccaggagcccccccaggcctag

SEQ ID NO: 89503 - DNA, 363 bp, Artificial Sequence
  Description of Artificial Sequence: Synthetic coding sequence
atgtgccacctgtacgagggccccgtggtgggcggctggtacaaggtgctggacagattcatccccggcaccaccaaggtggacgccctgaagaagatgctgctggaccagggcggcttcgccccctgcttcctgggctgcttcctgcccctggtgggcgccctgaacggcctgagcgcccaggacaactgggccaagctgcagagagactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 89504 - DNA, 531 bp, Artificial Sequence
  Description of Artificial Sequence: Synthetic coding sequence
atggccctgtggagagcctaccagagagccctggccgcccacccctggaaggtgcaggtgctgaccgccggcagcctgatgggcctgggcgacatcatcagccagcagctggtggagagaagaggcctgcaggagcaccagagaggcagaaccctgaccatggtgagcctgggctgcggcttcgtgggccccgtggtgggcggctggtacaaggtgctggacagattcatccccggcaccaccaaggtggacgccctgaagaagatgctgctggaccagggcggcttcgccccctgcttcctgggctgcttcctgcccctggtgggcgccctgaacggcctgagcgcccaggacaactgggccaagctgcagagagactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 89505 - DNA, 513 bp, Artificial Sequence
  Description of Artificial Sequence: Synthetic coding sequence
atggccctgtggagagcctaccagagagccctggccgcccacccctggaaggtgcaggtgctgaccgccggcagcctgatgggcctgggcgacatcatcagccagcagctggtggagagaagaggcctgcaggagcaccagagaggcagaaccctgaccatggtgagcctgggctgcggcttcgtgggccccgtggtgggcggctggtacaaggtgctggacagattcatccccggcaccaccaaggtggacgccctgaagaagatgctgctggaccagggcggcttcgccccctgcttcctgggctgcttcctgcccctggtgggcgccctgaacggcctgagcgcccaggacaactgggccaagctgcagagagactaccccgacgccctgatcaccaactactacgtgggcagatgccccatgtgctgctgctacctggagctgctgcccgtgctggagggcaccagcgccctgagcctgccccacagcatcgtgagcaccctgcagtag

SEQ ID NO: 89506 - DNA, 342 bp, Artificial Sequence
  Description of Artificial Sequence: Synthetic coding sequence
atggccctgtggagagcctaccagagagccctggccgcccacccctggaaggtgcaggtgctgaccgccggcagcctgatgggcctgggcgacatcatcagccagcagctggtggagagaagaggcctgcaggagcaccagagaggcagaaccctgaccatggtgagcctgggctgcggcttcgtggactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 89507 - DNA, 576 bp, Artificial Sequence
  Description of Artificial Sequence: Synthetic coding sequence
atggccctgtggagagcctaccagagagccctggccgcccacccctggaaggtgcaggtgctgaccgccgcccaccccagaagatgccccgacaacacctgcgtgccctgcatcggcagcctgatgggcctgggcgacatcatcagccagcagctggtggagagaagaggcctgcaggagcaccagagaggcagaaccctgaccatggtgagcctgggctgcggcttcgtgggccccgtggtgggcggctggtacaaggtgctggacagattcatccccggcaccaccaaggtggacgccctgaagaagatgctgctggaccagggcggcttcgccccctgcttcctgggctgcttcctgcccctggtgggcgccctgaacggcctgagcgcccaggacaactgggccaagctgcagagagactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 89508 - DNA, 348 bp, Artificial Sequence
  Description of Artificial Sequence: Synthetic coding sequence
atgggcctgggcgacatcatcagccagcagctggtggagagaagaggcctgcaggagcaccagagaggcagaaccctgaccatggtgagcctgggctgcggcttcgtgggccccgtggtgggcggctggtacaaggtgctggacagattcatccccggcaccaccaaggtggacgccctgaagaagatgctgctggaccagggcggcttcgccccctgcttcctgggctgcttcctgcccctggtgggcgccctgaacggcctgagcgcccaggacaactgggccaagctgcagagagactaccccgacgccctgatcaccaactactacctgtggcccgccgtgtag

SEQ ID NO: 89509 - DNA, 366 bp, Artificial Sequence
  Description of Artificial Sequence: Synthetic coding sequence
tgaagcctgatgggcctgggcgacatcatcagccagcagctggtggagagaagaggcctgcaggagcaccagagaggcagaaccctgaccatggtgagcctgggctgcggcttcgtgggccccgtggtgggcggctggtacaaggtgctggacagattcatccccggcaccaccaaggtggacgccctgaagaagatgctgctggaccaggactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 89510 - DNA, 204 bp, Artificial Sequence
  Description of Artificial Sequence: Synthetic coding sequence
tgagacagccagggcaagaagaccggcttcaccggcatcaagaagggcgactaccccgacgccctgatcaccaactactacctgtggcccgccgtgcagctggccaacttctacctggtgcccctgcactacagactggccgtggtgcagtgcgtggccgtgatctggaacagctacctgagctggaaggcccacagactgtag

SEQ ID NO: 89511 - DNA, 912 bp, Artificial Sequence
  Description of Artificial Sequence: Synthetic coding sequence
atggcccccgccgccgacatgaccagcctgcccctgggcgtgaaggtggaggacagcgccttcggcaagcccgccggcggcggcgccggccaggcccccagcgccgccgccgccaccgccgccgccatgggcgccgacgaggagggcgccaagcccaaggtgagccccagcctgctgcccttcagcgtggaggccctgatggccgaccacagaaagcccggcgccaaggagagcgccctggcccccagcgagggcgtgcaggccgccggcggcagcgcccagcccctgggcgtgccccccggcagcctgggcgcccccgacgcccccagcagccccagacccctgggccacttcagcgtgggcggcctgctgaagctgcccgaggacgccctggtgaaggccgagagccccgagaagcccgagagaaccccctggatgcagagccccagattcagccccccccccgccagaagactgagcccccccgcctgcaccctgagaaagcacaagaccaacagaaagcccagaacccccttcaccaccgcccagctgctggccctggagagaaagttcagacagaagcagtacctgagcatcgccgagagagccgagttcagcagcagcctgagcctgaccgagacccaggtgaagatctggttccagaacagaagagccaaggccaagagactgcaggaggccgagctggagaagctgaagatggccgccaagcccatgctgccccccgccgccttcggcctgagcttccccctgggcggccccgccgccgtggccgccgccgccggcgccagcctgtacggcgccagcggccccttccagagagccgccctgcccgtggcccccgtgggcctgtacaccgcccacgtgggctacagcatgtaccacctgacctag

SEQ ID NO: 89512 - DNA, 804 bp, Artificial Sequence
  Description of Artificial Sequence: Synthetic coding sequence
atggccagccccagcaagggcaacgacctgttcagccccgacgaggagggccccgccgtggtggccggccccggccccggccccggcggcgccgagggcgccgccgaggagagaagagtgaaggtgagcagcctgcccttcagcgtggaggccctgatgagcgacaagaagccccccaaggaggccagccccctgcccgccgagagcgccagcgccggcgccaccctgagacccctgctgctgagcggccacggcgccagagaggcccacagccccggccccctggtgaagcccttcgagaccgccagcgtgaagagcgagaacagcgaggacggcgccgcctggatgcaggagcccggcagatacagccccccccccagacacatgagccccaccacctgcaccctgagaaagcacaagaccaacagaaagcccagaacccccttcaccaccagccagctgctggccctggagagaaagttcagacagaagcagtacctgagcatcgccgagagagccgagttcagcagcagcctgaacctgaccgagacccaggtgaagatctggttccagaacagaagagccaaggccaagagactgcaggaggccgagctggagaagctgaagatggccgccaagcccatgctgcccagcagcttcagcctgcccttccccatcagcagccccctgcaggccgccagcatctacggcgccagctaccccttccacagacccgtgctgcccatcccccccgtgggcctgtacgccacccccgtgggctacggcatgtaccacctgagctag

SEQ ID NO: 89513 - DNA, 981 bp, Artificial Sequence
  Description of Artificial Sequence: Synthetic coding sequence
atgaacaccagccccggcaccgtgggcagcgaccccgtgatcctggccaccgccggctacgaccacaccgtgagattctggcaggcccacagcggcatctgcaccagaaccgtgcagcaccaggacagccaggtgaacgccctggaggtgacccccgacagaagcatgatcgccgccgccggctaccagcacatcagaatgtacgacctgaacagcaacaaccccaaccccatcatcagctacgacggcgtgaacaagaacatcgccagcgtgggcttccacgaggacggcagatggatgtacaccggcggcgaggactgcaccgccagaatctgggacctgagaagcagaaacctgcagtgccagagaatcttccaggtgaacgcccccatcaactgcgtgtgcctgcaccccaaccaggccgagctgatcgtgggcgaccagagcggcgccatccacatctgggacctgaagaccgaccacaacgagcagctgatccccgagcccgaggtgagcatcaccagcgcccacatcgaccccgacgccagctacatggccgccgtgaacagcaccggcaactgctacgtgtggaacctgaccggcggcatcggcgacgaggtgacccagctgatccccaagaccaagatccccgcccacaccagatacgccctgcagtgcagattcagccccgacagcaccctgctggccacctgcagcgccgaccagacctgcaagatctggagaaccagcaacttcagcctgatgaccgagctgagcatcaagagcggcaaccccggcgagagcagcagaggctggatgtggggctgcgccttcagcggcgacagccagtacatcgtgaccgccagcagcgacaacctggccagactgtggtgcgtggagaccggcgagatcaagagagagtacggcggccaccagaaggccgtggtgtgcctggccttcaacgacagcgtgctgggctag

SEQ ID NO: 89514 - DNA, 981 bp, Artificial Sequence; identical to SEQ ID NO: 89513
  Description of Artificial Sequence: Synthetic coding sequence

SEQ ID NO: 89515 - DNA, 984 bp, Artificial Sequence
  Description of Artificial Sequence: Synthetic coding sequence
atgaacaccagccccggcaccgtgggcagcgaccccgtgatcctggccaccgccggctacgaccacaccgtgagattctggcaggcccacagcggcatctgcaccagaaccgtgcagcaccaggacagccaggtgaacgccctggaggtgacccccgacagaagcatgatcgccgccgccggctaccagcacatcagaatgtacgacctgaacagcaacaaccccaaccccatcatcagctacgacggcgtgaacaagaacatcgccagcgtgggcttccacgaggacggcagatggatgtacaccggcggcgaggactgcaccgccagaatctgggacctgagaagcagaaacctgcagtgccagagaatcttccaggtgaacgcccccatcaactgcgtgtgcctgcaccccaaccaggccgagctgatcgtgggcgaccagagcggcgccatccacatctgggacctgaagaccgaccacaacgagcagctgatccccgagcccgaggtgagcatcaccagcgcccacatcgaccccgacgccagctacatggccgccgtgaacagcaccggcaactgctacgtgtggaacctgaccggcggcatcggcgacgaggtgacccagctgatccccaagaccaagatccccgcccacaccagatacgccctgcagtgcagattcagccccgacagcaccctgctggccacctgcagcgccgaccagacctgcaagatctggagaaccagcaacttcagcctgatgaccgagctgagcatcaagagcggcaaccccggcgagagcagcagaggctggatgtggggctgcgccttcagcggcgacagccagtacatcgtgaccggcgagcccagacccggcctgccccacccctggccccccgccctggccagcagagccagcccccccagactgcagctgcccctgtgctggggcagactgctgggcctgcacctgagaagctag

SEQ ID NO: 89516 - DNA, 654 bp, Artificial Sequence
  Description of Artificial Sequence: Synthetic coding sequence
atggagcacgccccctggagccccggcgccagcagcagagccagagccggccacaccatgaacaccagccccggcaccgtgggcagcgaccccgtgatcctggccaccgccggctacgaccacaccgtgagattctggcaggcccacagcggcatctgcaccagaaccgtgcagcaccaggacagccaggtgaacgccctggaggtgacccccgacagaagcatgatcgccgccgccggctaccagcacatcagaatgtacgacctgaacagcaacaaccccaaccccatcatcagctacgacggcgtgaacaagaacatcgccagcgtgggcttccacgaggacggcagatggatgtacaccggcggcgaggactgcaccgccagaatctgggacctgagaagcagaaacctgcagtgccagagaatcttccaggtgaacgcccccatcaactgcgtgtgcctgcaccccaaccaggccgagctgatcgtgggcgaccagagcggcgccatccacatctgggacctgaagaccgaccacaacgagcagctgatccccgagcccgaggtgagcatcaccagcgcccacatcgaccccgacgccagctacatggccgccgtgaacagcaccgcccccagacacctgctgggctag

SEQ ID NO: 89517 - DNA, 981 bp, Artificial Sequence; identical to SEQ ID NO: 89513
  Description of Artificial Sequence: Synthetic coding sequence

SEQ ID NO: 89518 - DNA, 981 bp, Artificial Sequence; identical to SEQ ID NO: 89513
  Description of Artificial Sequence: Synthetic coding sequence

SEQ ID NO: 89519 - DNA, 1473 bp, Artificial Sequence
  Description of Artificial Sequence: Synthetic coding sequence
atggcccagagagccgtgtggctgatcagccacgagcccggcacccccctgtgcggcaccgtgagattcagcagaagataccccaccgtggagaagagagccagagtgttcaacggcgccagctacgtgcccgtgcccgaggacggccccttcctgaaggccctgctgttcgagctgagactgctggacgacgacaaggacttcgtggagagcagagacagctgcagcagaatcaacaagaccagcatctacggcctgctgatcggcggcgaggagctgtggcccgtggtggccttcctgaagaacgacatgatctacgcctgcgtgcccctggtggagcagaccctgagccccagaccccccctgatcagcgtgagcggcgtgagccagggcttcgagttcctgttcggcatccaggacttcctgtacagcggccagaagaacgacagcgagctgaacaccaagctgagccagctgcccgacctgctgctgcaggcctgccccttcggcaccctgctggacgccaacctgcagaacagcctggacaacaccaacttcgccagcgtgacccagccccagaagcagcccgcctggaagaccggcacctacaagggcaagccccaggtgagcatcagcatcaccgagaaggtgaagagcatgcagtacgacaagcagggcatcgccgacacctggcaggtggtgggcaccgtgacctgcaagtgcgacctggagggcatcatgcccaacgtgaccatcagcctgagcctgcccaccaacggcagccccctgcaggacatcctggtgcacccctgcgtgaccagcctggacagcgccatcctgaccagcagcagcatcgacgccatggacgacagcgccttcagcggcccctacaagttccccttcaccccccccctggagagcttcaacctgtgcttctacaccagccaggtgcccgtgccccccatcctgggcttctaccagatgaaggaggaggaggtgcagctgagaatcaccatcaacctgaagctgcacgagagcgtgaagaacaacttcgagttctgcgaggcccacatccccttctacaacagaggccccatcacccacctggagtacaagaccagcttcggccagctggaggtgttcagagagaagagcctgctgatctggatcatcggccagaagttccccaagagcatggagatcagcctgagcggcaccgtgaccttcggcgccaagagccacgagaagcagcccttcgaccccatctgcaccggcgagaccgcctacctgaagctgcacttcagaatcctggactacaccctgaccggctgctacgccgaccagcacagcgtgcaggtgttcgccagcggcaagcccaagatcagcgcccacagaaagctgatcagcagcgactactacatctggaacagcaaggcccccgcccccgtgacctacggcagcctgctgctgtag

SEQ ID NO: 89520 - DNA, 16437 bp, Artificial Sequence
  Description of Artificial Sequence: Synthetic coding sequence
atgctggtgatctggatcctgaccctggccctgagactgtgcgccagcgtgaccaccgtgacccccgagggcagcgccgtgcacaaggccatcagccagcagggcaccctgtggaccggcgaggtgctggagaagcagaccgtggagcagggcaagagcaccctgagaagacagaagaaccacttccacagaagcgccggcgagctgagatgcagaaacgccctgaaggacgagggcgccagcgccggctggagcgtgatgttcgccggcgagagcgtggtggtgctggtgcacctgtggatgaccggcgccagagtgaagaacctgggcctggtggagttcgccagccccggcgacgacggcgacggcagagccgagggcttcagcctgggcctgcccctgagcgagcaggccagagccgccggcgccagagagaaggagagacaggagaccgtgatcaaccacagcaccttcagcggcttcagccagatcaccggcagcaccgtgaacaccagcatcggcggcaacaccaccagcgccagcacccccagcagcagcgaccccttcaccaccttcagcgactacggcgtgagcgtgaccttcatcaccggcagcaccgccaccaagcacttcctggacagcagcaccaacagcggccacagcgaggagagcaccgtgagccacagcggccccggcgccaccggcaccaccctgttccccagccacagcgccaccagcgtgttcgtgggcgagcccaagaccagccccatcaccagcgccagcatggagaccaccgccctgcccggcagcaccaccaccgccggcctgagcgagaagagcaccaccttctacagcagccccagaagccccgacagaaccctgagccccgccagaaccaccagcagcggcgtgagcgagaagagcaccaccagccacagcagacccggccccacccacaccatcgccttccccgacagcaccaccatgcccggcgtgagccaggagagcaccgccagccacagcatccccggcagcaccgacaccaccctgagccccggcaccaccacccccagcagcctgggccccgagagcaccaccttccacagcagccccggctacaccaagaccaccagactgcccgacaacaccaccaccagcggcctgctggaggccagcacccccgtgcacagcagcaccggcagcccccacaccaccctgagccccagcagcagcaccacccacgagggcgagcccaccaccttccagagctggcccagcagcaaggacaccagccccgcccccagcggcaccaccagcgccttcgtgaagctgagcaccacctaccacagcagccccagcagcacccccaccacccacttcagcgccagcagcaccaccctgggccacagcgaggagagcacccccgtgcacagcagccccgtggccaccgccaccacccccccccccgccagaagcgccaccagcggccacgtggaggagagcaccgcctaccacagaagccccggcagcacccagaccatgcacttccccgagagcagcaccaccagcggccacagcgaggagagcgccaccttccacggcagcaccacccacaccaagagcagcacccccagcaccaccgccgccctggcccacaccagctaccacagcagcctgggcagcaccgagaccacccacttcagagacagcagcaccatcagcggcagaagcgaggagagcaaggccagccacagcagccccgacgccatggccaccaccgtgctgcccgccggcagcacccccagcgtgctggtgggcgacagcacccccagccccatcagcagcggcagcatggagaccaccgccctgcccggcagcaccaccaagcccggcctgagcgagaagagcaccaccttctacagcagccccagaagccccgacaccacccacctgcccgccagcatgaccagcagcggcgtgagcgaggagagcaccaccagccacagcagacccggcagcacccacaccaccgccttccccggcagcaccaccatgcccggcctgagccaggagagcaccgccagccacagcagccccggccccaccgacaccaccctgagccccggcagcaccaccgccagcagcctgggccccgagtacaccaccttccacagcagacccggcagcaccgagaccaccctgctgcccgacaacaccaccgccagcggcctgctggaggccagcatgcccgtgcacagcagcaccagaagcccccacaccaccctgagccccgccggcagcaccaccagacagggcgagagcaccaccttccacagctggcccagcagcaaggacaccagacccgccccccccaccaccaccagcgccttcgtggagcccagcaccaccagccacggcagccccagcagcatccccaccacccacatcagcgccagaagcaccaccagcggcctggtggaggagagcaccacctaccacagcagccccggcagcacccagaccatgcacttccccgagagcgacaccaccagcggcagaggcgaggagagcaccaccagccacagcagcaccacccacaccatcagcagcgcccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagagaagcaccaccttccacagcagccccagaagccccgccaccaccctgagccccgccagcaccaccagcagcggcgtgagcgaggagagcaccaccagcagaagcagacccggcagcacccacaccaccgccttccccgacagcaccaccacccccggcctgagcagacacagcaccaccagccacagcagccccggcagcaccgacaccaccctgctgcccgccagcaccaccaccagcggccccagccaggagagcaccaccagccacagcagcagcggcagcaccgacaccgccctgagccccggcagcaccaccgccctgagcttcggccaggagagcaccaccttccacagcaaccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccgccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagcagaggcagcaccgagaccaccgtgttcccccacagcaccaccaccagcgtgcacggcgaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaagctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccaccagcgacctgagccaggagcccaccaccagccacagcagccagggcagcaccgaggccaccctgagccccggcagcaccaccgccagcagcctgggccagcagagcaccaccttccacagcagccccggcgacaccgagaccaccctgctgcccgacgacaccatcaccagcggcctggtggaggccagcacccccacccacagcagcaccggcagcctgcacaccaccctgacccccgccagcagcaccagcgccggcctgcaggaggagagcaccaccttccagagctggcccagcagcagcgacaccacccccagcccccccggcaccaccgccgcccccgtggaggtgagcaccacctaccacagcagacccagcagcacccccaccacccacttcagcgccagcagcaccaccctgggcagaagcgaggagagcaccaccgtgcacagcagccccggcgccaccggcaccgccctgttccccaccagaagcgccaccagcgtgctggtgggcgagcccaccaccagccccatcagcagcggcagcaccgagaccaccgccctgcccggcagcaccaccaccgccggcctgagcgagaagagcaccaccttctacagcagccccagaagccccgacaccaccctgagccccgccagcaccaccagcagcggcgtgagcgaggagagcaccaccagccacagcagacccggcagcacccacaccaccgccttccccggcagcaccaccatgcccggcgtgagccaggagagcaccgccagccacagcagccccggcagcaccgacaccaccctgagccccggcagcaccaccgccagcagcctgggccccgagagcaccaccttccacagcagccccggcagcaccgagaccaccctgctgcccgacaacaccaccgccagcggcctgctggaggccagcacccccgtgcacagcagcaccggcagcccccacaccaccctgagccccgccggcagcaccaccagacagggcgagagcaccaccttccagagctggcccagcagcaaggacaccatgcccgccccccccaccaccaccagcgccttcgtggagctgagcaccaccagccacggcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccgcctaccacagcagccccggcagcacccagaccatgcacttccccgagagcagcaccgccagcggcagaagcgaggagagcagaaccagccacagcagcaccacccacaccatcagcagcccccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagaagagcaccaccttccacagcagccccagaagccccgccaccaccctgagccccgccagcaccaccagcagcggcgtgagcgaggagagcaccaccagccacagcagacccggcagcacccacaccaccgccttccccgacagcaccaccacccccggcctgagcagacacagcaccaccagccacagcagccccggcagcaccgacaccaccctgctgcccgccagcaccaccaccagcggccccagccaggagagcaccaccagccacagcagccccggcagcaccgacaccgccctgagccccggcagcaccaccgccctgagcttcggccaggagagcaccaccttccacagcagccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccgccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagccccggcagcaccgagaccaccgtgttccccagaacccccaccaccagcgtgagaggcgaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaccctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccacccccggcctgagcagacacagcaccaccagccacagcagccccggcagcaccgacaccaccctgctgcccgccagcaccaccaccagcggccccagccaggagagcaccaccagccacagcagccccggcagcaccgacaccgccctgagccccggcagcaccaccgccctgagcttcggccaggagagcaccaccttccacagcagccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccaccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagccccggcagcaccgagaccaccgtgttccccagaagcaccaccaccagcgtgagaggcgaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaccctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccaccagcggcctgagccaggagcccaccgccagccacagcagccagggcagcaccgaggccaccctgagccccggcagcaccaccgccagcagcctgggccagcagagcaccaccttccacagcagccccggcgacaccgagaccaccctgctgcccgacgacaccatcaccagcggcctggtggaggccagcacccccacccacagcagcaccggcagcctgcacaccaccctgacccccgccagcagcaccagcgccggcctgcaggaggagagcaccaccttccagagctggcccagcagcagcgacaccacccccagcccccccggcaccaccgccgcccccgtggaggtgagcaccacctaccacagcagacccagcagcacccccaccacccacttcagcgccagcagcaccaccctgggcagaagcgaggagagcaccaccgtgcacagcagccccggcgccaccggcaccgccctgttccccaccagaagcgccaccagcgtgctggtgggcgagcccaccaccagccccatcagcagcggcagcaccgagaccaccgccctgcccggcagcaccaccaccgccggcctgagcgagaagagcaccaccttctacagcagccccagaagccccgacaccaccctgagccccgccagcaccaccagcagcggcgtgagcgaggagagcaccaccagccacagcagacccggcagcacccacaccaccgccttccccggcagcaccaccatgcccggcgtgagccaggagagcaccgccagccacagcagccccggcagcaccgacaccaccctgagccccggcagcaccaccgccagcagcctgggccccgagagcaccaccttccacagcggccccggcagcaccgagaccaccctgctgcccgacaacaccaccgccagcggcctgctggaggccagcacccccgtgcacagcagcaccggcagcccccacaccaccctgagccccgccggcagcaccaccagacagggcgagagcaccaccttccagagctggcccaacagcaaggacaccacccccgccccccccaccaccaccagcgccttcgtggagctgagcaccaccagccacggcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccacctaccacagcagccccggcagcacccagaccatgcacttccccgagagcgacaccaccagcggcagaggcgaggagagcaccaccagccacagcagcaccacccacaccatcagcagcgcccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagaagagcaccaccttccacagcagccccagaagccccgccaccaccctgagccccgccagcaccaccagcagcggcgtgagcgaggagagcaccaccagccacagcagacccggcagcacccacaccaccgccttccccgacagcaccaccacccccggcctgagcagacacagcaccaccagccacagcagccccggcagcaccgacaccaccctgctgcccgccagcaccaccaccagcggcagcagccaggagagcaccaccagccacagcagcagcggcagcaccgacaccgccctgagccccggcagcaccaccgccctgagcttcggccaggagagcaccaccttccacagcagccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccgccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagccccggcagcaccgagaccaccgtgttccccagaagcaccaccaccagcgtgagaagagaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaagctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccaccagcggcctgagccaggagcccaccaccagccacagcagccagggcagcaccgaggccaccctgagccccggcagcaccaccgccagcagcctgggccagcagagcaccaccttccacagcagccccggcgacaccgagaccaccctgctgcccgacgacaccatcaccagcggcctggtggaggccagcacccccacccacagcagcaccggcagcctgcacaccaccctgacccccgccagcagcaccagcaccggcctgcaggaggagagcaccaccttccagagctggcccagcagcagcgacaccacccccagcccccccagcaccaccgccgtgcccgtggaggtgagcaccacctaccacagcagacccagcagcacccccaccacccacttcagcgccagcagcaccaccctgggcagaagcgaggagagcaccaccgtgcacagcagccccggcgccaccggcaccgccctgttccccaccagaagcgccaccagcgtgctggtgggcgagcccaccaccagccccatcagcagcggcagcaccgagaccaccgccctgcccggcagcaccaccaccgccggcctgagcgagaagagcaccaccttctacagcagccccagaagccccgacaccaccctgagccccgccagcaccaccagcagcggcgtgagcgaggagagcaccaccagccacagcagacccggcagcatgcacaccaccgccttccccagcagcaccaccatgcccggcgtgagccaggagagcaccgccagccacagcagccccggcagcaccgacaccaccctgagccccggcagcaccaccgccagcagcctgggccccgagagcaccaccttccacagcagccccggcagcaccgagaccaccctgctgcccgacaacaccaccgccagcggcctgctggaggccagcacccccgtgcacagcagcaccggcagcccccacaccaccctgagccccgccggcagcaccaccagacagggcgagagcaccaccttccagagctggcccaacagcaaggacaccacccccgccccccccaccaccaccagcgccttcgtggagctgagcaccaccagccacggcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccacctaccacagcagccccggcagcacccagaccatgcacttccccgagagcaacaccaccagcggcagaggcgaggagagcaccaccagccacagcagcaccacccacaccatcagcagcgcccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagaagagcaccaccttccacagcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccgcctaccacagcagccccggcagcacccagaccatgcacttccccgagagcagcaccgccagcggcagaagcgaggagagcagaaccagccacagcagcaccacccacaccatcagcagcccccccagcaccaccagcgccctggtggaggagcccaccagctaccacagcagccccggcagcatcgccaccacccacttccccgagagcagcaccaccagcggcagaagcgaggagagcaccgccagccacagcagccccgacaccaacggcatcacccccctgcccgcccacttcaccaccagcggcagaatcgccgagagcaccaccttctacatcagccccggcagcatggagaccaccctggccagcaccgccaccacccccggcctgagcgccaagagcaccatcctgtacagcagcagcagaagccccgaccagaccctgagccccgccagcatgaccagcagcagcatcagcggcgagcccaccagcctgtacagccaggccgagagcacccacaccaccgccttccccgccagcaccaccaccagcggcctgagccaggagagcaccaccttccacagcaagcccggcagcaccgagaccaccctgagccccggcagcatcaccaccagcagcttcgcccaggagttcaccaccccccacagccagcccggcagcgccctgagcaccgtgagccccgccagcaccaccgtgcccggcctgagcgaggagagcaccaccttctacagcagccccggcagcaccgagaccaccgccttcagccacagcaacaccatgagcatccacagccagcagagcacccccttccccgacagccccggcttcacccacaccgtgctgcccgccaccctgaccaccaccgacatcggccaggagagcaccgccttccacagcagcagcgacgccaccggcaccacccccctgcccgccagaagcaccgccagcgacctggtgggcgagcccaccaccttctacatcagccccagccccacctacaccaccctgttccccgccagcagcagcaccagcggcctgaccgaggagagcaccaccttccacaccagccccagcttcaccagcaccatcgtgagcaccgagagcctggagaccctggcccccggcctgtgccaggagggccagatctggaacggcaagcagtgcgtgtgcccccagggctacgtgggctaccagtgcctgagccccctggagagcttccccgtggagacccccgagaagctgaacgccaccctgggcatgaccgtgaaggtgacctacagaaacttcaccgagaagatgaacgacgccagcagccaggagtaccagaacttcagcaccctgttcaagaacagaatggacgtggtgctgaagggcgacaacctgccccagtacagaggcgtgaacatcagaagactgctgaacggcagcatcgtggtgaagaacgacgtgatcctggaggccgactacaccctggagtacgaggagctgttcgagaacctggccgagatcgtgaaggccaagatcatgaacgagaccagaaccaccctgctggaccccgacagctgcagaaaggccatcctgtgctacagcgaggaggacaccttcgtggacagcagcgtgacccccggcttcgacttccaggagcagtgcacccagaaggccgccgagggctacacccagttctactacgtggacgtgctggacggcaagctggcctgcgtgaacaagtgcaccaagggcaccaagagccagatgaactgcaacctgggcacctgccagctgcagagaagcggccccagatgcctgtgccccaacaccaacacccactggtactggggcgagacctgcgagttcaacatcgccaagagcctggtgtacggcatcgtgggcgccgtgatggccgtgctgctgctggccctgatcatcctgatcatcctgttcagcctgagccagagaaagagacacagagagcagtacgacgtgccccaggagtggagaaaggagggcacccccggcatcttccagaagaccgccatctgggaggaccagaacctgagagagagcagattcggcctggagaacgcctacaacaacttcagacccaccctggagaccgtggacagcggcaccgagctgcacatccagagacccgagatggtggccagcaccgtgtag

SEQ ID NO: 89521 - DNA, 16008 bp, Artificial Sequence
  Description of Artificial Sequence: Synthetic coding sequence
atgctggtgatctggatcctgaccctggccctgagactgtgcgccagcgtgaccaccgtgacccccggcagcaccgtgaacaccagcatcggcggcaacaccaccagcgccagcacccccagcagcagcgaccccttcaccaccttcagcgactacggcgtgagcgtgaccttcatcaccggcagcaccgccaccaagcacttcctggacagcagcaccaacagcggccacagcgaggagagcaccgtgagccacagcggccccggcgccaccggcaccaccctgttccccagccacagcgccaccagcgtgttcgtgggcgagcccaagaccagccccatcaccagcgccagcatggagaccaccgccctgcccggcagcaccaccaccgccggcctgagcgagaagagcaccaccttctacagcagccccagaagccccgacagaaccctgagccccgccagaaccaccagcagcggcgtgagcgagaagagcaccaccagccacagcagacccggccccacccacaccatcgccttccccgacagcaccaccatgcccggcgtgagccaggagagcaccgccagccacagcatccccggcagcaccgacaccaccctgagccccggcaccaccacccccagcagcctgggccccgagagcaccaccttccacagcagccccggctacaccaagaccaccagactgcccgacaacaccaccaccagcggcctgctggaggccagcacccccgtgcacagcagcaccggcagcccccacaccaccctgagccccagcagcagcaccacccacgagggcgagcccaccaccttccagagctggcccagcagcaaggacaccagccccgcccccagcggcaccaccagcgccttcgtgaagctgagcaccacctaccacagcagccccagcagcacccccaccacccacttcagcgccagcagcaccaccctgggccacagcgaggagagcacccccgtgcacagcagccccgtggccaccgccaccacccccccccccgccagaagcgccaccagcggccacgtggaggagagcaccgcctaccacagaagccccggcagcacccagaccatgcacttccccgagagcagcaccaccagcggccacagcgaggagagcgccaccttccacggcagcaccacccacaccaagagcagcacccccagcaccaccgccgccctggcccacaccagctaccacagcagcctgggcagcaccgagaccacccacttcagagacagcagcaccatcagcggcagaagcgaggagagcaaggccagccacagcagccccgacgccatggccaccaccgtgctgcccgccggcagcacccccagcgtgctggtgggcgacagcacccccagccccatcagcagcggcagcatggagaccaccgccctgcccggcagcaccaccaagcccggcctgagcgagaagagcaccaccttctacagcagccccagaagccccgacaccacccacctgcccgccagcatgaccagcagcggcgtgagcgaggagagcaccaccagccacagcagacccggcagcacccacaccaccgccttccccggcagcaccaccatgcccggcctgagccaggagagcaccgccagccacagcagccccggccccaccgacaccaccctgagccccggcagcaccaccgccagcagcctgggccccgagtacaccaccttccacagcagacccggcagcaccgagaccaccctgctgcccgacaacaccaccgccagcggcctgctggaggccagcatgcccgtgcacagcagcaccagaagcccccacaccaccctgagccccgccggcagcaccaccagacagggcgagagcaccaccttccacagctggcccagcagcaaggacaccagacccgccccccccaccaccaccagcgccttcgtggagcccagcaccaccagccacggcagccccagcagcatccccaccacccacatcagcgccagaagcaccaccagcggcctggtggaggagagcaccacctaccacagcagccccggcagcacccagaccatgcacttccccgagagcgacaccaccagcggcagaggcgaggagagcaccaccagccacagcagcaccacccacaccatcagcagcgcccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagagaagcaccaccttccacagcagccccagaagccccgccaccaccctgagccccgccagcaccaccagcagcggcgtgagcgaggagagcaccaccagcagaagcagacccggcagcacccacaccaccgccttccccgacagcaccaccacccccggcctgagcagacacagcaccaccagccacagcagccccggcagcaccgacaccaccctgctgcccgccagcaccaccaccagcggccccagccaggagagcaccaccagccacagcagcagcggcagcaccgacaccgccctgagccccggcagcaccaccgccctgagcttcggccaggagagcaccaccttccacagcaaccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccgccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagcagaggcagcaccgagaccaccgtgttcccccacagcaccaccaccagcgtgcacggcgaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaagctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccaccagcgacctgagccaggagcccaccaccagccacagcagccagggcagcaccgaggccaccctgagccccggcagcaccaccgccagcagcctgggccagcagagcaccaccttccacagcagccccggcgacaccgagaccaccctgctgcccgacgacaccatcaccagcggcctggtggaggccagcacccccacccacagcagcaccggcagcctgcacaccaccctgacccccgccagcagcaccagcgccggcctgcaggaggagagcaccaccttccagagctggcccagcagcagcgacaccacccccagcccccccggcaccaccgccgcccccgtggaggtgagcaccacctaccacagcagacccagcagcacccccaccacccacttcagcgccagcagcaccaccctgggcagaagcgaggagagcaccaccgtgcacagcagccccggcgccaccggcaccgccctgttccccaccagaagcgccaccagcgtgctggtgggcgagcccaccaccagccccatcagcagcggcagcaccgagaccaccgccctgcccggcagcaccaccaccgccggcctgagcgagaagagcaccaccttctacagcagccccagaagccccgacaccaccctgagccccgccagcaccaccagcagcggcgtgagcgaggagagcaccaccagccacagcagacccggcagcacccacaccaccgccttccccggcagcaccaccatgcccggcgtgagccaggagagcaccgccagccacagcagccccggcagcaccgacaccaccctgagccccggcagcaccaccgccagcagcctgggccccgagagcaccaccttccacagcagccccggcagcaccgagaccaccctgctgcccgacaacaccaccgccagcggcctgctggaggccagcacccccgtgcacagcagcaccggcagcccccacaccaccctgagccccgccggcagcaccaccagacagggcgagagcaccaccttccagagctggcccagcagcaaggacaccatgcccgccccccccaccaccaccagcgccttcgtggagctgagcaccaccagccacggcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccgcctaccacagcagccccggcagcacccagaccatgcacttccccgagagcagcaccgccagcggcagaagcgaggagagcagaaccagccacagcagcaccacccacaccatcagcagcccccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagaagagcaccaccttccacagcagccccagaagccccgccaccaccctgagccccgccagcaccaccagcagcggcgtgagcgaggagagcaccaccagccacagcagacccggcagcacccacaccaccgccttccccgacagcaccaccacccccggcctgagcagacacagcaccaccagccacagcagccccggcagcaccgacaccaccctgctgcccgccagcaccaccaccagcggccccagccaggagagcaccaccagccacagcagccccggcagcaccgacaccgccctgagccccggcagcaccaccgccctgagcttcggccaggagagcaccaccttccacagcagccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccgccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagccccggcagcaccgagaccaccgtgttccccagaacccccaccaccagcgtgagaggcgaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaccctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccacccccggcctgagcagacacagcaccaccagccacagcagccccggcagcaccgacaccaccctgctgcccgccagcaccaccaccagcggccccagccaggagagcaccaccagccacagcagccccggcagcaccgacaccgccctgagccccggcagcaccaccgccctgagcttcggccaggagagcaccaccttccacagcagccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccaccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagccccggcagcaccgagaccaccgtgttccccagaagcaccaccaccagcgtgagaggcgaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaccctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccaccagcggcctgagccaggagcccaccgccagccacagcagccagggcagcaccgaggccaccctgagccccggcagcaccaccgccagcagcctgggccagcagagcaccaccttccacagcagccccggcgacaccgagaccaccctgctgcccgacgacaccatcaccagcggcctggtggaggccagcacccccacccacagcagcaccggcagcctgcacaccaccctgacccccgccagcagcaccagcgccggcctgcaggaggagagcaccaccttccagagctggcccagcagcagcgacaccacccccagcccccccggcaccaccgccgcccccgtggaggtgagcaccacctaccacagcagacccagcagcacccccaccacccacttcagcgccagcagcaccaccctgggcagaagcgaggagagcaccaccgtgcacagcagccccggcgccaccggcaccgccctgttccccaccagaagcgccaccagcgtgctggtgggcgagcccaccaccagccccatcagcagcggcagcaccgagaccaccgccctgcccggcagcaccaccaccgccggcctgagcgagaagagcaccaccttctacagcagccccagaagccccgacaccaccctgagccccgccagcaccaccagcagcggcgtgagcgaggagagcaccaccagccacagcagacccggcagcacccacaccaccgccttccccggcagcaccaccatgcccggcgtgagccaggagagcaccgccagccacagcagccccggcagcaccgacaccaccctgagccccggcagcaccaccgccagcagcctgggccccgagagcaccaccttccacagcggccccggcagcaccgagaccaccctgctgcccgacaacaccaccgccagcggcctgctggaggccagcacccccgtgcacagcagcaccggcagcccccacaccaccctgagccccgccggcagcaccaccagacagggcgagagcaccaccttccagagctggcccaacagcaaggacaccacccccgccccccccaccaccaccagcgccttcgtggagctgagcaccaccagccacggcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccacctaccacagcagccccggcagcacccagaccatgcacttccccgagagcgacaccaccagcggcagaggcgaggagagcaccaccagccacagcagcaccacccacaccatcagcagcgcccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagaagagcaccaccttccacagcagccccagaagccccgccaccaccctgagccccgccagcaccaccagcagcggcgtgagcgaggagagcaccaccagccacagcagacccggcagcacccacaccaccgccttccccgacagcaccaccacccccggcctgagcagacacagcaccaccagccacagcagccccggcagcaccgacaccaccctgctgcccgccagcaccaccaccagcggcagcagccaggagagcaccaccagccacagcagcagcggcagcaccgacaccgccctgagccccggcagcaccaccgccctgagcttcggccaggagagcaccaccttccacagcagccccggcagcacccacaccaccctgttccccgacagcaccaccagcagcggcatcgtggaggccagcaccagagtgcacagcagcaccggcagccccagaaccaccctgagccccgccagcagcaccagccccggcctgcagggcgagagcaccgccttccagacccaccccgccagcacccacaccacccccagcccccccagcaccgccaccgcccccgtggaggagagcaccacctaccacagaagccccggcagcacccccaccacccacttccccgccagcagcaccaccagcggccacagcgagaagagcaccatcttccacagcagccccgacgccagcggcaccacccccagcagcgcccacagcaccaccagcggcagaggcgagagcaccaccagcagaatcagccccggcagcaccgagatcaccaccctgcccggcagcaccaccacccccggcctgagcgaggccagcaccaccttctacagcagccccagaagccccaccaccaccctgagccccgccagcatgaccagcctgggcgtgggcgaggagagcaccaccagcagaagccagcccggcagcacccacagcaccgtgagccccgccagcaccaccacccccggcctgagcgaggagagcaccaccgtgtacagcagcagccccggcagcaccgagaccaccgtgttccccagaagcaccaccaccagcgtgagaagagaggagcccaccaccttccacagcagacccgccagcacccacaccaccctgttcaccgaggacagcaccaccagcggcctgaccgaggagagcaccgccttccccggcagccccgccagcacccagaccggcctgcccgccaccctgaccaccgccgacctgggcgaggagagcaccaccttccccagcagcagcggcagcaccggcaccaagctgagccccgccagaagcaccaccagcggcctggtgggcgagagcacccccagcagactgagccccagcagcaccgagaccaccaccctgcccggcagccccaccacccccagcctgagcgagaagagcaccaccttctacaccagccccagaagccccgacgccaccctgagccccgccaccaccaccagcagcggcgtgagcgaggagagcagcaccagccacagccagcccggcagcacccacaccaccgccttccccgacagcaccaccaccagcggcctgagccaggagcccaccaccagccacagcagccagggcagcaccgaggccaccctgagccccggcagcaccaccgccagcagcctgggccagcagagcaccaccttccacagcagccccggcgacaccgagaccaccctgctgcccgacgacaccatcaccagcggcctggtggaggccagcacccccacccacagcagcaccggcagcctgcacaccaccctgacccccgccagcagcaccagcaccggcctgcaggaggagagcaccaccttccagagctggcccagcagcagcgacaccacccccagcccccccagcaccaccgccgtgcccgtggaggtgagcaccacctaccacagcagacccagcagcacccccaccacccacttcagcgccagcagcaccaccctgggcagaagcgaggagagcaccaccgtgcacagcagccccggcgccaccggcaccgccctgttccccaccagaagcgccaccagcgtgctggtgggcgagcccaccaccagccccatcagcagcggcagcaccgagaccaccgccctgcccggcagcaccaccaccgccggcctgagcgagaagagcaccaccttctacagcagccccagaagccccgacaccaccctgagccccgccagcaccaccagcagcggcgtgagcgaggagagcaccaccagccacagcagacccggcagcatgcacaccaccgccttccccagcagcaccaccatgcccggcgtgagccaggagagcaccgccagccacagcagccccggcagcaccgacaccaccctgagccccggcagcaccaccgccagcagcctgggccccgagagcaccaccttccacagcagccccggcagcaccgagaccaccctgctgcccgacaacaccaccgccagcggcctgctggaggccagcacccccgtgcacagcagcaccggcagcccccacaccaccctgagccccgccggcagcaccaccagacagggcgagagcaccaccttccagagctggcccaacagcaaggacaccacccccgccccccccaccaccaccagcgccttcgtggagctgagcaccaccagccacggcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccacctaccacagcagccccggcagcacccagaccatgcacttccccgagagcaacaccaccagcggcagaggcgaggagagcaccaccagccacagcagcaccacccacaccatcagcagcgcccccagcaccaccagcgccctggtggaggagcccaccagctaccacagcagccccggcagcaccgccaccacccacttccccgacagcagcaccaccagcggcagaagcgaggagagcaccgccagccacagcagccaggacgccaccggcaccatcgtgctgcccgccagaagcaccaccagcgtgctgctgggcgagagcaccaccagccccatcagcagcggcagcatggagaccaccgccctgcccggcagcaccaccacccccggcctgagcgagaagagcaccaccttccacagcagccccagcagcacccccaccacccacttcagcgccagcagcaccaccctgggcagaagcgaggagagcaccaccgtgcacagcagccccgtggccaccgccaccacccccagccccgccagaagcaccaccagcggcctggtggaggagagcaccgcctaccacagcagccccggcagcacccagaccatgcacttccccgagagcagcaccgccagcggcagaagcgaggagagcagaaccagccacagcagcaccacccacaccatcagcagcccccccagcaccaccagcgccctggtggaggagcccaccagctaccacagcagccccggcagcatcgccaccacccacttccccgagagcagcaccaccagcggcagaagcgaggagagcaccgccagccacagcagccccgacaccaacggcatcacccccctgcccgcccacttcaccaccagcggcagaatcgccgagagcaccaccttctacatcagccccggcagcatggagaccaccctggccagcaccgccaccacccccggcctgagcgccaagagcaccatcctgtacagcagcagcagaagccccgaccagaccctgagccccgccagcatgaccagcagcagcatcagcggcgagcccaccagcctgtacagccaggccgagagcacccacaccaccgccttccccgccagcaccaccaccagcggcctgagccaggagagcaccaccttccacagcaagcccggcagcaccgagaccaccctgagccccggcagcatcaccaccagcagcttcgcccaggagttcaccaccccccacagccagcccggcagcgccctgagcaccgtgagccccgccagcaccaccgtgcccggcctgagcgaggagagcaccaccttctacagcagccccggcagcaccgagaccaccgccttcagccacagcaacaccatgagcatccacagccagcagagcacccccttccccgacagccccggcttcacccacaccgtgctgcccgccaccctgaccaccaccgacatcggccaggagagcaccgccttccacagcagcagcgacgccaccggcaccacccccctgcccgccagaagcaccgccagcgacctggtgggcgagcccaccaccttctacatcagccccagccccacctacaccaccctgttccccgccagcagcagcaccagcggcctgaccgaggagagcaccaccttccacaccagccccagcttcaccagcaccatcgtgagcaccgagagcctggagaccctggcccccggcctgtgccaggagggccagatctggaacggcaagcagtgcgtgtgcccccagggctacgtgggctaccagtgcctgagccccctggagagcttccccgtggagacccccgagaagctgaacgccaccctgggcatgaccgtgaaggtgacctacagaaacttcaccgagaagatgaacgacgccagcagccaggagtaccagaacttcagcaccctgttcaagaacagaatggacgtggtgctgaagggcgacaacctgccccagtacagaggcgtgaacatcagaagactgctgaacggcagcatcgtggtgaagaacgacgtgatcctggaggccgactacaccctggagtacgaggagctgttcgagaacctggccgagatcgtgaaggccaagatcatgaacgagaccagaaccaccctgctggaccccgacagctgcagaaaggccatcctgtgctacagcgaggaggacaccttcgtggacagcagcgtgacccccggcttcgacttccaggagcagtgcacccagaaggccgccgagggctacacccagttctactacgtggacgtgctggacggcaagctggcctgcgtgaacaagtgcaccaagggcaccaagagccagatgaactgcaacctgggcacctgccagctgcagagaagcggccccagatgcctgtgccccaacaccaacacccactggtactggggcgagacctgcgagttcaacatcgccaagagcctggtgtacggcatcgtgggcgccgtgatggccgtgctgctgctggccctgatcatcctgatcatcctgttcagcctgagccagagaaagagacacagagagcagtacgacgtgccccaggagtggagaaaggagggcacccccggcatcttccagaagaccgccatctgggaggaccagaacctgagagagagcagattcggcctggagaacgcctacaacaacttcagacccaccctggagaccgtggacagcggcaccgagctgcacatccagagacccgagatggtggccagcaccgtgtag

SEQ ID NO: 89522 - DNA, 1536 bp, Artificial Sequence
  Description of Artificial Sequence: Synthetic coding sequence
atgaaggccatcatccacctgaccctgctggccctgctgagcgtgaacaccgccaccaaccagggcaacagcgccgacgccgtgaccaccaccgagaccgccaccagcggccccaccgtggccgccgccgacaccaccgagaccaacttccccgagaccgccagcaccaccgccaacacccccttccccaccgccaccagccccgccccccccatcatcagcacccacagcagcagcaccatccccacccccgccccccccatcatcagcacccacagcagcagcaccatccccatccccaccgccgccgacagcgagagcaccaccaacgtgaacagcctggccaccagcgacatcatcaccgccagcagccccaacgacggcctgatcaccatggtgcccagcgagacccagagcaacaacgagatgagccccaccaccgaggacaaccagagcagcggcccccccaccggcaccgccctgctggagaccagcaccctgaacagcaccggccccagcaacccctgccaggacgacccctgcgccgacaacagcctgtgcgtgaagctgcacaacaccagcttctgcctgtgcctggagggctactactacaacagcagcacctgcaagaagggcaaggtgttccccggcaagatcagcgtgaccgtgagcgagaccttcgaccccgaggagaagcacagcatggcctaccaggacctgcacagcgagatcaccagcctgttcaaggacgtgttcggcaccagcgtgtacggccagaccgtgatcctgaccgtgagcaccagcctgagccccagaagcgagatgagagccgacgacaagttcgtgaacgtgaccatcgtgaccatcctggccgagaccaccagcgacaacgagaagaccgtgaccgagaagatcaacaaggccatcagaagcagcagcagcaacttcctgaactacgacctgaccctgagatgcgactactacggctgcaaccagaccgccgacgactgcctgaacggcctggcctgcgactgcaagagcgacctgcagagacccaacccccagagccccttctgcgtggccagcagcctgaagtgccccgacgcctgcaacgcccagcacaagcagtgcctgatcaagaagagcggcggcgcccccgagtgcgcctgcgtgcccggctaccaggaggacgccaacggcaactgccagaagtgcgccttcggctacagcggcctggactgcaaggacaagttccagctgatcctgaccatcgtgggcaccatcgccggcatcgtgatcctgagcatgatcatcgccctgatcgtgaccgccagaagcaacaacaagaccaagcacatcgaggaggagaacctgatcgacgaggacttccagaacctgaagctgagaagcaccggcttcaccaacctgggcgccgagggcagcgtgttccccaaggtgagaatcaccgccagcagagacagccagatgcagaacccctacagcagacacagcagcatgcccagacccgactactag

SEQ ID NO: 89523 - DNA, 13482 bp, Artificial Sequence
  Description of Artificial Sequence: Synthetic coding sequence
atgcccagacccggcaccatggccctgtgcctgctgaccctggtgctgagcctgctgcccccccaggccgccgccgagcaggacctgagcgtgaacagagccgtgtgggacggcggcggctgcatcagccagggcgacgtgctgaacagacagtgccagcagctgagccagcacgtgagaaccggcagcgccgccaacaccgccaccggcaccaccagcaccaacgtggtggagcccagaatgtacctgagctgcagcaccaaccccgagatgaccagcatcgagagcagcgtgaccagcgacacccccggcgtgagcagcaccagaatgacccccaccgagagcagaaccaccagcgagagcaccagcgacagcaccaccctgttccccagcagcaccgaggacaccagcagccccaccacccccgagggcaccgacgtgcccatgagcacccccagcgaggagagcatcagcagcaccatggccttcgtgagcaccgcccccctgcccagcttcgaggcctacaccagcctgacctacaaggtggacatgagcacccccctgaccaccagcacccaggccagcagcagccccaccacccccgagagcaccaccatccccaagagcaccaacagcgagggcagcacccccctgaccagcatgcccgccagcaccatgaaggtggccagcagcgaggccatcaccctgctgaccacccccgtggagatcagcacccccgtgaccatcagcgcccaggccagcagcagccccaccaccgccgagggccccagcctgagcaacagcgcccccagcggcggcagcacccccctgaccagaatgcccctgagcgtgatgctggtggtgagcagcgaggccagcaccctgagcaccacccccgccgccaccaacatccccgtgatcaccagcaccgaggccagcagcagccccaccaccgccgagggcaccagcatccccaccagcacctacaccgagggcagcacccccctgaccagcacccccgccagcaccatgcccgtggccaccagcgagatgagcaccctgagcatcacccccgtggacaccagcaccctggtgaccaccagcaccgagcccagcagcctgcccaccaccgccgaggccaccagcatgctgaccagcaccctgagcgagggcagcacccccctgaccaacatgcccgtgagcaccatcctggtggccagcagcgaggccagcaccaccagcaccatccccgtggacagcaagaccttcgtgaccaccgccagcgaggccagcagcagccccaccaccgccgaggacaccagcatcgccaccagcacccccagcgagggcagcacccccctgaccagcatgcccgtgagcaccacccccgtggccagcagcgaggccagcaacctgagcaccacccccgtggacagcaagacccaggtgaccaccagcaccgaggccagcagcagcccccccaccgccgaggtgaacagcatgcccaccagcacccccagcgagggcagcacccccctgaccagcatgagcgtgagcaccatgcccgtggccagcagcgaggccagcaccctgagcaccacccccgtggacaccagcacccccgtgaccaccagcagcgaggccagcagcagcagcaccacccccgagggcaccagcatccccaccagcacccccagcgagggcagcacccccctgaccaacatgcccgtgagcaccagactggtggtgagcagcgaggccagcaccaccagcaccacccccgccgacagcaacaccttcgtgaccaccagcagcgaggccagcagcagcagcaccaccgccgagggcaccagcatgcccaccagcacctacagcgagagaggcaccaccatcaccagcatgagcgtgagcaccaccctggtggccagcagcgaggccagcaccctgagcaccacccccgtggacagcaacacccccgtgaccaccagcaccgaggccaccagcagcagcaccaccgccgagggcaccagcatgcccaccagcacctacaccgagggcagcacccccctgaccagcatgcccgtgaacaccaccctggtggccagcagcgaggccagcaccctgagcaccacccccgtggacaccagcacccccgtgaccaccagcaccgaggccagcagcagccccaccaccgccgacggcgccagcatgcccaccagcacccccagcgagggcagcacccccctgaccagcatgcccgtgagcaagaccctgctgaccagcagcgaggccagcaccctgagcaccacccccctggacaccagcacccacatcaccaccagcaccgaggccagctgcagccccaccaccaccgagggcaccagcatgcccatcagcacccccagcgagggcagccccctgctgaccagcatccccgtgagcatcacccccgtgaccagccccgaggccagcaccctgagcaccacccccgtggacagcaacagccccgtgaccaccagcaccgaggtgagcagcagccccacccccgccgagggcaccagcatgcccaccagcacctacagcgagggcagaacccccctgaccagcatgcccgtgagcaccaccctggtggccaccagcgccatcagcaccctgagcaccacccccgtggacaccagcacccccgtgaccaacagcaccgaggccagaagcagccccaccaccagcgagggcaccagcatgcccaccagcacccccggcgagggcagcacccccctgaccagcatgcccgacagcaccacccccgtggtgagcagcgaggccagaaccctgagcgccacccccgtggacaccagcacccccgtgaccaccagcaccgaggccaccagcagccccaccaccgccgagggcaccagcatccccaccagcacccccagcgagggcaccacccccctgaccagcacccccgtgagccacaccctggtggccaacagcgaggccagcaccctgagcaccacccccgtggacagcaacacccccctgaccaccagcaccgaggccagcagccccccccccaccgccgagggcaccagcatgcccaccagcacccccagcgagggcagcacccccctgaccagaatgcccgtgagcaccaccatggtggccagcagcgagaccagcaccctgagcaccacccccgccgacaccagcacccccgtgaccacctacagccaggccagcagcagcagcaccaccgccgacggcaccagcatgcccaccagcacctacagcgagggcagcacccccctgaccagcgtgcccgtgagcaccagactggtggtgagcagcgaggccagcaccctgagcaccacccccgtggacaccagcatccccgtgaccaccagcaccgaggccagcagcagccccaccaccgccgagggcaccagcatccccaccagcccccccagcgagggcaccacccccctggccagcatgcccgtgagcaccaccctggtggtgagcagcgaggccaacaccctgagcaccacccccgtggacagcaagacccaggtggccaccagcaccgaggccagcagccccccccccaccgccgaggtgaccagcatgcccaccagcacccccggcgagagaagcacccccctgaccagcatgcccgtgagacacacccccgtggccagcagcgaggccagcaccctgagcaccagccccgtggacaccagcacccccgtgaccaccagcgccgagaccagcagcagccccaccaccgccgagggcaccagcctgcccaccagcaccaccagcgagggcagcaccctgctgaccagcatccccgtgagcaccaccctggtgaccagccccgaggccagcaccctgctgaccacccccgtggacaccaagggccccgtggtgaccagcaacgaggtgagcagcagccccacccccgccgagggcaccagcatgcccaccagcacctacagcgagggcagaacccccctgaccagcatccccgtgaacaccaccctggtggccagcagcgccatcagcatcctgagcaccacccccgtggacaacagcacccccgtgaccaccagcaccgaggcctgcagcagccccaccaccagcgagggcaccagcatgcccaacagcaaccccagcgagggcaccacccccctgaccagcatccccgtgagcaccacccccgtggtgagcagcgaggccagcaccctgagcgccacccccgtggacaccagcacccccggcaccaccagcgccgaggccaccagcagccccaccaccgccgagggcatcagcatccccaccagcacccccagcgagggcaagacccccctgaagagcatccccgtgagcaacacccccgtggccaacagcgaggccagcaccctgagcaccacccccgtggacagcaacagccccgtggtgaccagcaccgccgtgagcagcagccccacccccgccgagggcaccagcatcgccatcagcacccccagcgagggcagcaccgccctgaccagcatccccgtgagcaccaccaccgtggccagcagcgagatcaacagcctgagcaccacccccgccgtgaccagcacccccgtgaccacctacagccaggccagcagcagccccaccaccgccgacggcaccagcatgcagaccagcacctacagcgagggcagcacccccctgaccagcctgcccgtgagcaccatgctggtggtgagcagcgaggccaacaccctgagcaccacccccatcgacagcaagacccaggtgaccgccagcaccgaggccagcagcagcaccaccgccgagggcagcagcatgaccatcagcacccccagcgagggcagccccctgctgaccagcatccccgtgagcaccacccccgtggccagccccgaggccagcaccctgagcaccacccccgtggacagcaacagccccgtgatcaccagcaccgaggtgagcagcagccccacccccgccgagggcaccagcatgcccaccagcacctacaccgagggcagaacccccctgaccagcatcaccgtgagaaccacccccgtggccagcagcgccatcagcaccctgagcaccacccccgtggacaacagcacccccgtgaccaccagcaccgaggccagaagcagccccaccaccagcgagggcaccagcatgcccaacagcacccccagcgagggcaccacccccctgaccagcatccccgtgagcaccacccccgtgctgagcagcgaggccagcaccctgagcgccacccccatcgacaccagcacccccgtgaccaccagcaccgaggccaccagcagccccaccaccgccgagggcaccagcatccccaccagcaccctgagcgagggcatgacccccctgaccagcacccccgtgagccacaccctggtggccaacagcgaggccagcaccctgagcaccacccccgtggacagcaacagccccgtggtgaccagcaccgccgtgagcagcagccccacccccgccgagggcaccagcatcgccaccagcacccccagcgagggcagcaccgccctgaccagcatccccgtgagcaccaccaccgtggccagcagcgagaccaacaccctgagcaccacccccgccgtgaccagcacccccgtgaccacctacgcccaggtgagcagcagccccaccaccgccgacggcagcagcatgcccaccagcacccccagagagggcagaccccccctgaccagcatccccgtgagcaccaccaccgtggccagcagcgagatcaacaccctgagcaccaccctggccgacaccagaacccccgtgaccacctacagccaggccagcagcagccccaccaccgccgacggcaccagcatgcccacccccgcctacagcgagggcagcacccccctgaccagcatgcccctgagcaccaccctggtggtgagcagcgaggccagcaccctgagcaccacccccgtggacaccagcacccccgccaccaccagcaccgagggcagcagcagccccaccaccgccggcggcaccagcatccagaccagcacccccagcgagagaaccacccccctggccggcatgcccgtgagcaccaccctggtggtgagcagcgagggcaacaccctgagcaccacccccgtggacagcaagacccaggtgaccaacagcaccgaggccagcagcagcgccaccgccgagggcagcagcatgaccatcagcgcccccagcgagggcagccccctgctgaccagcatccccctgagcaccacccccgtggccagccccgaggccagcaccctgagcaccacccccgtggacagcaacagccccgtgatcaccagcaccgaggtgagcagcagccccatccccaccgagggcaccagcatgcagaccagcacctacagcgacagaagaacccccctgaccagcatgcccgtgagcaccaccgtggtggccagcagcgccatcagcaccctgagcaccacccccgtggacaccagcacccccgtgaccaacagcaccgaggccagaagcagccccaccaccagcgagggcaccagcatgcccaccagcacccccagcgagggcagcacccccttcaccagcatgcccgtgagcaccatgcccgtggtgaccagcgaggccagcaccctgagcgccacccccgtggacaccagcacccccgtgaccaccagcaccgaggccaccagcagccccaccaccgccgagggcaccagcatccccaccagcaccctgagcgagggcaccacccccctgaccagcatccccgtgagccacaccctggtggccaacagcgaggtgagcaccctgagcaccacccccgtggacagcaacacccccttcaccaccagcaccgaggccagcagccccccccccaccgccgagggcaccagcatgcccaccagcaccagcagcgagggcaacacccccctgaccagaatgcccgtgagcaccaccatggtggccagcttcgagaccagcaccctgagcaccacccccgccgacaccagcacccccgtgaccacctacagccaggccggcagcagccccaccaccgccgacgacaccagcatgcccaccagcacctacagcgagggcagcacccccctgaccagcgtgcccgtgagcaccatgcccgtggtgagcagcgaggccagcacccacagcaccacccccgtggacaccagcacccccgtgaccaccagcaccgaggccagcagcagccccaccaccgccgagggcaccagcatccccaccagcccccccagcgagggcaccacccccctggccagcatgcccgtgagcaccacccccgtggtgagcagcgaggccggcaccctgagcaccacccccgtggacaccagcacccccatgaccaccagcaccgaggccagcagcagccccaccaccgccgaggacatcgtggtgcccatcagcaccgccagcgagggcagcaccctgctgaccagcatccccgtgagcaccacccccgtggccagccccgaggccagcaccctgagcaccacccccgtggacagcaacagccccgtggtgaccagcaccgagatcagcagcagcgccaccagcgccgagggcaccagcatgcccaccagcacctacagcgagggcagcacccccctgagaagcatgcccgtgagcaccaagcccctggccagcagcgaggccagcaccctgagcaccacccccgtggacaccagcatccccgtgaccaccagcaccgagaccagcagcagccccaccaccgccaaggacaccagcatgcccatcagcacccccagcgaggtgagcaccagcctgaccagcatcctggtgagcaccatgcccgtggccagcagcgaggccagcaccctgagcaccacccccgtggacaccagaaccctggtgaccaccagcaccggcaccagcagcagccccaccaccgccgagggcagcagcatgcccaccagcacccccggcgagagaagcacccccctgaccaacatcctggtgagcaccaccctgctggccaacagcgaggccagcaccctgagcaccacccccgtggacaccagcacccccgtgaccaccagcgccgaggccagcagcagccccaccaccgccgagggcaccagcatgagaatcagcacccccagcgacggcagcacccccctgaccagcatcctggtgagcaccctgcccgtggccagcagcgaggccagcaccgtgagcaccaccgccgtggacaccagcatccccgtgaccaccagcaccgaggccagcagcagccccaccaccgccgaggtgaccagcatgcccaccagcacccccagcgagaccagcacccccctgaccagcatgcccgtgaaccacacccccgtggccagcagcgaggccggcaccctgagcaccacccccgtggacaccagcacccccgtgaccaccagcaccaaggccagcagcagccccaccaccgccgagggcatcgtggtgcccatcagcaccgccagcgagggcagcaccctgctgaccagcatccccgtgagcaccacccccgtggccagcagcgaggccagcaccctgagcaccacccccgtggacaccagcatccccgtgaccaccagcaccgagggcagcagcagccccaccaccgccgagggcaccagcatgcccatcagcacccccagcgaggtgagcacccccctgaccagcatcctggtgagcaccgtgcccgtggccggcagcgaggccagcaccctgagcaccacccccgtggacaccagaacccccgtgaccaccagcgccgaggccagcagcagccccaccaccgccgagggcaccagcatgcccatcagcacccccggcgagagaagaacccccctgaccagcatgagcgtgagcaccatgcccgtggccagcagcgaggccagcaccctgagcagaacccccgccgacaccagcacccccgtgaccaccagcaccgaggccagcagcagccccaccaccgccgagggcaccggcatccccatcagcacccccagcgagggcagcacccccctgaccagcatccccgtgagcaccacccccgtggccatccccgaggccagcaccctgagcaccacccccgtggacagcaacagccccgtggtgaccagcaccgaggtgagcagcagccccacccccgccgagggcaccagcatgcccatcagcacctacagcgagggcagcacccccctgaccggcgtgcccgtgagcaccacccccgtgaccagcagcgccatcagcaccctgagcaccacccccgtggacaccagcacccccgtgaccaccagcaccgaggcccacagcagccccaccaccagcgagggcaccagcatgcccaccagcacccccagcgagggcagcacccccctgacctacatgcccgtgagcaccatgctggtggtgagcagcgaggacagcaccctgagcgccacccccgtggacaccagcacccccgtgaccaccagcaccgaggccaccagcagcaccaccgccgagggcaccagcatccccaccagcacccccagcgagggcatgacccccctgaccagcgtgcccgtgagcaacacccccgtggccagcagcgaggccagcatcctgagcaccacccccgtggacagcaacacccccctgaccaccagcaccgaggccagcagcagcccccccaccgccgagggcaccagcatgcccaccagcacccccagcgagggcagcacccccctgaccagcatgcccgtgagcaccaccaccgtggccagcagcgagaccagcaccctgagcaccacccccgccgacaccagcacccccgtgaccacctacagccaggccagcagcagcccccccatcgccgacggcaccagcatgcccaccagcacctacagcgagggcagcacccccctgaccaacatgagcttcagcaccacccccgtggtgagcagcgaggccagcaccctgagcaccacccccgtggacaccagcacccccgtgaccaccagcaccgaggccagcctgagccccaccaccgccgagggcaccagcatccccaccagcagccccagcgagggcaccacccccctggccagcatgcccgtgagcaccacccccgtggtgagcagcgaggtgaacaccctgagcaccacccccgtggacagcaacaccctggtgaccaccagcaccgaggccagcagcagccccaccatcgccgagggcaccagcctgcccaccagcaccaccagcgagggcagcacccccctgagcatcatgcccctgagcaccacccccgtggccagcagcgaggccagcaccctgagcaccacccccgtggacaccagcacccccgtgaccaccagcagccccaccaacagcagccccaccaccgccgaggtgaccagcatgcccaccagcaccgccggcgagggcagcacccccctgaccaacatgcccgtgagcaccacccccgtggccagcagcgaggccagcaccctgagcaccacccccgtggacagcaacaccttcgtgaccagcagcagccaggccagcagcagccccgccaccctgcaggtgaccaccatgagaatgagcacccccagcgagggcagcagcagcctgaccaccatgctgctgagcagcacctacgtgaccagcagcgaggccagcacccccagcacccccagcgtggacagaagcacccccgtgaccaccagcacccagagcaacagcacccccaccccccccgaggtgatcaccctgcccatgagcacccccagcgaggtgagcacccccctgaccatcatgcccgtgagcaccaccagcgtgaccatcagcgaggccggcaccgccagcaccctgcccgtggacaccagcacccccgtgatcaccagcacccaggtgagcagcagccccgtgacccccgagggcaccaccatgcccatctggacccccagcgagggcagcacccccctgaccaccatgcccgtgagcaccaccagagtgaccagcagcgagggcagcaccctgagcacccccagcgtggtgaccagcacccccgtgaccaccagcaccgaggccatcagcagcagcgccaccctggacagcaccaccatgagcgtgagcatgcccatggagatcagcaccctgggcaccaccatcctggtgagcaccacccccgtgaccagattccccgagagcagcacccccagcatccccagcgtgtacaccagcatgagcatgaccaccgccagcgagggcagcagcagccccaccaccctggagggcaccaccaccatgcccatgagcaccaccagcgagagaagcaccctgctgaccaccgtgctgatcagccccatcagcgtgatgagccccagcgaggccagcaccctgagcaccccccccggcgacaccagcacccccctgctgaccagcaccaaggccggcagcttcagcatccccgccgaggtgaccaccatcagaatcagcatcaccagcgagagaagcacccccctgaccaccctgctggtgagcaccaccctgcccaccagcttccccggcgccagcatcgccagcaccccccccctggacaccagcaccaccttcacccccagcaccgacaccgccagcacccccaccatccccgtggccaccaccatcagcgtgagcgtgatcaccgagggcagcacccccggcaccaccatcttcatccccagcacccccgtgaccagcagcaccgccgacgtgttccccgccaccaccggcgccgtgagcacccccgtgatcaccagcaccgagctgaacacccccagcaccagcagcagcagcaccaccaccagcttcagcaccaccaaggagttcaccacccccgccatgaccaccgccgcccccctgacctacgtgaccatgagcaccgcccccagcacccccagaaccaccagcagaggctgcaccaccagcgccagcaccctgagcgccaccagcaccccccacaccagcaccagcgtgaccaccagacccgtgacccccagcagcgagagcagcagacccagcaccatcaccagccacaccatcccccccaccttcccccccgcccacagcagcaccccccccaccaccagcgccagcagcaccaccgtgaaccccgaggccgtgaccaccatgaccaccagaaccaagcccagcaccagaaccaccagcttccccaccgtgaccaccaccgccgtgcccaccaacaccaccatcaagagcaaccccaccagcacccccaccgtgcccagaaccaccacctgcttcggcgacggctgccagaacaccgccagcagatgcaagaacggcggcacctgggacggcctgaagtgccagtgccccaacctgtactacggcgagctgtgcgaggaggtggtgagcagcatcgacatcggcccccccgagaccatcagcgcccagatggagctgaccgtgaccgtgaccagcgtgaagttcaccgaggagctgaagaaccacagcagccaggagttccaggagttcaagcagaccttcaccgagcagatgaacatcgtgtacagcggcatccccgagtacgtgggcgtgaacatcaccaagctgagactgggcagcgtggtggtggagcacgacgtgctgctgagaaccaagtacacccccgagtacaagaccgtgctggacaacgccaccgaggtggtgaaggagaagatcaccaaggtgaccacccagcagatcatgatcaacgacatctgcagcgacatgatgtgcttcaacaccaccggcacccaggtgcagaacatcaccgtgacccagtacgaccccgaggaggactgcagaaagatggccaaggagtacggcgactacttcgtggtggagtacagagaccagaagccctactgcatcagcccctgcgagcccggcttcagcgtgagcaagaactgcaacctgggcaagtgccagatgagcctgagcggcccccagtgcctgtgcgtgaccaccgagacccactggtacagcggcgagacctgcaaccagggcacccagaagagcctggtgtacggcctggtgggcgccggcgtggtgctgatgctgatcatcctggtggccctgctgatgctggtgttcagaagcaagagagaggtgaagagacagaagtacagactgagccagctgtacaagtggcaggaggaggacagcggccccgcccccggcaccttccagaacatcggcttcgacatctgccaggacgacgacagcatccacctggagagcatctacagcaacttccagcccagcctgagacacatcgaccccgagaccaagatcagaatccagagaccccaggtgatgaccaccagcttctag

SEQ ID NO: 89524 - DNA, 843 bp, Artificial Sequence
  Description of Artificial Sequence: Synthetic coding sequence
atgaccaccgccctgggcagccagctgagcagcagccagaccgtgatccccggcagcagcggcaccatcagccacaccaccgtggcccccggcagcagcgtgaccggcaccaccaccggcgccagcgacgaccaggtgaccggcagcaagaccggcaccaccggcgtggccctgagcaccaccgtggcccccggcagcagcagcaccgaggccaccaccagcaccggcgtgcacagaaccaccgtggtgggccagaagaccggcgccaccaccagaggcagcgccaagcagggcaccagaagcaccatcgaggccaccaccagcttcagaggcaccggcaccaccggcagcggcatgaacaccggcaccaccggcgtggtgagcggcaacaccatcagccccagcagcttcaacaccgaggccaccagcggcaccagcgagagacccaaccccggcagcgagatcggcaccaccggcatcgtgagcggcaccaccgtggcccccggcagcagcaacaccgaggccaccaccagcctgggcaacggcggcaccaccgaggccggcagcaagatcgtgaccaccggcatcaccaccggcaccaccatcgtgcccggcagcttcaacaccaaggccaccaccagcaccgacgtgggcgtggccaccggcgtgggcatggccaccggcatcaccaacatcatcagcggcagaagccagcccaccggcagcaagaccggctacaccgtgaccggcagcggcaccaccgccctgcccggcggcttcagaaccgacagccccagcttccccctgttcctgatctgcagctacagaggccacaacttctag

SEQ ID NO: 89525 - DNA, 837 bp, Artificial Sequence
  Description of Artificial Sequence: Synthetic coding sequence
cccaccggcacccagacccccacccccacccccatcagcaccaccaccaccgtgacccccacccccacccccaccggcacccagacccccaccaccacccccatcaccaccaccaccaccgtgacccccacccccacccccaccggcacccagacccccaccaccgtgctgatcaccaccaccaccaccatgacccccacccccacccccaccagcaccaagagcaccaccgtgacccccatcaccaccaccaccaccgtgaccgccacccccacccccaccggcacccagacccccaccatgatccccatcagcaccaccaccaccgtgacccccacccccacccccaccaccggcagcaccggcccccccacccacaccagcaccgcccccatcgccgagctgaccaccagcaaccccccccccgagagcagcaccccccagaccagcagaagcaccagcagccccctgaccgagagcaccaccctgctgagcaccctgccccccgccatcgagatgaccagcaccgccccccccagcacccccaccgcccccaccaccaccagcggcggccacaccctgagccccccccccagcaccaccaccagcccccccggcacccccaccagaggcaccaccaccggcagcagcagcgcccccacccccagcaccgtgcagaccaccaccaccagcgcctggacccccacccccacccccctgagcacccccagcatcatcagaaccaccggcctgagaccctaccccagcagcgtgctgatctgctgcgtgctgaacgacacctactacgcccccggcgaggaggtgtacaacggctag

SEQ ID NO: 89526 - DNA, 5343 bp, Artificial Sequence
  Description of Artificial Sequence: Synthetic coding sequence
atgggcctgcccctggccagactggccgccgtgtgcctggccctgagcctggccggcggcagcgagctgcagaccgagggcagaaccagaaaccacggccacaacgtgtgcagcacctggggcaacttccactacaagaccttcgacggcgacgtgttcagattccccggcctgtgcgactacaacttcgccagcgactgcagaggcagctacaaggagttcgccgtgcacctgaagagaggccccggccaggccgaggcccccgccggcgtggagagcatcctgctgaccatcaaggacgacaccatctacctgaccagacacctggccgtgctgaacggcgccgtggtgagcaccccccactacagccccggcctgctgatcgagaagagcgacgcctacaccaaggtgtacagcagagccggcctgaccctgatgtggaacagagaggacgccctgatgctggagctggacaccaagttcagaaaccacacctgcggcctgtgcggcgactacaacggcctgcagagctacagcgagttcctgagcgacggcgtgctgttcagccccctggagttcggcaacatgcagaagatcaaccagcccgacgtggtgtgcgaggaccccgaggaggaggtggcccccgccagctgcagcgagcacagagccgagtgcgagagactgctgaccgccgaggccttcgccgactgccaggacctggtgcccctggagccctacctgagagcctgccagcaggacagatgcagatgccccggcggcgacacctgcgtgtgcagcaccgtggccgagttcagcagacagtgcagccacgccggcggcagacccggcaactggagaaccgccaccctgtgccccaagacctgccccggcaacctggtgtacctggagagcggcagcccctgcatggacacctgcagccacctggaggtgagcagcctgtgcgaggagcacagaatggacggctgcttctgccccgagggcaccgtgtacgacgacatcggcgacagcggctgcgtgcccgtgagccagtgccactgcagactgcacggccacctgtacacccccggccaggagatcaccaacgactgcgagcagtgcgtgtgcaacgccggcagatgggtgtgcaaggacctgccctgccccggcacctgcgccctggagggcggcagccacatcaccaccttcgacggcaagacctacaccttccacggcgactgctactacgtgctggccaagggcgaccacaacgacagctacgccctgctgggcgagctggccccctgcggcagcaccgacaagcagacctgcctgaagaccgtggtgctgctggccgacaagaagaagaacgtggtggtgttcaagagcgacggcagcgtgctgctgaacgagctgcaggtgaacctgccccacgtgaccgccagcttcagcgtgttcagacccagcagctaccacatcatggtgagcatggccatcggcgtgagactgcaggtgcagctggcccccgtgatgcagctgttcgtgaccctggaccaggccagccagggccaggtgcagggcctgtgcggcaacttcaacggcctggagggcgacgacttcaagaccgccagcggcctggtggaggccaccggcgccggcttcgccaacacctggaaggcccagagcagctgccacgacaagctggactggctggacgacccctgcagcctgaacatcgagagcgccaactacgccgagcactggtgcagcctgctgaagaagaccgagacccccttcggcagatgccacagcgccgtggaccccgccgagtactacaagagatgcaagtacgacacctgcaactgccagaacaacgaggactgcctgtgcgccgccctgagcagctacgccagagcctgcaccgccaagggcgtgatgctgtggggctggagagagcacgtgtgcaacaaggacgtgggcagctgccccaacagccaggtgttcctgtacaacctgaccacctgccagcagacctgcagaagcctgagcgaggccgacagccactgcctggagggcttcgcccccgtggacggctgcggctgccccgaccacaccttcctggacgagaagggcagatgcgtgcccctggccaagtgcagctgctaccacagaggcctgtacctggaggccggcgacgtggtggtgagacaggaggagagatgcgtgtgcagagacggcagactgcactgcagacagatcagactgatcggccagagctgcaccgcccccaagatccacatggactgcagcaacctgaccgccctggccaccagcaagcccagagccctgagctgccagaccctggccgccggctactaccacaccgagtgcgtgagcggctgcgtgtgccccgacggcctgatggacgacggcagaggcggctgcgtggtggagaaggagtgcccctgcgtgcacaacaacgacctgtacagcagcggcgccaagatcaaggtggactgcaacacctgcacctgcaagagaggcagatgggtgtgcacccaggccgtgtgccacggcacctgcagcatctacggcagcggccactacatcaccttcgacggcaagtactacgacttcgacggccactgcagctacgtggccgtgcaggactactgcggccagaacagcagcctgggcagcttcagcatcatcaccgagaacgtgccctgcggcaccaccggcgtgacctgcagcaaggccatcaagatcttcatgggcagaaccgagctgaagctggaggacaagcacagagtggtgatccagagagacgagggccaccacgtggcctacaccaccagagaggtgggccagtacctggtggtggagagcagcaccggcatcatcgtgatctgggacaagagaaccaccgtgttcatcaagctggcccccagctacaagggcaccgtgtgcggcctgtgcggcaacttcgaccacagaagcaacaacgacttcaccaccagagaccacatggtggtgagcagcgagctggacttcggcaacagctggaaggaggcccccacctgccccgacgtgagcaccaaccccgagccctgcagcctgaacccccacagaagaagctgggccgagaagcagtgcagcatcctgaagagcagcgtgttcagcatctgccacagcaaggtggaccccaagcccttctacgaggcctgcgtgcacgacagctgcagctgcgacaccggcggcgactgcgagtgcttctgcagcgccgtggccagctacgcccaggagtgcaccaaggagggcgcctgcgtgttctggagaacccccgacctgtgccccatcttctgcgactactacaaccccccccacgagtgcgagtggcactacgagccctgcggcaacagaagcttcgagacctgcagaaccatcaacggcatccacagcaacatcagcgtgagctacctggagggctgctaccccagatgccccaaggacagacccatctacgaggaggacctgaagaagtgcgtgaccgccgacaagtgcggctgctacgtggaggacacccactacccccccggcgccagcgtgcccaccgaggagacctgcaagagctggtgcacctgcacccagacccacaccgcctaccacgtgcacacccacggcaagatcctgaaccagacccaggacggcgccttctgctactgggagatctgcggccccaacggcaccgtggagaagcacttcaacatctgcagcatcaccaccagacccagcaccctgaccaccttcaccaccatcaccctgcccaccacccccaccaccttcaccaccaccaccaccaccaccacccccaccagcagcaccgtgctgagcaccacccccaagctgtgctgcctgtggagcgactggatcaacgaggaccaccccagcagcggcagcgacgacggcgacagagagaccttcgacggcgtgtgcggcgcccccgaggacatcgagtgcagaagcgtgaaggacccccacctgagcctggagcagctgggccagaaggtgcagtgcgacgtgagcgtgggcttcatctgcaagaacgaggaccagttcggcaacggccccttcggcctgtgctacgactacaagatcagagtgaactgctgctggcccatggacaagtgcatcaccacccccagcccccccaccaccacccccagccccccccccaccagcaccaccaccctgccccccaccaccacccccagcccccccaccaccaccaccaccacccccccccccaccaccacccccagcccccccatcaccaccaccaccacccccccccccaccaccacccccagcccccccatcagcaccaccaccacccccccccccaccaccacccccagcccccccaccaccacccccagcccccccaccaccacccccagcccccccaccaccaccaccaccacccccccccccaccaccacccccagcccccccaccaccacccccatcaccccccccgccagcaccaccaccctgccccccaccaccacccccagcccccccaccaccaccaccaccacccccccccccaccaccacccccatcaccaccaccaccaccgtgacccccacccccacccccaccggcacccagacccccaccaccacccccatcaccaccaccaccaccgtgacccccacccccacccccaccggcacccagacccccaccagcacccccatcaccaccaccaccaccacccccacccccaccgccatcaccaccaccaccaccgtgacccccacccccacccccaccggcacccagacccccaccaccacccccatcaccaccaccaccaccgtgacccccacccccacccccaccggcacccagagccccacccccaccgccatcaccaccaccaccaccgtgacccccacccccacccccaccggcacccagacccccaccagcacccccatcaccaccaccaccaccgtgacccccacccccacccccaccggcacccagacccccacccccacccccatcagcaccaccaccaccgtgacccccacccccacccccaccggcacccagacccccaccaccacccccatcaccaccaccaccaccgtgacccccacccccacccccaccggcacccagacccccaccaccacccccacccccaccagcaccaagagcaccaccgtgacccccatcaccaccaccaccaccgtgaccgccacccccacccccaccggcacccagacccccaccatgatccccatcagcaccaccaccaccgtgaccccctag

SEQ ID NO: 89527 - DNA, 1230 bp, Artificial Sequence
  Description of Artificial Sequence: Synthetic coding sequence
gacatcgagtgcagaagcgtgaaggacccccacctgagcctggagcagctgggccagaaggtgcagtgcgacgtgagcgtgggcttcatctgcaagaacgaggaccagttcggcaacggccccttcggcctgtgctacgactacaagatcagagtgaactgctgctgcacccccaccagaggcaccaccaccggcagcagcagcgcccccacccccagcaccgtgcagaccaccaccaccagcgcctggacccccacccccacccccctgagcacccccagcatcatcagaaccaccggcctgagaccctaccccagcagcgtgctgatctgctgcgtgctgaacgacacctactacgcccccggcgaggaggtgtacaacggcacctacggcgacacctgctacttcgtgaactgcagcctgagctgcaccctggagttctacaactggagctgccccagcacccccagccccacccccacccccagcaagagcacccccacccccagcaagcccagcagcacccccagcaagcccacccccggcaccaagccccccgagtgccccgacttcgacccccccagacaggagaacgagacctggtggctgtgcgactgcttcatggccacctgcaagtacaacaacaccgtggagatcgtgaaggtggagtgcgagcccccccccatgcccacctgcagcaacggcctgcagcccgtgagagtggaggaccccgacggctgctgctggcactgggagtgcgactgctactgcaccggctggggcgacccccactacgtgaccttcgacggcctgtactacagctaccagggcaactgcacctacgtgctggtggaggagatcagccccagcgtggacaacttcggcgtgtacatcgacaactaccactgcgaccccaacgacaaggtgagctgccccagaaccctgatcgtgagacacgagacccaggaggtgctgatcaagaccgtgcacatgatgcccatgcaggtgcaggtgcaggtgaacagacaggccgtggccctgccctacaagaagtacggcctggaggtgtaccagagcggcatcaactacgtggtggacatccccgagctgggcgtgctggtgagctacaacggcctgagcttcagcgtgagactgccctaccacagattcggcaacaacaccaagggccagtgcggcacctgcaccaacaccaccagcgacgactgctag

SEQ ID NO: 89528 - DNA, 8454 bp, Artificial Sequence
  Description of Artificial Sequence: Synthetic coding sequence
atgggcctgcccctggccagactggccgccgtgtgcctggccctgagcctggccggcggcagcgagctgcagaccgagggcagaaccagaaaccacggccacaacgtgtgcagcacctggggcaacttccactacaagaccttcgacggcgacgtgttcagattccccggcctgtgcgactacaacttcgccagcgactgcagaggcagctacaaggagttcgccgtgcacctgaagagaggccccggccaggccgaggcccccgccggcgtggagagcatcctgctgaccatcaaggacgacaccatctacctgaccagacacctggccgtgctgaacggcgccgtggtgagcaccccccactacagccccggcctgctgatcgagaagagcgacgcctacaccaaggtgtacagcagagccggcctgaccctgatgtggaacagagaggacgccctgatgctggagctggacaccaagttcagaaaccacacctgcggcctgtgcggcgactacaacggcctgcagagctacagcgagttcctgagcgacggcgtgctgttcagccccctggagttcggcaacatgcagaagatcaaccagcccgacgtggtgtgcgaggaccccgaggaggaggtggcccccgccagctgcagcgagcacagagccgagtgcgagagactgctgaccgccgaggccttcgccgactgccaggacctggtgcccctggagccctacctgagagcctgccagcaggacagatgcagatgccccggcggcgacacctgcgtgtgcagcaccgtggccgagttcagcagacagtgcagccacgccggcggcagacccggcaactggagaaccgccaccctgtgccccaagacctgccccggcaacctggtgtacctggagagcggcagcccctgcatggacacctgcagccacctggaggtgagcagcctgtgcgaggagcacagaatggacggctgcttctgccccgagggcaccgtgtacgacgacatcggcgacagcggctgcgtgcccgtgagccagtgccactgcagactgcacggccacctgtacacccccggccaggagatcaccaacgactgcgagcagtgcgtgtgcaacgccggcagatgggtgtgcaaggacctgccctgccccggcacctgcgccctggagggcggcagccacatcaccaccttcgacggcaagacctacaccttccacggcgactgctactacgtgctggccaagggcgaccacaacgacagctacgccctgctgggcgagctggccccctgcggcagcaccgacaagcagacctgcctgaagaccgtggtgctgctggccgacaagaagaagaacgtggtggtgttcaagagcgacggcagcgtgctgctgaacgagctgcaggtgaacctgccccacgtgaccgccagcttcagcgtgttcagacccagcagctaccacatcatggtgagcatggccatcggcgtgagactgcaggtgcagctggcccccgtgatgcagctgttcgtgaccctggaccaggccagccagggccaggtgcagggcctgtgcggcaacttcaacggcctggagggcgacgacttcaagaccgccagcggcctggtggaggccaccggcgccggcttcgccaacacctggaaggcccagagcagctgccacgacaagctggactggctggacgacccctgcagcctgaacatcgagagcgccaactacgccgagcactggtgcagcctgctgaagaagaccgagacccccttcggcagatgccacagcgccgtggaccccgccgagtactacaagagatgcaagtacgacacctgcaactgccagaacaacgaggactgcctgtgcgccgccctgagcagctacgccagagcctgcaccgccaagggcgtgatgctgtggggctggagagagcacgtgtgcaacaaggacgtgggcagctgccccaacagccaggtgttcctgtacaacctgaccacctgccagcagacctgcagaagcctgagcgaggccgacagccactgcctggagggcttcgcccccgtggacggctgcggctgccccgaccacaccttcctggacgagaagggcagatgcgtgcccctggccaagtgcagctgctaccacagaggcctgtacctggaggccggcgacgtggtggtgagacaggaggagagatgcgtgtgcagagacggcagactgcactgcagacagatcagactgatcggccagagctgcaccgcccccaagatccacatggactgcagcaacctgaccgccctggccaccagcaagcccagagccctgagctgccagaccctggccgccggctactaccacaccgagtgcgtgagcggctgcgtgtgccccgacggcctgatggacgacggcagaggcggctgcgtggtggagaaggagtgcccctgcgtgcacaacaacgacctgtacagcagcggcgccaagatcaaggtggactgcaacacctgcacctgcaagagaggcagatgggtgtgcacccaggccgtgtgccacggcacctgcagcatctacggcagcggccactacatcaccttcgacggcaagtactacgacttcgacggccactgcagctacgtggccgtgcaggactactgcggccagaacagcagcctgggcagcttcagcatcatcaccgagaacgtgccctgcggcaccaccggcgtgacctgcagcaaggccatcaagatcttcatgggcagaaccgagctgaagctggaggacaagcacagagtggtgatccagagagacgagggccaccacgtggcctacaccaccagagaggtgggccagtacctggtggtggagagcagcaccggcatcatcgtgatctgggacaagagaaccaccgtgttcatcaagctggcccccagctacaagggcaccgtgtgcggcctgtgcggcaacttcgaccacagaagcaacaacgacttcaccaccagagaccacatggtggtgagcagcgagctggacttcggcaacagctggaaggaggcccccacctgccccgacgtgagcaccaaccccgagccctgcagcctgaacccccacagaagaagctgggccgagaagcagtgcagcatcctgaagagcagcgtgttcagcatctgccacagcaaggtggaccccaagcccttctacgaggcctgcgtgcacgacagctgcagctgcgacaccggcggcgactgcgagtgcttctgcagcgccgtggccagctacgcccaggagtgcaccaaggagggcgcctgcgtgttctggagaacccccgacctgtgccccatcttctgcgactactacaaccccccccacgagtgcgagtggcactacgagccctgcggcaacagaagcttcgagacctgcagaaccatcaacggcatccacagcaacatcagcgtgagctacctggagggctgctaccccagatgccccaaggacagacccatctacgaggaggacctgaagaagtgcgtgaccgccgacaagtgcggctgctacgtggaggacacccactacccccccggcgccagcgtgcccaccgaggagacctgcaagagctgcgtgtgcaccaacagcagccaggtggtgtgcagacccgaggagggcaagatcctgaaccagacccaggacggcgccttctgctactgggagatctgcggccccaacggcaccgtggagaagcacttcaacatctgcagcatcaccaccagacccagcaccctgaccaccttcaccaccatcaccctgcccaccacccccaccaccttcaccaccaccaccaccaccaccacccccaccagcagcaccgtgctgagcaccacccccaagctgtgctgcctgtggagcgactggatcaacgaggaccaccccagcagcggcagcgacgacggcgacagagagaccttcgacggcgtgtgcggcgcccccgaggacatcgagtgcagaagcgtgaaggacccccacctgagcctggagcagctgggccagaaggtgcagtgcgacgtgagcgtgggcttcatctgcaagaacgaggaccagttcggcaacggccccttcggcctgtgctacgactacaagatcagagtgaactgctgctggcccatggacaagtgcatcaccacccccagcccccccaccaccacccccagccccccccccaccagcaccaccaccctgccccccaccaccacccccagcccccccaccaccaccaccaccacccccccccccaccaccacccccagcccccccatcaccaccaccaccacccccccccccaccaccacccccagcccccccatcagcaccaccaccacccccccccccaccaccacccccagcccccccaccaccacccccagcccccccaccaccacccccagcccccccaccaccaccaccaccacccccccccccaccaccacccccagcccccccaccaccacccccatcaccccccccgccagcaccaccaccctgccccccaccaccacccccagcccccccaccaccaccaccaccacccccccccccaccaccacccccatcaccaccaccaccaccgtgacccccacccccacccccaccggcacccagacccccaccaccacccccatcaccaccaccaccaccgtgacccccacccccacccccaccggcacccagacccccaccagcacccccatcaccaccaccaccaccgtgacccccacccccacccccaccggcacccagacccccaccaccacccccatcaccaccaccaccaccgtgacccccacccccacccccaccggcacccagacccccacccccaccgccatcaccaccaccaccaccgtgacccccacccccacccccaccggcacccagacccccaccaccacccccatcaccaccaccaccaccgtgacccccacccccacccccaccggcacccagagccccacccccaccgccatcaccaccaccaccaccgtgacccccacccccacccccaccggcacccagacccccaccagcacccccatcaccaccaccaccaccgtgacccccacccccacccccaccggcacccagacccccacccccacccccatcagcaccaccaccaccgtgacccccacccccacccccaccggcacccagacccccaccaccacccccatcaccaccaccaccaccgtgacccccacccccacccccaccggcacccagacccccaccaccgtgctgatcaccaccaccaccaccatgacccccacccccacccccaccagcaccaagagcaccaccgtgacccccatcaccaccaccaccaccgtgaccgccacccccacccccaccggcacccagacccccaccatgatccccatcagcaccaccaccaccgtgacccccacccccacccccaccaccggcagcaccggcccccccacccacaccagcaccgcccccatcgccgagctgaccaccagcaaccccccccccgagagcagcaccccccagaccagcagaagcaccagcagccccctgaccgagagcaccaccctgctgagcaccctgccccccgccatcgagatgaccagcaccgccccccccagcacccccaccgcccccaccaccaccagcggcggccacaccctgagccccccccccagcaccaccaccagcccccccggcacccccaccagaggcaccaccaccggcagcagcagcgcccccacccccagcaccgtgcagaccaccaccaccagcgcctggacccccacccccacccccctgagcacccccagcatcatcagaaccaccggcctgagaccctaccccagcagcgtgctgatctgctgcgtgctgaacgacacctactacgcccccggcgaggaggtgtacaacggcacctacggcgacacctgctacttcgtgaactgcagcctgagctgcaccctggagttctacaactggagctgccccagcacccccagccccacccccacccccagcaagagcacccccacccccagcaagcccagcagcacccccagcaagcccacccccggcaccaagccccccgagtgccccgacttcgacccccccagacaggagaacgagacctggtggctgtgcgactgcttcatggccacctgcaagtacaacaacaccgtggagatcgtgaaggtggagtgcgagcccccccccatgcccacctgcagcaacggcctgcagcccgtgagagtggaggaccccgacggctgctgctggcactgggagtgcgactgctactgcaccggctggggcgacccccactacgtgaccttcgacggcctgtactacagctaccagggcaactgcacctacgtgctggtggaggagatcagccccagcgtggacaacttcggcgtgtacatcgacaactaccactgcgaccccaacgacaaggtgagctgccccagaaccctgatcgtgagacacgagacccaggaggtgctgatcaagaccgtgcacatgatgcccatgcaggtgcaggtgcaggtgaacagacaggccgtggccctgccctacaagaagtacggcctggaggtgtaccagagcggcatcaactacgtggtggacatccccgagctgggcgtgctggtgagctacaacggcctgagcttcagcgtgagactgccctaccacagattcggcaacaacaccaagggccagtgcggcacctgcaccaacaccaccagcgacgactgcatcctgcccagcggcgagatcgtgagcaactgcgaggccgccgccgaccagtggctggtgaacgaccccagcaagccccactgcccccacagcagcagcaccaccaagagacccgccgtgaccgtgcccggcggcggcaagaccaccccccacaaggactgcacccccagccccctgtgccagctgatcaaggacagcctgttcgcccagtgccacgccctggtgcccccccagcactactacgacgcctgcgtgttcgacagctgcttcatgcccggcagcagcctggagtgcgccagcctgcaggcctacgccgccctgtgcgcccagcagaacatctgcctggactggagaaaccacacccacggcgcctgcctggtggagtgccccagccacagagagtaccaggcctgcggccccgccgaggagcccacctgcaagagcagcagcagccagcagaacaacaccgtgctggtggagggctgcttctgccccgagggcaccatgaactacgcccccggcttcgacgtgtgcgtgaagacctgcggctgcgtgggccccgacaacgtgcccagagagttcggcgagcacttcgagttcgactgcaagaactgcgtgtgcctggagggcggcagcggcatcatctgccagcccaagagatgcagccagaagcccgtgacccactgcgtggaggacggcacctacctggccaccgaggtgaaccccgccgacacctgctgcaacatcaccgtgtgcaagtgcaacaccagcctgtgcaaggagaagcccagcgtgtgccccctgggcttcgaggtgaagagcaagatggtgcccggcagatgctgccccttctactggtgcgagagcaagggcgtgtgcgtgcacggcaacgccgagtaccagcccggcagccccgtgtacagcagcaagtgccaggactgcgtgtgcaccgacaaggtggacaacaacaccctgctgaacgtgatcgcctgcacccacgtgccctgcaacaccagctgcagccccggcttcgagctgatggaggcccccggcgagtgctgcaagaagtgcgagcagacccactgcatcatcaagagacccgacaaccagcacgtgatcctgaagcccggcgacttcaagagcgaccccaagaacaactgcaccttcttcagctgcgtgaagatccacaaccagctgatcagcagcgtgagcaacatcacctgccccaacttcgacgccagcatctgcatccccggcagcatcaccttcatgcccaacggctgctgcaagacctgcacccccagaaacgagaccagagtgccctgcagcaccgtgcccgtgaccaccgaggtgagctacgccggctgcaccaagaccgtgctgatgaaccactgcagcggcagctgcggcaccttcgtgatgtacagcgccaaggcccaggccctggaccacagctgcagctgctgcaaggaggagaagaccagccagagagaggtggtgctgagctgccccaacggcggcagcctgacccacacctacacccacatcgagagctgccagtgccaggacaccgtgtgcggcctgcccaccggcaccagcagaagagccagaagaagccccagacacctgggcagcggctag

SEQ ID NO: 89529 - DNA, 2631 bp, Artificial Sequence
  Description of Artificial Sequence: Synthetic coding sequence
atctacagcaccgtgagcaccagcaccaccgccatcaccagccacttcaccaccagcgagaccgccgtgacccccacccccgtgacccccagcagcctgagcaccgacatccccaccaccagcctgagaaccctgacccccagcagcgtgggcaccagcaccagcctgaccaccaccaccgacttccccagcatccccaccgacatcagcaccctgcccaccagaacccacatcatcagcagcagccccagcatccagagcaccgagaccagcagcctggtgggcaccaccagccccaccatgagcaccgtgagaatgaccctgagaatcaccgagaacacccccatcagcagcttcagcaccagcatcgtggtgatccccgagacccccacccagaccccccccgtgctgaccagcgccaccggcacccagaccagccccgcccccaccaccgtgaccttcggcagcaccgacagcagcaccagcaccctgcacaccctgacccccagcaccgccctgagcaccatcgtgagcaccagccaggtgcccatccccagcacccacagcagcaccctgcagaccacccccagcacccccagcctgcagaccagcctgaccagcaccagcgagttcaccaccgagagcttcaccagaggcagcaccagcaccaacgccatcctgaccagcttcagcaccatcatctggagcagcacccccaccatcatcatgagcagcagccccagcagcgccagcatcacccccgtgttcagcaccaccatccacagcgtgcccagcagcccctacatcttcagcaccgagaacgtgggcagcgccagcatcaccggcttccccagcctgagcagcagcgccaccaccagcaccagcagcaccagcagcagcctgaccaccgccctgaccgagatcacccccttcagctacatcagcctgcccagcaccaccccctgccccggcaccatcaccatcaccatcgtgcccgccagccccaccgacccctgcgtggagatggaccccagcaccgaggccaccagcccccccaccacccccctgaccgtgttccccttcaccaccgagatggtgacctgccccaccagcatcagcatccagaccaccctgaccacctacatggacaccagcagcatgatgcccgagagcgagagcagcatcagccccaacgccagcagcagcaccggcaccggcaccgtgcccaccaacaccgtgttcaccagcaccagactgcccaccagcgagacctggctgagcaacagcagcgtgatccccctgcccctgcccggcgtgagcaccatccccctgaccatgaagcccagcagcagcctgcccaccatcctgagaaccagcagcaagagcacccaccccagcccccccaccaccagaaccagcgagacccccgtggccaccacccagacccccaccaccctgaccagcagaagaaccaccagaatcaccagccagatgaccacccagagcaccctgaccaccaccgccggcacctgcgacaacggcggcacctgggagcagggccagtgcgcctgcctgcccggcttcagcggcgacagatgccagctgcagaccagatgccagaacggcggccagtgggacggcctgaagtgccagtgccccagcaccttctacggcagcagctgcgagttcgccgtggagcaggtggacctggacgtggtggagaccgaggtgggcatggaggtgagcgtggaccagcagttcagccccgacctgaacgacaacaccagccaggcctacagagacttcaacaagaccttctggaaccagatgcagaagatcttcgccgacatgcagggcttcaccttcaagggcgtggagatcctgagcctgagaaacggcagcatcgtggtggactacctggtgctgctggagatgcccttcagcccccagctggagagcgagtacgagcaggtgaagaccaccctgaaggagggcctgcagaacgccagccaggacgccaacagctgccaggacagccagaccctgtgcttcaagcccgacagcatcaaggtgaacaacaacagcaagaccgagctgacccccgaggccatctgcagaagagccgcccccaccggctacgaggagttctacttccccctggtggaggccaccagactgagatgcgtgaccaagtgcaccagcggcgtggacaacgccatcgactgccaccagggccagtgcgtgctggagaccagcggccccgcctgcagatgctacagcaccgacacccactggttcagcggccccagatgcgaggtggccgtgcactggagagccctggtgggcggcctgaccgccggcgccgccctgctggtgctgctgctgctggccctgggcgtgagagccgtgagaagcggctggtggggcggccagagaagaggcagaagctgggaccaggacagaaagtggttcgagacctgggacgaggaggtggtgggcaccttcagcaactggggcttcgaggacgacggcaccgacaaggacaccaacttccacgtggccctggagaacgtggacaccaccatgaaggtgcacatcaagagacccgagatgaccagcagcagcgtgtag

SEQ ID NO: 89530 - DNA, 927 bp, Artificial Sequence
  Description of Artificial Sequence: Synthetic coding sequence
tgcgacaacggcggcacctgggagcagggccagtgcgcctgcctgcccggcttcagcggcgacagatgccagctgcagaccagatgccagaacggcggccagtgggacggcctgaagtgccagtgccccagcaccttctacggcagcagctgcgagttcgccgtggagcaggtggacctggacgtggtggagaccgaggtgggcatggaggtgagcgtggaccagcagttcagccccgacctgaacgacaacaccagccaggcctacagagacttcaacaagaccttctggaaccagatgcagaagatcttcgccgacatgcagggcttcaccttcaagggcgtggagatcctgagcctgagaaacggcagcatcgtggtggactacctggtgctgctggagatgcccttcagcccccagctggagagcgagtacgagcaggtgaagaccaccctgaaggagggcctgcagaacgccagccaggacgccaacagctgccaggacagccagaccctgtgcttcaagcccgacagcatcaaggtgaacaacaacagcaagaccgagctgacccccgaggccatctgcagaagagccgcccccaccggctacgaggagttctacttccccctggtggaggccaccagactgagatgcgtgaccaagtgcaccagcggcgtggacaacgccatcgactgccaccagggccagtgcgtgctggagaccagcggccccgcctgcagaagctgggaccaggacagaaagtggttcgagacctgggacgaggaggtggtgggcaccttcagcaactggggcttcgaggacgacggcaccgacaaggacaccaacttccacgtggccctggagaacgtggacaccaccatgaaggtgcacatcaagagacccgagatgaccagcagcagcgtgtag

SEQ ID NO: 89531 - DNA, 3531 bp, Artificial Sequence
  Description of Artificial Sequence: Synthetic coding sequence
atgaagggcgccagatggagaagagtgccctgggtgagcctgagctgcctgtgcctgtgcctgctgccccacgtggtgcccggcatgaccacccccagcctgaagaccgacggcggcagaagaaccgccaccagccccccccccaccaccagccagaccatcatcagcaccatccccagcaccgccatgcacaccagaagcaccgccgcccccatccccatcctgcccgagagaggcgtgagcctgttcccctacggcgccggcgccggcgacctggagttcgtgagaagaaccgtggacttcaccagccccctgttcaagcccgccaccggcttccccctgggcagcagcctgagagacagcctgtacttcaccgacaacggccagatcatcttccccgagagcgactaccagatcttcagctaccccaaccccctgcccaccggcttcaccggcagagaccccgtggccctggtggcccccttctgggacgacgccgacttcagcaccggcagaggcaccaccttctaccaggagtacgagaccttctacggcgagcacagcctgctggtgcagcaggccgagagctggatcagaaagatgaccaacaacggcggctacaaggccagatgggccctgaaggtgacctgggtgaacgcccacgcctaccccgcccagtggaccctgggcagcaacacctaccaggccatcctgagcaccgacggcagcagaagctacgccctgttcctgtaccagagcggcggcatgcagtgggacgtggcccagagaagcggcaaccccgtgctgatgggcttcagcagcggcgacggctacttcgagaacagccccctgatgagccagcccgtgtgggagagatacagacccgacagattcctgaacagcaacagcggcctgcagggcctgcagttctacagactgcacagagaggagagacccaactacagactggagtgcctgcagtggctgaagagccagcccagatggcccagctggggctggaaccaggtgagctgcccctgcagctggcagcagggcagaagagacctgagattccagcccgtgagcatcggcagatggggcctgggcagcagacagctgtgcagcttcaccagctggagaggcggcgtgtgctgcagctacggcccctggggcgagttcagagagggctggcacgtgcagagaccctggcagctggcccaggagctggagccccagagctggtgctgcagatggaacgacaagccctacctgtgcgccctgtaccagcagagaagaccccacgtgggctgcgccacctacagacccccccagcccgcctggatgttcggcgacccccacatcaccaccctggacggcgtgagctacaccttcaacggcctgggcgacttcctgctggtgggcgcccaggacggcaacagcagcttcctgctgcagggcagaaccgcccagaccggcagcgcccaggccaccaacttcatcgccttcgccgcccagtacagaagcagcagcctgggccccgtgaccgtgcagtggctgctggagccccacgacgccatcagagtgctgctggacaaccagaccgtgaccttccagcccgaccacgaggacggcggcggccaggagaccttcaacgccaccggcgtgctgctgagcagaaacggcagcgaggtgagcgccagcttcgacggctgggccaccgtgagcgtgatcgccctgagcaacatcctgcacgccagcgccagcctgccccccgagtaccagaacagaaccgagggcctgctgggcgtgtggaacaacaaccccgaggacgacttcagaatgcccaacggcagcaccatcccccccggcagccccgaggagatgctgttccacttcggcatgacctggcagatcaacggcaccggcctgctgggcaagagaaacgaccagctgcccagcaacttcacccccgtgttctacagccagctgcagaagaacagcagctgggccgagcacctgatcagcaactgcgacggcgacagcagctgcatctacgacaccctggccctgagaaacgccagcatcggcctgcacaccagagaggtgagcaagaactacgagcaggccaacgccaccctgaaccagtacccccccagcatcaacggcggcagagtgatcgaggcctacaagggccagaccaccctgatccagtacaccagcaacgccgaggacgccaacttcaccctgagagacagctgcaccgacctggagctgttcgagaacggcaccctgctgtggacccccaagagcctggagcccttcaccctggagatcctggccagaagcgccaagatcggcctggccagcgccctgcagcccagaaccgtggtgtgccactgcaacgccgagagccagtgcctgtacaaccagaccagcagagtgggcaacagcagcctggaggtggccggctgcaagtgcgacggcggcaccttcggcagatactgcgagggcagcgaggacgcctgcgaggagccctgcttccccagcgtgcactgcgtgcccggcaagggctgcgaggcctgcccccccaacctgaccggcgacggcagacactgcgccgccctgggcagcagcttcctgtgccagaaccagagctgccccgtgaactactgctacaaccagggccactgctacatcagccagaccctgggctgccagcccatgtgcacctgcccccccgccttcaccgacagcagatgcttcctggccggcaacaacttcagccccaccgtgaacctggagctgcccctgagagtgatccagctgctgctgagcgaggaggagaacgccagcatggccgaggtgaacgccagcgtggcctacagactgggcaccctggacatgagagccttcctgagaaacagccaggtggagagaatcgacagcgccgcccccgccagcggcagccccatccagcactggatggtgatcagcgagttccagtacagacccagaggccccgtgatcgacttcctgaacaaccagctgctggccgccgtggtggaggccttcctgtaccacgtgcccagaagaagcgaggagcccagaaacgacgtggtgttccagcccatcagcggcgaggacgtgagagacgtgaccgccctgaacgtgagcaccctgaaggcctacttcagatgcgacggctacaagggctacgacctggtgtacagcccccagagcggcttcacctgcgtgagcccctgcagcagaggctactgcgaccacggcggccagtgccagcacctgcccagcggccccagatgcagctgcgtgagcttcagcatctacaccgcctggggcgagcactgcgagcacctgagcatgaagctggacgccttcttcggcatcttcttcggcgccctgggcggcctgctgctgctgggcgtgggcaccttcgtggtgctgagattctggggctgcagcggcgccagattcagctacttcctgaacagcgccgaggccctgccctag

SEQ ID NO: 89532 - DNA, 3378 bp, Artificial Sequence
  Description of Artificial Sequence: Synthetic coding sequence
atgaagggcgccagatggagaagagtgccctgggtgagcctgagctgcctgtgcctgtgcctgctgccccacgtggtgcccggcgtgagcctgttcccctacggcgccggcgccggcgacctggagttcgtgagaagaaccgtggacttcaccagccccctgttcaagcccgccaccggcttccccctgggcagcagcctgagagacagcctgtacttcaccgacaacggccagatcatcttccccgagagcgactaccagatcttcagctaccccaaccccctgcccaccggcttcaccggcagagaccccgtggccctggtggcccccttctgggacgacgccgacttcagcaccggcagaggcaccaccttctaccaggagtacgagaccttctacggcgagcacagcctgctggtgcagcaggccgagagctggatcagaaagatgaccaacaacggcggctacaaggccagatgggccctgaaggtgacctgggtgaacgcccacgcctaccccgcccagtggaccctgggcagcaacacctaccaggccatcctgagcaccgacggcagcagaagctacgccctgttcctgtaccagagcggcggcatgcagtgggacgtggcccagagaagcggcaaccccgtgctgatgggcttcagcagcggcgacggctacttcgagaacagccccctgatgagccagcccgtgtgggagagatacagacccgacagattcctgaacagcaacagcggcctgcagggcctgcagttctacagactgcacagagaggagagacccaactacagactggagtgcctgcagtggctgaagagccagcccagatggcccagctggggctggaaccaggtgagctgcccctgcagctggcagcagggcagaagagacctgagattccagcccgtgagcatcggcagatggggcctgggcagcagacagctgtgcagcttcaccagctggagaggcggcgtgtgctgcagctacggcccctggggcgagttcagagagggctggcacgtgcagagaccctggcagctggcccaggagctggagccccagagctggtgctgcagatggaacgacaagccctacctgtgcgccctgtaccagcagagaagaccccacgtgggctgcgccacctacagacccccccagcccgcctggatgttcggcgacccccacatcaccaccctggacggcgtgagctacaccttcaacggcctgggcgacttcctgctggtgggcgcccaggacggcaacagcagcttcctgctgcagggcagaaccgcccagaccggcagcgcccaggccaccaacttcatcgccttcgccgcccagtacagaagcagcagcctgggccccgtgaccgtgcagtggctgctggagccccacgacgccatcagagtgctgctggacaaccagaccgtgaccttccagcccgaccacgaggacggcggcggccaggagaccttcaacgccaccggcgtgctgctgagcagaaacggcagcgaggtgagcgccagcttcgacggctgggccaccgtgagcgtgatcgccctgagcaacatcctgcacgccagcgccagcctgccccccgagtaccagaacagaaccgagggcctgctgggcgtgtggaacaacaaccccgaggacgacttcagaatgcccaacggcagcaccatcccccccggcagccccgaggagatgctgttccacttcggcatgacctggcagatcaacggcaccggcctgctgggcaagagaaacgaccagctgcccagcaacttcacccccgtgttctacagccagctgcagaagaacagcagctgggccgagcacctgatcagcaactgcgacggcgacagcagctgcatctacgacaccctggccctgagaaacgccagcatcggcctgcacaccagagaggtgagcaagaactacgagcaggccaacgccaccctgaaccagtacccccccagcatcaacggcggcagagtgatcgaggcctacaagggccagaccaccctgatccagtacaccagcaacgccgaggacgccaacttcaccctgagagacagctgcaccgacctggagctgttcgagaacggcaccctgctgtggacccccaagagcctggagcccttcaccctggagatcctggccagaagcgccaagatcggcctggccagcgccctgcagcccagaaccgtggtgtgccactgcaacgccgagagccagtgcctgtacaaccagaccagcagagtgggcaacagcagcctggaggtggccggctgcaagtgcgacggcggcaccttcggcagatactgcgagggcagcgaggacgcctgcgaggagccctgcttccccagcgtgcactgcgtgcccggcaagggctgcgaggcctgcccccccaacctgaccggcgacggcagacactgcgccgccctgggcagcagcttcctgtgccagaaccagagctgccccgtgaactactgctacaaccagggccactgctacatcagccagaccctgggctgccagcccatgtgcacctgcccccccgccttcaccgacagcagatgcttcctggccggcaacaacttcagccccaccgtgaacctggagctgcccctgagagtgatccagctgctgctgagcgaggaggagaacgccagcatggccgaggtgaacgccagcgtggcctacagactgggcaccctggacatgagagccttcctgagaaacagccaggtggagagaatcgacagcgccgcccccgccagcggcagccccatccagcactggatggtgatcagcgagttccagtacagacccagaggccccgtgatcgacttcctgaacaaccagctgctggccgccgtggtggaggccttcctgtaccacgtgcccagaagaagcgaggagcccagaaacgacgtggtgttccagcccatcagcggcgaggacgtgagagacgtgaccgccctgaacgtgagcaccctgaaggcctacttcagatgcgacggctacaagggctacgacctggtgtacagcccccagagcggcttcacctgcgtgagcccctgcagcagaggctactgcgaccacggcggccagtgccagcacctgcccagcggccccagatgcagctgcgtgagcttcagcatctacaccgcctggggcgagcactgcgagcacctgagcatgaagctggacgccttcttcggcatcttcttcggcgccctgggcggcctgctgctgctgggcgtgggcaccttcgtggtgctgagattctggggctgcagcggcgccagattcagctacttcctgaacagcgccgaggccctgccctag

SEQ ID NO: 89533 - DNA, 5739 bp, Artificial Sequence
  Description of Artificial Sequence: Synthetic coding sequence
cccggcaccaccgaggacaccctgatcaccggcagcaagaccgccgcccccgtgaccagcaccggcagcaccaccgccaccctggagggccagagcaccgccgccagcagcagaaccagcaaccaggacatcagcgccagcagccagaaccaccagaccaagagcaccgagaccaccagcaaggcccagaccgacaccctgacccagatgatgaccagcaccctgttcagcagccccagcgtgcacaacgtgatggagaccgccccccccgacgagatgaccaccagcttccccagcagcgtgaccaacaccctgatgatgaccagcaagaccatcaccatgaccaccagcaccgacagcaccctgggcaacaccgaggagaccagcaccgccggcaccgagagcagcacccccgtgaccagcgccgtgagcatcaccgccggccaggagggccagagcagaaccaccagctggagaaccagcatccaggacaccagcgccagcagccagaaccactggaccagaagcacccagaccaccagagagagccagaccagcaccctgacccacagaaccaccagcacccccagcttcagccccagcgtgcacaacgtgaccggcaccgtgagccagaagaccagccccagcggcgagaccgccaccagcagcctgtgcagcgtgaccaacaccagcatgatgaccagcgagaagatcaccgtgaccaccagcaccggcagcaccctgggcaaccccggcgagaccagcagcgtgcccgtgaccggcagcctgatgcccgtgaccagcgccgccctggtgaccttcgaccccgagggccagagccccgccaccttcagcagaaccagcacccaggacaccaccgccttcagcaagaaccaccagacccagagcgtggagaccaccagagtgagccagatcaacaccctgaacaccctgacccccgtgaccaccagcaccgtgctgagcagccccagcggcttcaaccccagcggcaccgtgagccaggagaccttccccagcggcgagaccaccaccagcagccccagcagcgtgagcaacaccttcctggtgaccagcaaggtgttcagaatgcccaccagcagagacagcaccctgggcaacaccgaggagaccagcctgagcgtgagcggcaccatcagcgccatcaccagcaaggtgagcaccatctggtggagcgacaccctgagcaccgccctgagccccagcagcctgccccccaagatcagcaccgccttccacacccagcagagcgagggcgccgagaccaccggcagaccccacgagagaagcagcttcagccccggcgtgagccaggagatcttcaccctgcacgagaccaccacctggcccagcagcttcagcagcaagggccacaccacctggagccagaccgagctgcccagcaccagcaccggcgccgccaccagactggtgaccggcaaccccagcaccggcaccgccggcaccatccccagagtgcccagcaaggtgagcgccatcggcgagcccggcgagcccaccacctacagcagccacagcaccaccctgcccaagaccaccggcgccggcgcccagacccagtggacccaggagaccggcaccaccggcgaggccctgctgagcagccccagctacagcgtgacccagatgatcaagaccgccaccagccccagcagcagccccatgctggacagacacaccagccagcagatcaccaccgcccccagcaccaaccacagcaccatccacagcaccagcaccagcccccaggagagccccgccgtgagccagagaggccacacccaggccccccagaccacccaggagagccagaccaccagaagcgtgagccccatgaccgacaccaagaccgtgaccacccccggcagcagcttcaccgccagcggccacagccccagcgagatcgtgccccaggacgcccccaccatcagcgccgccaccaccttcgcccccgcccccaccggcgacggccacaccacccaggcccccaccaccgccctgcaggccgcccccagcagccacgacgccaccctgggccccagcggcggcaccagcctgagcaagaccggcgccctgaccctggccaacagcgtggtgagcacccccggcggccccgagggccagtggaccagcgccagcgccagcaccagccccgacaccgccgccgccatgacccacacccaccaggccgagagcaccgaggccagcggccagacccagaccagcgagcccgccagcagcggcagcagaaccaccagcgccggcaccgccacccccagcagcagcggcgccagcggcaccacccccagcggcagcgagggcatcagcaccagcggcgagaccaccagattcagcagcaaccccagcagagacagccacaccacccagagcaccaccgagctgctgagcgccagcgccagccacggcgccatccccgtgagcaccggcatggccagcagcatcgtgcccggcaccttccaccccaccctgagcgaggccagcaccgccggcagacccaccggccagagcagccccaccagccccagcgccagcccccaggagaccgccgccatcagcagaatggcccagacccagagaaccagaaccagcagaggcagcgacaccatcagcctggccagccaggccaccgacaccttcagcaccgtgccccccaccccccccagcatcaccagcaccggcctgaccagcccccagaccgagacccacaccctgagccccagcggcagcggcaagaccttcaccaccgccctgatcagcaacgccacccccctgcccgtgacctacgccagcagcgccagcaccggccacgccacccccctggccgtgagcagcgccaccagcgccagcaccgtgagcagcgacagccccctgaagatggagacccccggcatgaccacccccagcctgaagaccgacggcggcagaagaaccgccaccagccccccccccaccaccagccagaccatcatcagcaccatccccagcaccgccatgcacaccagaagcaccgccgcccccatccccatcctgcccgagagaggcgtgagcctgttcccctacggcgccggcgccggcgacctggagttcgtgagaagaaccgtggacttcaccagccccctgttcaagcccgccaccggcttccccctgggcagcagcctgagagacagcctgtacttcaccgacaacggccagatcatcttccccgagagcgactaccagatcttcagctaccccaaccccctgcccaccggcttcaccggcagagaccccgtggccctggtggcccccttctgggacgacgccgacttcagcaccggcagaggcaccaccttctaccaggagtacgagaccttctacggcgagcacagcctgctggtgcagcaggccgagagctggatcagaaagatgaccaacaacggcggctacaaggccagatgggccctgaaggtgacctgggtgaacgcccacgcctaccccgcccagtggaccctgggcagcaacacctaccaggccatcctgagcaccgacggcagcagaagctacgccctgttcctgtaccagagcggcggcatgcagtgggacgtggcccagagaagcggcaaccccgtgctgatgggcttcagcagcggcgacggctacttcgagaacagccccctgatgagccagcccgtgtgggagagatacagacccgacagattcctgaacagcaacagcggcctgcagggcctgcagttctacagactgcacagagaggagagacccaactacagactggagtgcctgcagtggctgaagagccagcccagatggcccagctggggctggaaccaggtgagctgcccctgcagctggcagcagggcagaagagacctgagattccagcccgccagcctgccccccgagtaccagaacagaaccgagggcctgctgggcgtgtggaacaacaaccccgaggacgacttcagaatgcccaacggcagcaccatcccccccggcagccccgaggagatgctgttccacttcggcatgacctggcagatcaacggcaccggcctgctgggcaagagaaacgaccagctgcccagcaacttcacccccgtgttctacagccagctgcagaagaacagcagctgggccgagcacctgatcagcaactgcgacggcgacagcagctgcatctacgacaccctggccctgagaaacgccagcatcggcctgcacaccagagaggtgagcaagaactacgagcaggccaacgccaccctgaaccagtacccccccagcatcaacggcggcagagtgatcgaggcctacaagggccagaccaccctgatccagtacaccagcaacgccgaggacgccaacttcaccctgagagacagctgcaccgacctggagctgttcgagaacggcaccctgctgtggacccccaagagcctggagcccttcaccctggagatcctggccagaagcgccaagatcggcctggccagcgccctgcagcccagaaccgtggtgtgccactgcaacgccgagagccagtgcctgtacaaccagaccagcagagtgggcaacagcagcctggaggtggccggctgcaagtgcgacggcggcaccttcggcagatactgcgagggcagcgaggacgcctgcgaggagccctgcttccccagcgtgcactgcgtgcccggcaagggctgcgaggcctgcccccccaacctgaccggcgacggcagacactgcgccgccctgggcagcagcttcctgtgccagaaccagagctgccccgtgaactactgctacaaccagggccactgctacatcagccagaccctgggctgccagcccatgtgcacctgcccccccgccttcaccgacagcagatgcttcctggccggcaacaacttcagccccaccgtgaacctggagctgcccctgagagtgatccagctgctgctgagcgaggaggagaacgccagcatggccgaggtgaacgccagcgtggcctacagactgggcaccctggacatgagagccttcctgagaaacagccaggtggagagaatcgacagcgccgcccccgccagcggcagccccatccagcactggatggtgatcagcgagttccagtacagacccagaggccccgtgatcgacttcctgaacaaccagctgctggccgccgtggtggaggccttcctgtaccacgtgcccagaagaagcgaggagcccagaaacgacgtggtgttccagcccatcagcggcgaggacgtgagagacgtgaccgccctgaacgtgagcaccctgaaggcctacttcagatgcgacggctacaagggctacgacctggtgtacagcccccagagcggcttcacctgcgtgagcccctgcagcagaggctactgcgaccacggcggccagtgccagcacctgcccagcggccccagatgcagctgcgtgagcttcagcatctacaccgcctggggcgagcactgcgagcacctgagcatgaagctggacgccttcttcggcatcttcttcggcgccctgggcggcctgctgctgctgggcgtgggcaccttcgtggtgctgagattctggggctgcagcggcgccagattcagctacttcctgaacagcgccgaggccctgccctag

SEQ ID NO: 89534 - DNA, 16239 bp, Artificial Sequence
  Description of Artificial Sequence: Synthetic coding sequence
atgaagggcgccagatggagaagagtgccctgggtgagcctgagctgcctgtgcctgtgcctgctgccccacgtggtgcccggcaccaccgaggacaccctgatcaccggcagcaagaccgccgcccccgtgaccagcaccggcagcaccaccgccaccctggagggccagagcaccgccgccagcagcagaaccagcaaccaggacatcagcgccagcagccagaaccaccagaccaagagcaccgagaccaccagcaaggcccagaccgacaccctgacccagatgatgaccagcaccctgttcagcagccccagcgtgcacaacgtgatggagaccgccccccccgacgagatgaccaccagcttccccagcagcgtgaccaacaccctgatgatgaccagcaagaccatcaccatgaccaccagcaccgacagcaccctgggcaacaccgaggagaccagcaccgccggcaccgagagcagcacccccgtgaccagcgccgtgagcatcaccgccggccaggagggccagagcagaaccaccagctggagaaccagcatccaggacaccagcgccagcagccagaaccactggaccagaagcacccagaccaccagagagagccagaccagcaccctgacccacagaaccaccagcacccccagcttcagccccagcgtgcacaacgtgaccggcaccgtgagccagaagaccagccccagcggcgagaccgccaccagcagcctgtgcagcgtgaccaacaccagcatgatgaccagcgagaagatcaccgtgaccaccagcaccggcagcaccctgggcaaccccggcgagaccagcagcgtgcccgtgaccggcagcctgatgcccgtgaccagcgccgccctggtgaccttcgaccccgagggccagagccccgccaccttcagcagaaccagcacccaggacaccaccgccttcagcaagaaccaccagacccagagcgtggagaccaccagagtgagccagatcaacaccctgaacaccctgacccccgtgaccaccagcaccgtgctgagcagccccagcggcttcaaccccagcggcaccgtgagccaggagaccttccccagcggcgagaccaccaccagcagccccagcagcgtgagcaacaccttcctggtgaccagcaaggtgttcagaatgcccaccagcagagacagcaccctgggcaacaccgaggagaccagcctgagcgtgagcggcaccatcagcgccatcaccagcaaggtgagcaccatctggtggagcgacaccctgagcaccgccctgagccccagcagcctgccccccaagatcagcaccgccttccacacccagcagagcgagggcgccgagaccaccggcagaccccacgagagaagcagcttcagccccggcgtgagccaggagatcttcaccctgcacgagaccaccacctggcccagcagcttcagcagcaagggccacaccacctggagccagaccgagctgcccagcaccagcaccggcgccgccaccagactggtgaccggcaaccccagcaccggcaccgccggcaccatccccagagtgcccagcaaggtgagcgccatcggcgagcccggcgagcccaccacctacagcagccacagcaccaccctgcccaagaccaccggcgccggcgcccagacccagtggacccaggagaccggcaccaccggcgaggccctgctgagcagccccagctacagcgtgacccagatgatcaagaccgccaccagccccagcagcagccccatgctggacagacacaccagccagcagatcaccaccgcccccagcaccaaccacagcaccatccacagcaccagcaccagcccccaggagagccccgccgtgagccagagaggccacacccaggccccccagaccacccaggagagccagaccaccagaagcgtgagccccatgaccgacaccaagaccgtgaccacccccggcagcagcttcaccgccagcggccacagccccagcgagatcgtgccccaggacgcccccaccatcagcgccgccaccaccttcgcccccgcccccaccggcgacggccacaccacccaggcccccaccaccgccctgcaggccgcccccagcagccacgacgccaccctgggccccagcggcggcaccagcctgagcaagaccggcgccctgaccctggccaacagcgtggtgagcacccccggcggccccgagggccagtggaccagcgccagcgccagcaccagccccgacaccgccgccgccatgacccacacccaccaggccgagagcaccgaggccagcggccagacccagaccagcgagcccgccagcagcggcagcagaaccaccagcgccggcaccgccacccccagcagcagcggcgccagcggcaccacccccagcggcagcgagggcatcagcaccagcggcgagaccaccagattcagcagcaaccccagcagagacagccacaccacccagagcaccaccgagctgctgagcgccagcgccagccacggcgccatccccgtgagcaccggcatggccagcagcatcgtgcccggcaccttccaccccaccctgagcgaggccagcaccgccggcagacccaccggccagagcagccccaccagccccagcgccagcccccaggagaccgccgccatcagcagaatggcccagacccagagaaccagaaccagcagaggcagcgacaccatcagcctggccagccaggccaccgacaccttcagcaccgtgccccccaccccccccagcatcaccagcaccggcctgaccagcccccagaccgagacccacaccctgagccccagcggcagcggcaagaccttcaccaccgccctgatcagcaacgccacccccctgcccgtgacctacgccagcagcgccagcaccggccacaccacccccctgcacgtgaccgacgccagcagcgtgagcaccggccacgccacccccctgcccgtgaccagccccagcagcgtgagcaccggccacaccacccccctgcccgtgaccgacaccagcagcgagagcaccggccacgtgacccccctgcccgtgaccagcttcagcagcgccagcaccggcgacagcacccccctgcccgtgaccgacaccagcagcgccagcaccggccacgtgacccccctgcccgtgaccagcctgagcagcgccagcaccggcgacaccacccccctgcccgtgaccgacaccagcagcgccagcaccggccacgccaccagcctgcccgtgaccgacaccagcagcgtgagcaccggccacaccacccccctgcccgtgaccgacaccagcagcgccagcaccggccacgccaccagcctgcccgtgaccgacaccagcagcgtgagcaccggccacaccacccccctgcacgtgaccgacgccagcagcgccagcaccggccaggccacccccctgcccgtgaccagcctgagcagcgtgagcaccggcgacaccacccccctgcccgtgaccagccccagcagcgccagcaccggccacgccacccccctgctggtgaccgacaccagcagcgccagcaccggccacgccacccccctgcccgtgaccgacgccagcagcgtgagcaccgaccacgccaccagcctgcccgtgaccatccccagcgccgccagcaccggccacaccacccccctgcccgtgaccgacaccagcagcgccagcaccggccaggccaccagcctgctggtgaccgacaccagcagcgtgagcaccggcgacaccacccccctgcccgtgaccagcaccagcagcgccagcaccggccacgtgacccccctgcacgtgaccagccccagcagcgccagcaccggccacgccacccccctgcccgtgaccagcctgagcagcgccagcaccggcgacaccatgcccctgcccgtgaccagccccagcagcgccagcaccggcgacaccacccccctgcccgtgaccgacgccagcagcgtgagcaccggccacaccacccccctgcacgtgaccgacgccagcagcgccagcaccggccaggccacccccctgcccgtgaccagcctgagcagcgtgagcaccggcgacaccacccccctgcccgtgaccagccccagcagcgccagcaccggccacgccacccccctgctggtgaccgacaccagcagcgccagcaccggccacgccacccccctgcccgtgaccgacgccagcagcgtgagcaccgaccacgccaccagcctgcccgtgaccatccccagcgccgccagcaccggccacaccacccccctgcccgtgaccgacaccagcagcgccagcaccggccaggccaccagcctgctggtgaccgacaccagcagcgtgagcaccggcgacaccacccccctgcccgtgaccagcaccagcagcgccagcaccggccacgtgacccccctgcacgtgaccagccccagcagcgccagcaccggccacgccacccccctgcccgtgaccagcctgagcagcgccagcaccggcgacaccatgcccctgcccgtgaccagccccagcagcgccagcaccggcgacaccacccccctgcccgtgaccgacgccagcagcgtgagcaccggccacaccacccccctgcccgtgaccagccccagcagcgccagcaccggccacaccacccccctgcccgtgaccgacaccagcagcgccagcaagggcgacaccacccccctgcccgtgaccagccccagcagcgccagcaccggccacaccacccccctgcccgtgaccgacaccagcagcgccagcaccggcgacaccacccccctgcccgtgaccaacgccagcagcctgagcaccggccacgccacccccctgcacgtgaccagccccagcagcgccagcaccggccacgccacccccctgcccgtgaccagcaccagcagcgccagcaccggccacgccacccccctgcccgtgaccggcctgagcagcgccaccaccgacgacaccaccagactgcccgtgaccgacgtgagcagcgccagcaccggccaggccacccccctgcccgtgaccagcctgagcagcgtgagcaccggcgacaccacccccctgcccgtgaccagccccagcagcgccagcaccggccacgccagccccctgctggtgaccgacgccagcagcgccagcaccggccaggccacccccctgcccgtgaccgacaccagcagcgtgagcaccgcccacgccacccccctgcccgtgaccggcctgagcagcgccagcaccgacgacaccaccagactgcccgtgaccgacgtgagcagcgccagcaccggccaggccatccccctgcccgtgaccagccccagcagcgccagcaccggcgacaccacccccctgcccgtgaccgacgccagcagcgccagcaccggcgacaccaccagcctgcccgtgaccatccccagcagcgccagcagcggccacaccaccagcctgcccgtgaccgacgccagcagcgtgagcaccggccacgccaccagcctgctggtgaccgacgccagcagcgtgagcaccggcgacaccacccccctgcccgtgaccgacaccaacagcgccagcaccggcgacaccacccccctgcacgtgaccgacgccagcagcgtgagcaccggccacgccaccagcctgcccgtgaccagcctgagcagcgccagcaccggcgacaccacccccctgcccgtgaccagccccagcagcgccagcagcggccacaccacccccctgcccgtgaccgacgccagcagcgtgcccaccggccacgccaccagcctgcccgtgaccgacgccagcagcgtgagcaccggccacgccacccccctgcccgtgaccgacgccagcagcgtgagcaccggccacgccacccccctgcccgtgaccgacaccagcagcgtgagcaccggccaggccacccccctgcccgtgaccagcctgagcagcgccagcaccggcgacaccacccccctgcccgtgaccgacaccagcagcgccagcaccggccaggacacccccctgcccgtgaccagcctgagcagcgtgagcaccggcgacaccacccccctgcccgtgaccaaccccagcagcgccagcaccggccacgccacccccctgctggtgaccgacgccagcagcatcagcaccggccacgccaccagcctgctggtgaccgacgccagcagcgtgagcaccggccacgccaccgccctgcacgacaccgacgccagcagcctgagcaccggcgacaccacccccctgcccgtgaccagccccagcagcaccagcaccggcgacaccacccccctgcccgtgaccgagaccagcagcgtgagcaccggccacgccaccagcctgcccgtgaccgacaccagcagcgccagcaccggccacgccaccagcctgcccgtgaccgacaccagcagcgccagcaccggccacgccacccccctgcccgtgaccgacaccagcagcgccagcaccggccaggccacccccctgcccgtgaccagccccagcagcgccagcaccggccacgccatccccctgctggtgaccgacaccagcagcgccagcaccggccaggccacccccctgcccgtgaccagcctgagcagcgccagcaccggcgacaccacccccctgcccgtgaccgacgccagcagcgtgagcaccggccacgccaccagcctgcccgtgaccagcctgagcagcgtgagcaccggcgacaccacccccctgcccgtgaccagccccagcagcgccagcaccggccacgccacccccctgcacgtgaccgacgccagcagcgccagcaccggccacgccacccccctgcccgtgaccagcctgagcagcgccagcaccggcgacaccacccccctgcccgtgaccagccccagcagcgccagcaccggccacgccacccccctgcacgtgaccgacgccagcagcgtgagcaccggcgacaccacccccctgcccgtgaccagcagcagcagcgccagcagcggccacaccacccccctgcccgtgaccgacgccagcagcgccagcaccggcgacaccacccccctgcccgtgaccgacaccagcagcgccagcaccggccacgccacccacctgcccgtgaccggcctgagcagcgccagcaccggcgacaccaccagactgcccgtgaccaacgtgagcagcgccagcaccggccacgccacccccctgcccgtgaccagcaccagcagcgccagcaccggcgacaccacccccctgcccggcaccgacaccagcagcgtgagcaccggccacaccacccccctgctggtgaccgacgccagcagcgtgagcaccggcgacaccaccagactgcccgtgaccagccccagcagcgccagcaccggccacaccacccccctgcccgtgaccgacacccccagcgccagcaccggcgacaccacccccctgcccgtgaccaacgccagcagcctgagcaccagacacgccaccagcctgcacgtgaccagccccagcagcgccagcaccggccacgccaccagcctgcccgtgaccgacaccagcgccgccagcaccggccacgccacccccctgcccgtgaccagcaccagcagcgccagcaccggcgacaccacccccctgcccgtgaccgacacctacagcgccagcaccggccaggccacccccctgcccgtgaccagcctgagcagcgtgagcaccggcgacaccacccccctgcccgtgaccagccccagcagcgccagcaccggccacgccacccccctgctggtgaccgacgccagcagcgccagcaccggccaggccacccccctgcccgtgaccagcctgagcagcgtgagcaccggcgacaccacccccctgcccgtgaccagccccagcagcgccagcaccggccacgccaccagcctgcccgtgaccgacaccagcagcgccagcaccggcgacaccaccagcctgcccgtgaccgacaccagcagcgcctacaccggcgacaccaccagcctgcccgtgaccgacaccagcagcagcagcaccggcgacaccacccccctgctggtgaccgagaccagcagcgtgagcaccggcgacaccacccccctgcccgtgaccgacaccagcagcgccagcaccggccacgccacccccctgcccgtgaccaacaccagcagcgtgagcaccggccacgccacccccctgcacgtgaccagccccagcagcgccagcaccggccacaccacccccctgcccgtgaccgacgccagcagcgtgagcaccggccacgccaccagcctgcccgtgaccgacgccagcagcgtgttcaccggccacgccaccagcctgcccgtgaccatccccagcagcgccagcagcggccacaccacccccctgcccgtgaccgacgccagcagcgtgagcaccggccacgccaccagcctgcccgtgaccgacgccagcagcgtgagcaccggccacgccacccccctgcccgtgaccgacgccagcagcgtgagcaccggccacgccacccccctgcccctgaccagcctgagcagcgtgagcaccggcgacaccacccccctgcccgtgaccgacaccagcagcgccagcaccggccaggccacccccctgcccgtgaccagcctgagcagcgtgagcaccggcgacaccacccccctgcccgtgaccgacaccagcagcgccagcaccggccacgccaccagcctgcccgtgaccgacaccagcagcgccagcaccggccacgccacccccctgcccgacaccgacaccagcagcgccagcaccggccacgccaccctgctgcccgtgaccgacaccagcagcgccagcatcggccacgccaccagcctgcccgtgaccgacaccagcagcatcagcaccggccacgccacccccctgcacgtgaccagccccagcagcgccagcaccggccacgccacccccctgcccgtgaccgacaccagcagcgccagcaccggccacgccaaccccctgcacgtgaccagccccagcagcgccagcaccggccacgccacccccctgcccgtgaccgacaccagcagcgccagcaccggccacgccacccccctgcccgtgaccagcctgagcagcgtgagcaccggcgacaccacccccctgcccgtgaccagccccagcagcgccagcaccggccacaccacccccctgcccgtgaccgacaccagcagcgccagcaccggccaggccaccgccctgcccgtgaccagcaccagcagcgccagcaccggcgacaccacccccctgcccgtgaccgacaccagcagcgccagcaccggccaggccacccccctgcccgtgaccagcctgagcagcgtgagcaccggcgacaccacccccctgcccgtgaccagccccagcagcgccagcaccggccacgccacccccctgctggtgaccgacgccagcagcgccagcaccggccaggccacccccctgcccgtgaccagcctgagcagcgtgagcaccggcgacaccacccccctgcccgtgaccagccccagcagcgccagcaccggccacgccaccagcctgcccgtgaccgacaccagcagcgccagcaccggcgacaccaccagcctgcccgtgaccgacaccagcagcgcctacaccggcgacaccaccagcctgcccgtgaccgacaccagcagcagcagcaccggcgacaccacccccctgctggtgaccgagaccagcagcgtgagcaccggccacgccacccccctgctggtgaccgacgccagcagcgccagcaccggccacgccacccccctgcacgtgaccagccccagcagcgccagcaccggcgacaccacccccgtgcccgtgaccgacaccagcagcgtgagcaccggccacgccacccccctgcccgtgaccggcctgagcagcgccagcaccggcgacaccaccagactgcccgtgaccgacatcagcagcgccagcaccggccaggccacccccctgcccgtgaccaacaccagcagcgtgagcaccggcgacaccatgcccctgcccgtgaccagccccagcagcgccagcaccggccacgccacccccctgcccgtgaccagcaccagcagcgccagcaccggccacgccacccccgtgcccgtgaccagcaccagcagcgccagcaccggccacaccacccccctgcccgtgaccgacaccagcagcgccagcaccggcgacaccacccccctgcccgtgaccagccccagcagcgccagcaccggccacaccacccccctgcacgtgaccatccccagcagcgccagcaccggcgacaccagcaccctgcccgtgaccggcgccagcagcgccagcaccggccacgccacccccctgcccgtgaccgacaccagcagcgtgagcaccggccacgccacccccctgcccgtgaccagcctgagcagcgtgagcaccggcgacaccacccccctgcccgtgaccgacgccagcagcgccagcaccggccaggccacccccctgcccgtgaccagcctgagcagcgtgagcaccggcgacaccacccccctgctggtgaccgacgccagcagcgtgagcaccggccacgccacccccctgcccgtgaccgacaccagcagcgccagcaccggcgacaccaccagactgcccgtgaccgacaccagcagcgccagcaccggccaggccacccccctgcccgtgaccagcctgagcagcgtgagcaccggcgacaccacccccctgctggtgaccgacgccagcagcgtgagcaccggccacgccacccccctgcccgtgaccgacaccagcagcgccagcaccggcgacaccaccagactgcccgtgaccgacaccagcagcgccagcaccggccaggccacccccctgcccgtgaccatccccagcagcagcagcagcggccacaccacccccctgcccgtgaccagcaccagcagcgtgagcaccggccacgtgacccccctgcacgtgaccagccccagcagcgccagcaccggccacgtgacccccctgcccgtgaccagcaccagcagcgccagcaccggccacgccacccccctgctggtgaccgacgccagcagcgtgagcaccggccacgccacccccctgcccgtgaccgacgccagcagcgccagcaccggcgacaccacccccctgcccgtgaccgacaccagcagcgccagcaccggccaggccacccccctgcccgtgaccagcctgagcagcgtgagcaccggcgacaccacccccctgcccgtgaccgacgccagcagcgccagcaccggccacgccacccccctgcccgtgaccatccccagcagcgtgagcaccggcgacaccatgcccctgcccgtgaccagccccagcagcgccagcaccggccacgccacccccctgcccgtgaccggcctgagcagcgccagcaccggcgacaccacccccctgcccgtgaccgacaccagcagcgccagcaccagacacgccacccccctgcccgtgaccgacaccagcagcgccagcaccgacgacaccaccagactgcccgtgaccgacgtgagcagcgccagcaccggccacgccacccccctgcccgtgaccagcaccagcagcgccagcaccggcgacaccacccccctgcccgtgaccgacaccagcagcgtgagcaccggccacgccaccagcctgcccgtgaccagcagaagcagcgccagcaccggccacgccacccccctgcccgtgaccgacaccagcagcgtgagcaccggccacgccacccccctgcccgtgaccagcaccagcagcgtgagcaccggccacgccacccccctgcccgtgaccagccccagcagcgccagcaccggccacgccacccccgtgcccgtgaccagcaccagcagcgccagcaccggcgacaccacccccctgcccgtgaccaacgccagcagcctgagcaccggccacgccacccccctgcacgtgaccagccccagcagcgccagcagaggcgacaccagcaccctgcccgtgaccgacgccagcagcgccagcaccggccacgccacccccctgcccctgaccagcctgagcagcgtgagcaccggcgacaccacccccctgcccgtgaccgacaccagcagcgccagcaccggccaggccacccccctgcccgtgaccagcctgagcagcgtgagcaccggcgacaccacccccctgcccgtgaccatccccagcagcgccagcagcggccacaccaccagcctgcccgtgaccgacgccagcagcgtgagcaccggccacggcacccccctgcccgtgaccagcaccagcagcgccagcaccggcgacaccacccccctgcccgtgaccgacaccagcagcgccagcaccggccacgccacccccctgcccgtgaccgacaccagcagcgccagcaccggccacgccacccccctgcccgtgaccagcctgagcagcgtgagcaccggccacgccacccccctggccgtgagcagcgccaccagcgccagcaccgtgagcagcgacagccccctgaagatggagacccccggcatgaccacccccagcctgaagaccgacggcggcagaagaaccgccaccagccccccccccaccaccagccagaccatcatcagcaccatccccagcaccgccatgcacaccagaagcaccgccgcccccatccccatcctgcccgagagaggcgtgagcctgttcccctacggcgccggcgccggcgacctggagttcgtgagaagaaccgtggacttcaccagccccctgttcaagcccgccaccggcttccccctgggcagcagcctgagagacagcctgtacttcaccgacaacggccagatcatcttccccgagagcgactaccagatcttcagctaccccaaccccctgcccaccggcttcaccggcagagaccccgtggccctggtggcccccttctgggacgacgccgacttcagcaccggcagaggcaccaccttctaccaggagtacgagaccttctacggcgagcacagcctgctggtgcagcaggccgagagctggatcagaaagatgaccaacaacggcggctacaaggccagatgggccctgaaggtgacctgggtgaacgcccacgcctaccccgcccagtggaccctgggcagcaacacctaccaggccatcctgagcaccgacggcagcagaagctacgccctgttcctgtaccagagcggcggcatgcagtgggacgtggcccagagaagcggcaaccccgtgctgatgggcttcagcagcggcgacggctacttcgagaacagccccctgatgagccagcccgtgtgggagagatacagacccgacagattcctgaacagcaacagcggcctgcagggcctgcagttctacagactgcacagagaggagagacccaactacagactggagtgcctgcagtggctgaagagccagcccagatggcccagctggggctggaaccaggtgagctgcccctgcagctggcagcagggcagaagagacctgagattccagcccgtgagcatcggcagatggggcctgggcagcagacagctgtgcagcttcaccagctggagaggcggcgtgtgctgcagctacggcccctggggcgagttcagagagggctggcacgtgcagagaccctggcagctggcccaggagctggagccccagagctggtgctgcagatggaacgacaagccctacctgtgcgccctgtaccagcagagaagaccccacgtgggctgcgccacctacagacccccccagcccgcctggatgttcggcgacccccacatcaccaccctggacggcgtgagctacaccttcaacggcctgggcgacttcctgctggtgggcgcccaggacggcaacagcagcttcctgctgcagggcagaaccgcccagaccggcagcgcccaggccaccaacttcatcgccttcgccgcccagtacagaagcagcagcctgggccccgtgaccgtgcagtggctgctggagccccacgacgccatcagagtgctgctggacaaccagaccgtgaccttccagcccgaccacgaggacggcggcggccaggagaccttcaacgccaccggcgtgctgctgagcagaaacggcagcgaggtgagcgccagcttcgacggctgggccaccgtgagcgtgatcgccctgagcaacatcctgcacgccagcgccagcctgccccccgagtaccagaacagaaccgagggcctgctgggcgtgtggaacaacaaccccgaggacgacttcagaatgcccaacggcagcaccatcccccccggcagccccgaggagatgctgttccacttcggcatgacctggcagatcaacggcaccggcctgctgggcaagagaaacgaccagctgcccagcaacttcacccccgtgttctacagccagctgcagaagaacagcagctgggccgagcacctgatcagcaactgcgacggcgacagcagctgcatctacgacaccctggccctgagaaacgccagcatcggcctgcacaccagagaggtgagcaagaactacgagcaggccaacgccaccctgaaccagtacccccccagcatcaacggcggcagagtgatcgaggcctacaagggccagaccaccctgatccagtacaccagcaacgccgaggacgccaacttcaccctgagagacagctgcaccgacctggagctgttcgagaacggcaccctgctgtggacccccaagagcctggagcccttcaccctggagatcctggccagaagcgccaagatcggcctggccagcgccctgcagcccagaaccgtggtgtgccactgcaacgccgagagccagtgcctgtacaaccagaccagcagagtgggcaacagcagcctggaggtggccggctgcaagtgcgacggcggcaccttcggcagatactgcgagggcagcgaggacgcctgcgaggagccctgcttccccagcgtgcactgcgtgcccggcaagggctgcgaggcctgcccccccaacctgaccggcgacggcagacactgcgccgccctgggcagcagcttcctgtgccagaaccagagctgccccgtgaactactgctacaaccagggccactgctacatcagccagaccctgggctgccagcccatgtgcacctgcccccccgccttcaccgacagcagatgcttcctggccggcaacaacttcagccccaccgtgaacctggagctgcccctgagagtgatccagctgctgctgagcgaggaggagaacgccagcatggccgaggtgaacgccagcgtggcctacagactgggcaccctggacatgagagccttcctgagaaacagccaggtggagagaatcgacagcgccgcccccgccagcggcagccccatccagcactggatggtgatcagcgagttccagtacagacccagaggccccgtgatcgacttcctgaacaaccagctgctggccgccgtggtggaggccttcctgtaccacgtgcccagaagaagcgaggagcccagaaacgacgtggtgttccagcccatcagcggcgaggacgtgagagacgtgaccgccctgaacgtgagcaccctgaaggcctacttcagatgcgacggctacaagggctacgacctggtgtacagcccccagagcggcttcacctgcgtgagcccctgcagcagaggctactgcgaccacggcggccagtgccagcacctgcccagcggccccagatgcagctgcgtgagcttcagcatctacaccgcctggggcgagcactgcgagcacctgagcatgaagctggacgccttcttcggcatcttcttcggcgccctgggcggcctgctgctgctgggcgtgggcaccttcgtggtgctgagattctggggctgcagcggcgccagattcagctacttcctgaacagcgccgaggccctgccctag

SEQ ID NO: 89535 - DNA, 16083 bp, Artificial Sequence
  Description of Artificial Sequence: Synthetic coding sequence
atgaagggcgccagatggagaagagtgccctgggtgagcctgagctgcctgtgcctgtgcctgctgccccacgtggtgcccggcaccaccgaggacaccctgatcaccggcagcaagaccgccgcccccgtgaccagcaccggcagcaccaccgccaccctggagggccagagcaccgccgccagcagcagaaccagcaaccaggacatcagcgccagcagccagaaccaccagaccaagagcaccgagaccaccagcaaggcccagaccgacaccctgacccagatgatgaccagcaccctgttcagcagccccagcgtgcacaacgtgatggagaccgccccccccgacgagatgaccaccagcttccccagcagcgtgaccaacaccctgatgatgaccagcaagaccatcaccatgaccaccagcaccgacagcaccctgggcaacaccgaggagaccagcaccgccggcaccgagagcagcacccccgtgaccagcgccgtgagcatcaccgccggccaggagggccagagcagaaccaccagctggagaaccagcatccaggacaccagcgccagcagccagaaccactggaccagaagcacccagaccaccagagagagccagaccagcaccctgacccacagaaccaccagcacccccagcttcagccccagcgtgcacaacgtgaccggcaccgtgagccagaagaccagccccagcggcgagaccgccaccagcagcctgtgcagcgtgaccaacaccagcatgatgaccagcgagaagatcaccgtgaccaccagcaccggcagcaccctgggcaaccccggcgagaccagcagcgtgcccgtgaccggcagcctgatgcccgtgaccagcgccgccctggtgaccttcgaccccgagggccagagccccgccaccttcagcagaaccagcacccaggacaccaccgccttcagcaagaaccaccagacccagagcgtggagaccaccagagtgagccagatcaacaccctgaacaccctgacccccgtgaccaccagcaccgtgctgagcagccccagcggcttcaaccccagcggcaccgtgagccaggagaccttccccagcggcgagaccaccaccagcagccccagcagcgtgagcaacaccttcctggtgaccagcaaggtgttcagaatgcccaccagcagagacagcaccctgggcaacaccgaggagaccagcctgagcgtgagcggcaccatcagcgccatcaccagcaaggtgagcaccatctggtggagcgacaccctgagcaccgccctgagccccagcagcctgccccccaagatcagcaccgccttccacacccagcagagcgagggcgccgagaccaccggcagaccccacgagagaagcagcttcagccccggcgtgagccaggagatcttcaccctgcacgagaccaccacctggcccagcagcttcagcagcaagggccacaccacctggagccagaccgagctgcccagcaccagcaccggcgccgccaccagactggtgaccggcaaccccagcaccggcaccgccggcaccatccccagagtgcccagcaaggtgagcgccatcggcgagcccggcgagcccaccacctacagcagccacagcaccaccctgcccaagaccaccggcgccggcgcccagacccagtggacccaggagaccggcaccaccggcgaggccctgctgagcagccccagctacagcgtgacccagatgatcaagaccgccaccagccccagcagcagccccatgctggacagacacaccagccagcagatcaccaccgcccccagcaccaaccacagcaccatccacagcaccagcaccagcccccaggagagccccgccgtgagccagagaggccacacccaggccccccagaccacccaggagagccagaccaccagaagcgtgagccccatgaccgacaccaagaccgtgaccacccccggcagcagcttcaccgccagcggccacagccccagcgagatcgtgccccaggacgcccccaccatcagcgccgccaccaccttcgcccccgcccccaccggcgacggccacaccacccaggcccccaccaccgccctgcaggccgcccccagcagccacgacgccaccctgggccccagcggcggcaccagcctgagcaagaccggcgccctgaccctggccaacagcgtggtgagcacccccggcggccccgagggccagtggaccagcgccagcgccagcaccagccccgacaccgccgccgccatgacccacacccaccaggccgagagcaccgaggccagcggccagacccagaccagcgagcccgccagcagcggcagcagaaccaccagcgccggcaccgccacccccagcagcagcggcgccagcggcaccacccccagcggcagcgagggcatcagcaccagcggcgagaccaccagattcagcagcaaccccagcagagacagccacaccacccagagcaccaccgagctgctgagcgccagcgccagccacggcgccatccccgtgagcaccggcatggccagcagcatcgtgcccggcaccttccaccccaccctgagcgaggccagcaccgccggcagacccaccggccagagcagccccaccagccccagcgccagcccccaggagaccgccgccatcagcagaatggcccagacccagagaaccagaaccagcagaggcagcgacaccatcagcctggccagccaggccaccgacaccttcagcaccgtgccccccaccccccccagcatcaccagcaccggcctgaccagcccccagaccgagacccacaccctgagccccagcggcagcggcaagaccttcaccaccgccctgatcagcaacgccacccccctgcccgtgacctacgccagcagcgccagcaccggccacaccacccccctgcacgtgaccgacgccagcagcgtgagcaccggccacgccacccccctgcccgtgaccagccccagcagcgtgagcaccggccacaccacccccctgcccgtgaccgacaccagcagcgagagcaccggccacgtgacccccctgcccgtgaccagcttcagcagcgccagcaccggcgacagcacccccctgcccgtgaccgacaccagcagcgccagcaccggccacgtgacccccctgcccgtgaccagcctgagcagcgccagcaccggcgacaccacccccctgcccgtgaccgacaccagcagcgccagcaccggccacgccaccagcctgcccgtgaccgacaccagcagcgtgagcaccggccacaccacccccctgcccgtgaccgacaccagcagcgccagcaccggccacgccaccagcctgcccgtgaccgacaccagcagcgtgagcaccggccacaccacccccctgcacgtgaccgacgccagcagcgccagcaccggccaggccacccccctgcccgtgaccagcctgagcagcgtgagcaccggcgacaccacccccctgcccgtgaccagccccagcagcgccagcaccggccacgccacccccctgctggtgaccgacaccagcagcgccagcaccggccacgccacccccctgcccgtgaccgacgccagcagcgtgagcaccgaccacgccaccagcctgcccgtgaccatccccagcgccgccagcaccggccacaccacccccctgcccgtgaccgacaccagcagcgccagcaccggccaggccaccagcctgctggtgaccgacaccagcagcgtgagcaccggcgacaccacccccctgcccgtgaccagcaccagcagcgccagcaccggccacgtgacccccctgcacgtgaccagccccagcagcgccagcaccggccacgccacccccctgcccgtgaccagcctgagcagcgccagcaccggcgacaccatgcccctgcccgtgaccagccccagcagcgccagcaccggcgacaccacccccctgcccgtgaccgacgccagcagcgtgagcaccggccacaccacccccctgcacgtgaccgacgccagcagcgccagcaccggccaggccacccccctgcccgtgaccagcctgagcagcgtgagcaccggcgacaccacccccctgcccgtgaccagccccagcagcgccagcaccggccacgccacccccctgctggtgaccgacaccagcagcgccagcaccggccacgccacccccctgcccgtgaccgacgccagcagcgtgagcaccgaccacgccaccagcctgcccgtgaccatccccagcgccgccagcaccggccacaccacccccctgcccgtgaccgacaccagcagcgccagcaccggccaggccaccagcctgctggtgaccgacaccagcagcgtgagcaccggcgacaccacccccctgcccgtgaccagcaccagcagcgccagcaccggccacgtgacccccctgcacgtgaccagccccagcagcgccagcaccggccacgccacccccctgcccgtgaccagcctgagcagcgccagcaccggcgacaccatgcccctgcccgtgaccagccccagcagcgccagcaccggcgacaccacccccctgcccgtgaccgacgccagcagcgtgagcaccggccacaccacccccctgcccgtgaccagccccagcagcgccagcaccggccacaccacccccctgcccgtgaccgacaccagcagcgccagcaagggcgacaccacccccctgcccgtgaccagccccagcagcgccagcaccggccacaccacccccctgcccgtgaccgacaccagcagcgccagcaccggcgacaccacccccctgcccgtgaccaacgccagcagcctgagcaccggccacgccacccccctgcacgtgaccagccccagcagcgccagcaccggccacgccacccccctgcccgtgaccagcaccagcagcgccagcaccggccacgccacccccctgcccgtgaccggcctgagcagcgccaccaccgacgacaccaccagactgcccgtgaccgacgtgagcagcgccagcaccggccaggccacccccctgcccgtgaccagcctgagcagcgtgagcaccggcgacaccacccccctgcccgtgaccagccccagcagcgccagcaccggccacgccagccccctgctggtgaccgacgccagcagcgccagcaccggccaggccacccccctgcccgtgaccgacaccagcagcgtgagcaccgcccacgccacccccctgcccgtgaccggcctgagcagcgccagcaccgacgacaccaccagactgcccgtgaccgacgtgagcagcgccagcaccggccaggccatccccctgcccgtgaccagccccagcagcgccagcaccggcgacaccacccccctgcccgtgaccgacgccagcagcgccagcaccggcgacaccaccagcctgcccgtgaccatccccagcagcgccagcagcggccacaccaccagcctgcccgtgaccgacgccagcagcgtgagcaccggccacgccaccagcctgctggtgaccgacgccagcagcgtgagcaccggcgacaccacccccctgcccgtgaccgacaccaacagcgccagcaccggcgacaccacccccctgcacgtgaccgacgccagcagcgtgagcaccggccacgccaccagcctgcccgtgaccagcctgagcagcgccagcaccggcgacaccacccccctgcccgtgaccagccccagcagcgccagcagcggccacaccacccccctgcccgtgaccgacgccagcagcgtgcccaccggccacgccaccagcctgcccgtgaccgacgccagcagcgtgagcaccggccacgccacccccctgcccgtgaccgacgccagcagcgtgagcaccggccacgccacccccctgcccgtgaccgacaccagcagcgtgagcaccggccaggccacccccctgcccgtgaccagcctgagcagcgccagcaccggcgacaccacccccctgcccgtgaccgacaccagcagcgccagcaccggccaggacacccccctgcccgtgaccagcctgagcagcgtgagcaccggcgacaccacccccctgcccgtgaccaaccccagcagcgccagcaccggccacgccacccccctgctggtgaccgacgccagcagcatcagcaccggccacgccaccagcctgctggtgaccgacgccagcagcgtgagcaccggccacgccaccgccctgcacgacaccgacgccagcagcctgagcaccggcgacaccacccccctgcccgtgaccagccccagcagcaccagcaccggcgacaccacccccctgcccgtgaccgagaccagcagcgtgagcaccggccacgccaccagcctgcccgtgaccgacaccagcagcgccagcaccggccacgccaccagcctgcccgtgaccgacaccagcagcgccagcaccggccacgccacccccctgcccgtgaccgacaccagcagcgccagcaccggccaggccacccccctgcccgtgaccagccccagcagcgccagcaccggccacgccatccccctgctggtgaccgacaccagcagcgccagcaccggccaggccacccccctgcccgtgaccagcctgagcagcgccagcaccggcgacaccacccccctgcccgtgaccgacgccagcagcgtgagcaccggccacgccaccagcctgcccgtgaccagcctgagcagcgtgagcaccggcgacaccacccccctgcccgtgaccagccccagcagcgccagcaccggccacgccacccccctgcacgtgaccgacgccagcagcgccagcaccggccacgccacccccctgcccgtgaccagcctgagcagcgccagcaccggcgacaccacccccctgcccgtgaccagccccagcagcgccagcaccggccacgccacccccctgcacgtgaccgacgccagcagcgtgagcaccggcgacaccacccccctgcccgtgaccagcagcagcagcgccagcagcggccacaccacccccctgcccgtgaccgacgccagcagcgccagcaccggcgacaccacccccctgcccgtgaccgacaccagcagcgccagcaccggccacgccacccacctgcccgtgaccggcctgagcagcgccagcaccggcgacaccaccagactgcccgtgaccaacgtgagcagcgccagcaccggccacgccacccccctgcccgtgaccagcaccagcagcgccagcaccggcgacaccacccccctgcccggcaccgacaccagcagcgtgagcaccggccacaccacccccctgctggtgaccgacgccagcagcgtgagcaccggcgacaccaccagactgcccgtgaccagccccagcagcgccagcaccggccacaccacccccctgcccgtgaccgacacccccagcgccagcaccggcgacaccacccccctgcccgtgaccaacgccagcagcctgagcaccagacacgccaccagcctgcacgtgaccagccccagcagcgccagcaccggccacgccaccagcctgcccgtgaccgacaccagcgccgccagcaccggccacgccacccccctgcccgtgaccagcaccagcagcgccagcaccggcgacaccacccccctgcccgtgaccgacacctacagcgccagcaccggccaggccacccccctgcccgtgaccagcctgagcagcgtgagcaccggcgacaccacccccctgcccgtgaccagccccagcagcgccagcaccggccacgccacccccctgctggtgaccgacgccagcagcgccagcaccggccaggccacccccctgcccgtgaccagcctgagcagcgtgagcaccggcgacaccacccccctgcccgtgaccagccccagcagcgccagcaccggccacgccaccagcctgcccgtgaccgacaccagcagcgccagcaccggcgacaccaccagcctgcccgtgaccgacaccagcagcgcctacaccggcgacaccaccagcctgcccgtgaccgacaccagcagcagcagcaccggcgacaccacccccctgctggtgaccgagaccagcagcgtgagcaccggcgacaccacccccctgcccgtgaccgacaccagcagcgccagcaccggccacgccacccccctgcccgtgaccaacaccagcagcgtgagcaccggccacgccacccccctgcacgtgaccagccccagcagcgccagcaccggccacaccacccccctgcccgtgaccgacgccagcagcgtgagcaccggccacgccaccagcctgcccgtgaccgacgccagcagcgtgttcaccggccacgccaccagcctgcccgtgaccatccccagcagcgccagcagcggccacaccacccccctgcccgtgaccgacgccagcagcgtgagcaccggccacgccaccagcctgcccgtgaccgacgccagcagcgtgagcaccggccacgccacccccctgcccgtgaccgacgccagcagcgtgagcaccggccacgccacccccctgcccctgaccagcctgagcagcgtgagcaccggcgacaccacccccctgcccgtgaccgacaccagcagcgccagcaccggccaggccacccccctgcccgtgaccagcctgagcagcgtgagcaccggcgacaccacccccctgcccgtgaccgacaccagcagcgccagcaccggccacgccaccagcctgcccgtgaccgacaccagcagcgccagcaccggccacgccacccccctgcccgacaccgacaccagcagcgccagcaccggccacgccaccctgctgcccgtgaccgacaccagcagcgccagcatcggccacgccaccagcctgcccgtgaccgacaccagcagcatcagcaccggccacgccacccccctgcacgtgaccagccccagcagcgccagcaccggccacgccacccccctgcccgtgaccgacaccagcagcgccagcaccggccacgccaaccccctgcacgtgaccagccccagcagcgccagcaccggccacgccacccccctgcccgtgaccgacaccagcagcgccagcaccggccacgccacccccctgcccgtgaccagcctgagcagcgtgagcaccggcgacaccacccccctgcccgtgaccagccccagcagcgccagcaccggccacaccacccccctgcccgtgaccgacaccagcagcgccagcaccggccaggccaccgccctgcccgtgaccagcaccagcagcgccagcaccggcgacaccacccccctgcccgtgaccgacaccagcagcgccagcaccggccaggccacccccctgcccgtgaccagcctgagcagcgtgagcaccggcgacaccacccccctgcccgtgaccagccccagcagcgccagcaccggccacgccacccccctgctggtgaccgacgccagcagcgccagcaccggccaggccacccccctgcccgtgaccagcctgagcagcgtgagcaccggcgacaccacccccctgcccgtgaccagccccagcagcgccagcaccggccacgccaccagcctgcccgtgaccgacaccagcagcgccagcaccggcgacaccaccagcctgcccgtgaccgacaccagcagcgcctacaccggcgacaccaccagcctgcccgtgaccgacaccagcagcagcagcaccggcgacaccacccccctgctggtgaccgagaccagcagcgtgagcaccggccacgccacccccctgctggtgaccgacgccagcagcgccagcaccggccacgccacccccctgcacgtgaccagccccagcagcgccagcaccggcgacaccacccccgtgcccgtgaccgacaccagcagcgtgagcaccggccacgccacccccctgcccgtgaccggcctgagcagcgccagcaccggcgacaccaccagactgcccgtgaccgacatcagcagcgccagcaccggccaggccacccccctgcccgtgaccaacaccagcagcgtgagcaccggcgacaccatgcccctgcccgtgaccagccccagcagcgccagcaccggccacgccacccccctgcccgtgaccagcaccagcagcgccagcaccggccacgccacccccgtgcccgtgaccagcaccagcagcgccagcaccggccacaccacccccctgcccgtgaccgacaccagcagcgccagcaccggcgacaccacccccctgcccgtgaccagccccagcagcgccagcaccggccacaccacccccctgcacgtgaccatccccagcagcgccagcaccggcgacaccagcaccctgcccgtgaccggcgccagcagcgccagcaccggccacgccacccccctgcccgtgaccgacaccagcagcgtgagcaccggccacgccacccccctgcccgtgaccagcctgagcagcgtgagcaccggcgacaccacccccctgcccgtgaccgacgccagcagcgccagcaccggccaggccacccccctgcccgtgaccagcctgagcagcgtgagcaccggcgacaccacccccctgctggtgaccgacgccagcagcgtgagcaccggccacgccacccccctgcccgtgaccgacaccagcagcgccagcaccggcgacaccaccagactgcccgtgaccgacaccagcagcgccagcaccggccaggccacccccctgcccgtgaccagcctgagcagcgtgagcaccggcgacaccacccccctgctggtgaccgacgccagcagcgtgagcaccggccacgccacccccctgcccgtgaccgacaccagcagcgccagcaccggcgacaccaccagactgcccgtgaccgacaccagcagcgccagcaccggccaggccacccccctgcccgtgaccatccccagcagcagcagcagcggccacaccacccccctgcccgtgaccagcaccagcagcgtgagcaccggccacgtgacccccctgcacgtgaccagccccagcagcgccagcaccggccacgtgacccccctgcccgtgaccagcaccagcagcgccagcaccggccacgccacccccctgctggtgaccgacgccagcagcgtgagcaccggccacgccacccccctgcccgtgaccgacgccagcagcgccagcaccggcgacaccacccccctgcccgtgaccgacaccagcagcgccagcaccggccaggccacccccctgcccgtgaccagcctgagcagcgtgagcaccggcgacaccacccccctgcccgtgaccgacgccagcagcgccagcaccggccacgccacccccctgcccgtgaccatccccagcagcgtgagcaccggcgacaccatgcccctgcccgtgaccagccccagcagcgccagcaccggccacgccacccccctgcccgtgaccggcctgagcagcgccagcaccggcgacaccacccccctgcccgtgaccgacaccagcagcgccagcaccagacacgccacccccctgcccgtgaccgacaccagcagcgccagcaccgacgacaccaccagactgcccgtgaccgacgtgagcagcgccagcaccggccacgccacccccctgcccgtgaccagcaccagcagcgccagcaccggcgacaccacccccctgcccgtgaccgacaccagcagcgtgagcaccggccacgccaccagcctgcccgtgaccagcagaagcagcgccagcaccggccacgccacccccctgcccgtgaccgacaccagcagcgtgagcaccggccacgccacccccctgcccgtgaccagcaccagcagcgtgagcaccggccacgccacccccctgcccgtgaccagccccagcagcgccagcaccggccacgccacccccgtgcccgtgaccagcaccagcagcgccagcaccggcgacaccacccccctgcccgtgaccaacgccagcagcctgagcaccggccacgccacccccctgcacgtgaccagccccagcagcgccagcagaggcgacaccagcaccctgcccgtgaccgacgccagcagcgccagcaccggccacgccacccccctgcccctgaccagcctgagcagcgtgagcaccggcgacaccacccccctgcccgtgaccgacaccagcagcgccagcaccggccaggccacccccctgcccgtgaccagcctgagcagcgtgagcaccggcgacaccacccccctgcccgtgaccatccccagcagcgccagcagcggccacaccaccagcctgcccgtgaccgacgccagcagcgtgagcaccggccacggcacccccctgcccgtgaccagcaccagcagcgccagcaccggcgacaccacccccctgcccgtgaccgacaccagcagcgccagcaccggccacgccacccccctgcccgtgaccgacaccagcagcgccagcaccggccacgccacccccctgcccgtgaccagcctgagcagcgtgagcaccggccacgccacccccctggccgtgagcagcgccaccagcgccagcaccgtgagcagcgacagccccctgaagatggagacccccggcatgaccacccccagcctgaagaccgacggcggcagaagaaccgccaccagccccccccccaccaccagccagaccatcatcagcaccatccccagcaccgccatgcacaccagaagcaccgccgcccccatccccatcctgcccgagagaggcgtgagcctgttcccctacggcgccggcgccggcgacctggagttcgtgagaagaaccgtggacttcaccagccccctgttcaagcccgccaccggcttccccctgggcagcagcctgagagacagcctgtacttcaccgacaacggccagatcatcttccccgagagcgactaccagatcttcagctaccccaaccccctgcccaccggcttcaccggcagagaccccgtggccctggtggcccccttctgggacgacgccgacttcagcaccggcagaggcaccaccttctaccagagcaacacctaccaggccatcctgagcaccgacggcagcagaagctacgccctgttcctgtaccagagcggcggcatgcagtgggacgtggcccagagaagcggcaaccccgtgctgatgggcttcagcagcggcgacggctacttcgagaacagccccctgatgagccagcccgtgtgggagagatacagacccgacagattcctgaacagcaacagcggcctgcagggcctgcagttctacagactgcacagagaggagagacccaactacagactggagtgcctgcagtggctgaagagccagcccagatggcccagctggggctggaaccaggtgagctgcccctgcagctggcagcagggcagaagagacctgagattccagcccgtgagcatcggcagatggggcctgggcagcagacagctgtgcagcttcaccagctggagaggcggcgtgtgctgcagctacggcccctggggcgagttcagagagggctggcacgtgcagagaccctggcagctggcccaggagctggagccccagagctggtgctgcagatggaacgacaagccctacctgtgcgccctgtaccagcagagaagaccccacgtgggctgcgccacctacagacccccccagcccgcctggatgttcggcgacccccacatcaccaccctggacggcgtgagctacaccttcaacggcctgggcgacttcctgctggtgggcgcccaggacggcaacagcagcttcctgctgcagggcagaaccgcccagaccggcagcgcccaggccaccaacttcatcgccttcgccgcccagtacagaagcagcagcctgggccccgtgaccgtgcagtggctgctggagccccacgacgccatcagagtgctgctggacaaccagaccgtgaccttccagcccgaccacgaggacggcggcggccaggagaccttcaacgccaccggcgtgctgctgagcagaaacggcagcgaggtgagcgccagcttcgacggctgggccaccgtgagcgtgatcgccctgagcaacatcctgcacgccagcgccagcctgccccccgagtaccagaacagaaccgagggcctgctgggcgtgtggaacaacaaccccgaggacgacttcagaatgcccaacggcagcaccatcccccccggcagccccgaggagatgctgttccacttcggcatgacctggcagatcaacggcaccggcctgctgggcaagagaaacgaccagctgcccagcaacttcacccccgtgttctacagccagctgcagaagaacagcagctgggccgagcacctgatcagcaactgcgacggcgacagcagctgcatctacgacaccctggccctgagaaacgccagcatcggcctgcacaccagagaggtgagcaagaactacgagcaggccaacgccaccctgaaccagtacccccccagcatcaacggcggcagagtgatcgaggcctacaagggccagaccaccctgatccagtacaccagcaacgccgaggacgccaacttcaccctgagagacagctgcaccgacctggagctgttcgagaacggcaccctgctgtggacccccaagagcctggagcccttcaccctggagatcctggccagaagcgccaagatcggcctggccagcgccctgcagcccagaaccgtggtgtgccactgcaacgccgagagccagtgcctgtacaaccagaccagcagagtgggcaacagcagcctggaggtggccggctgcaagtgcgacggcggcaccttcggcagatactgcgagggcagcgaggacgcctgcgaggagccctgcttccccagcgtgcactgcgtgcccggcaagggctgcgaggcctgcccccccaacctgaccggcgacggcagacactgcgccgccctgggcagcagcttcctgtgccagaaccagagctgccccgtgaactactgctacaaccagggccactgctacatcagccagaccctgggctgccagcccatgtgcacctgcccccccgccttcaccgacagcagatgcttcctggccggcaacaacttcagccccaccgtgaacctggagctgcccctgagagtgatccagctgctgctgagcgaggaggagaacgccagcatggccgaggtgaacgccagcgtggcctacagactgggcaccctggacatgagagccttcctgagaaacagccaggtggagagaatcgacagcgccgcccccgccagcggcagccccatccagcactggatggtgatcagcgagttccagtacagacccagaggccccgtgatcgacttcctgaacaaccagctgctggccgccgtggtggaggccttcctgtaccacgtgcccagaagaagcgaggagcccagaaacgacgtggtgttccagcccatcagcggcgaggacgtgagagacgtgaccgccctgaacgtgagcaccctgaaggcctacttcagatgcgacggctacaagggctacgacctggtgtacagcccccagagcggcttcacctgcgtgagcccctgcagcagaggctactgcgaccacggcggccagtgccagcacctgcccagcggccccagatgcagctgcgtgagcttcagcatctacaccgcctggggcgagcactgcgagcacctgagcatgaagctggacgccttcttcggcatcttcttcggcgccctgggcggcctgctgctgctgggcgtgggcaccttcgtggtgctgagattctggggctgcagcggcgccagattcagctacttcctgaacagcgccgaggccctgccctag

SEQ ID NO: 89536 - DNA, 1863 bp, Artificial Sequence
  Description of Artificial Sequence: Synthetic coding sequence
atgagcgtgggcagaagaaagctggccctgctgtgggccctggccctggccctggcctgcaccagacacaccggccacgcccaggacggcagcagcgagagcagctacaagcaccaccccgccctgagccccatcgccagaggccccagcggcgtgcccctgagaggcgccaccgtgttccccagcctgagaaccatccccgtggtgagagccagcaaccccgcccacaacggcagagtgtgcagcacctggggcagcttccactacaagaccttcgacggcgacgtgttcagattccccggcctgtgcaactacgtgttcagcgagcactgcggcgccgcctacgaggacttcaaccccgccaccccccagcccggcgtgagcggcccccacgccgagcagggcccccacgagggcggctggagaggccaccccgccgaccagggcctgagacccggccagagaccccccggccccgccgccctgcagcccgtgtggggcccccacagcagagccgccgccacccccagatggagacccggctgggccctgagcagctgcggcaccaccatgaccgcctgctgctggctggacaccaagtacgccaacaagctgtgggccctgtggggcctgcagagagacgccagaggccagagagcccccctgccccagcaccaggccgacacccacggcatcagagagcccgccagatggaccacccccagaagcagcgtgagaaccctgagcctgaaccccagaggcaccgcccccctggccctgggcatctgcgaggagctgctgcacggccagctgttcagcggctgcgtggccctggtggacgtgggcagctacctggaggcctgcagacaggacctgtgcttctgcgaggacaccgacctgctgagctgcgtgtgccacaccctggccgagtacagcagacagtgcacccacgccggcggcctgccccaggactggagaggccccgacttctgcccccagaagtgccccaacaacatgcagtaccacgagtgcagaagcccctgcgccgacacctgcagcaaccaggagcacagcagagcctgcgaggaccactgcgtggccggctgcttctgccccgagggcaccgtgctggacgacatcggccagaccggctgcgtgcccgtgagcaagtgcgcctgcgtgtacaacggcgccgcctacgcccccggcgccacctacagcaccgactgcaccaactgcacctgcagcggcggcagatggagctgccaggaggtgccctgccccggcacctgcagcgtgctgggcggcgcccacttcagcaccttcgacggcaagcagtacaccgtgcacggcgactgcagctacgtgctgaccaagccctgcgacagcagcgccttcaccgtgctggccgagctgagaagatgcggcctgaccgacagcgagacctgcctgaagagcgtgaccctgagcctggacggcgtgcagaccgtggtggtgatcaaggccagcggcgaggtgttcctgaaccagatctacacccagctgcccatcagcgccgccaacgtgaccatcttcagacccagcaccttcttcatcatcgcccagaccagcctgggcctgcagctgaacctgcagctggtgcccaccatgcagctgttcatgcagctggcccccaagctgagaggccagacctgcggcctgtgcggcaacttcaacagcatccaggccgacgacttcagaaccctgagcggcgtggtggaggccaccgccgccgccttcttcaacaccttcaagacccaggccgcctgccccaacatcagaaacagcttcgaggacccctgcagcctgagcgtggagaactag

SEQ ID NO: 89537 - DNA, 1872 bp, Artificial Sequence
  Description of Artificial Sequence: Synthetic coding sequence
atgagcgtgggcagaagaaagctggccctgctgtgggccctggccctggccctggcctgcaccagacacaccggccacgcccaggacggcagcagcgagagcagctacaagcaccaccccgccctgagccccatcgccagaggccccagcggcgtgcccctgagaggcgccaccgtgttccccagcctgagaaccatccccgtggtgagagccagcaaccccgcccacaacggcagagtgtgcagcacctggggcagcttccactacaagaccttcgacggcgacgtgttcagattccccggcctgtgcaactacgtgttcagcgagcactgcggcgccgcctacgaggacttcaacatccagctgagaagaagccaggagagcgccgcccccaccctgagcagagtgctgatgaaggtggacggcgtggtgatccagctgaccaagggcagcgtgctggtgaacggccaccccgtgctgctgcccttcagccagagcggcgtgctgatccagcagagcagcagctacaccaaggtggaggccagactgggcctggtgctgatgtggaaccacgacgacagcctgctgctggagctggacaccaagtacgccaacaagacctgcggcctgtgcggcgacttcaacggcatgcccgtggtgagcgagctgctgagccacaacaccaagctgacccccatggagttcggcaacctgcagaagatggacgaccccaccgagcagtgccaggaccccgtgcccgagccccccagaaactgcagcaccggcttcggcatctgcgaggagctgctgcacggccagctgttcagcggctgcgtggccctggtggacgtgggcagctacctggaggcctgcagacaggacctgtgcttctgcgaggacaccgacctgctgagctgcgtgtgccacaccctggccgagtacagcagacagtgcacccacgccggcggcctgccccaggactggagaggccccgacttctgcccccagaagtgccccaacaacatgcagtaccacgagtgcagaagcccctgcgccgacacctgcagcaaccaggagcacagcagagcctgcgaggaccactgcgtggccggctgcttctgccccgagggcaccgtgctggacgacatcggccagaccggctgcgtgcccgtgagcaagtgcgcctgcgtgtacaacggcgccgcctacgcccccggcgccacctacagcaccgactgcaccaactgcacctgcagcggcggcagatggagctgccaggaggtgccctgccccggcacctgcagcgtgctgggcggcgcccacttcagcaccttcgacggcaagcagtacaccgtgcacggcgactgcagctacgtgctgaccaagccctgcgacagcagcgccttcaccgtgctggccgagctgagaagatgcggcctgaccgacagcgagacctgcctgaagagcgtgaccctgagcctggacggcgtgcagaccgtggtggtgatcaaggccagcggcgaggtgttcctgaaccagatctacacccagctgcccatcagcgccgccaacgtgaccatcttcagacccagcaccttcttcatcatcgcccagaccagcctgggcctgcagctgaacctgcagctggtgcccaccatgcagctgttcatgcagctggcccccaagctgagaggccagacctgcggcctgtgcggcaacttcaacagcatccaggccgacgacttcagaaccctgagcggcgtggtggaggccaccgccgccgccttcttcaacaccttcaagacccaggccgcctgccccaacatcagaaacagcttcgaggacccctgcagcctgagcgtggagaactag

SEQ ID NO: 89538 - DNA, 17121 bp, Artificial Sequence
  Description of Artificial Sequence: Synthetic coding sequence
atgggcgcccccagcgcctgcagaaccctggtgctggccctggccgccatgctggtggtgccccaggccgagacccagggccccgtggagcccagctgggagaacgccggccacaccatggacggcggcgcccccaccagcagccccaccagaagagtgagcttcgtgccccccgtgaccgtgttccccagcctgagccccctgaaccccgcccacaacggcagagtgtgcagcacctggggcgacttccactacaagaccttcgacggcgacgtgttcagattccccggcctgtgcaactacgtgttcagcgagcactgcagagccgcctacgaggacttcaacgtgcagctgagaagaggcctggtgggcagcagacccgtggtgaccagagtggtgatcaaggcccagggcctggtgctggaggccagcaacggcagcgtgctgatcaacggccagagagaggagctgccctacagcagaaccggcctgctggtggagcagagcggcgactacatcaaggtgagcatcagactggtgctgaccttcctgtggaacggcgaggacagcgccctgctggagctggaccccaagtacgccaaccagacctgcggcctgtgcggcgacttcaacggcctgcccgccttcaacgagttctacgcccacaacgccagactgacccccctgcagttcggcaacctgcagaagctggacggccccaccgagcagtgccccgaccccctgcccctgcccgccggcaactgcaccgacgaggagggcatctgccacagaaccctgctgggccccgccttcgccgagtgccacgccctggtggacagcaccgcctacctggccgcctgcgcccaggacctgtgcagatgccccacctgcccctgcgccaccttcgtggagtacagcagacagtgcgcccacgccggcggccagcccagaaactggagatgccccgagctgtgccccagaacctgccccctgaacatgcagcaccaggagtgcggcagcccctgcaccgacacctgcagcaacccccagagagcccagctgtgcgaggaccactgcgtggacggctgcttctgcccccccggcagcaccgtgctggacgacatcacccacagcggctgcctgcccctgggccagtgcccctgcacccacggcggcagaacctacagccccggcaccagcttcaacaccacctgcagcagctgcacctgcagcggcggcctgtggcagtgccaggacctgccctgccccggcacctgcagcgtgcagggcggcgcccacatcagcacctacgacgagaagctgtacgacctgcacggcgactgcagctacgtgctgagcaagaagtgcgccgacagcagcttcaccgtgctggccgagctgagaaagtgcggcctgaccgacaacgagaactgcctgaaggccgtgaccctgagcctggacggcggcgacaccgccatcagagtgcaggccgacggcggcgtgttcctgaacagcatctacacccagctgcccctgagcgccgccaacatcaccctgttcacccccagcagcttcttcatcgtggtgcagaccggcctgggcctgcagctgctggtgcagctggtgcccctgatgcaggtgttcgtgagactggaccccgcccaccagggccagatgtgcggcctgtgcggcaacttcaaccagaaccaggccgacgacttcaccgccctgagcggcgtggtggaggccaccggcgccgccttcgccaacacctggaaggcccaggccgcctgcgccaacgccagaaacagcttcgaggacccctgcagcctgagcgtggagaacgagaactacgccagacactggtgcagcagactgaccgaccccaacagcgccttcagcagatgccacagcatcatcaaccccaagcccttccacagcaactgcatgttcgacacctgcaactgcgagagaagcgaggactgcctgtgcgccgccctgagcagctacgtgcacgcctgcgccgccaagggcgtgcagctgagcgactggagagacggcgtgtgcaccaagtacatgcagaactgccccaagagccagagatacgcctacgtggtggacgcctgccagcccacctgcagaggcctgagcgaggccgacgtgacctgcagcgtgagcttcgtgcccgtggacggctgcacctgccccgccggcaccttcctgaacgacgccggcgcctgcgtgcccgcccaggagtgcccctgctacgcccacggcaccgtgctggcccccggcgaggtggtgcacgacgagggcgccgtgtgcagctgcaccggcggcaagctgagctgcctgggcgccagcctgcagaagagcaccggctgcgccgcccccatggtgtacctggactgcagcaacagcagcgccggcacccccggcgccgagtgcctgagaagctgccacaccctggacgtgggctgcttcagcacccactgcgtgagcggctgcgtgtgcccccccggcctggtgagcgacggcagcggcggctgcatcgccgaggaggactgcccctgcgtgcacaacgaggccacctacaagcccggcgagaccatcagagtggactgcaacacctgcacctgcagaaacagaagatgggagtgcagccacagactgtgcctgggcacctgcgtggcctacggcgacggccacttcatcaccttcgacggcgacagatacagcttcgagggcagctgcgagtacatcctggcccaggactactgcggcgacaacaccacccacggcaccttcagaatcgtgaccgagaacatcccctgcggcaccaccggcaccacctgcagcaaggccatcaagctgttcgtggagagctacgagctgatcctgcaggagggcaccttcaaggccgtggccagaggccccggcggcgaccccccctacaagatcagatacatgggcatcttcctggtgatcgagacccacggcatggccgtgagctgggacagaaagaccagcgtgttcatcagactgcaccaggactacaagggcagagtgtgcggcctgtgcggcaacttcgacgacaacgccatcaacgacttcgccaccagaagcagaagcgtggtgggcgacgccctggagttcggcaacagctggaagctgagccccagctgccccgacgccctggcccccaaggacccctgcaccgccaaccccttcagaaagagctgggcccagaagcagtgcagcatcctgcacggccccaccttcgccgcctgcagaagccaggtggacagcaccaagtactacgaggcctgcgtgaacgacgcctgcgcctgcgacagcggcggcgactgcgagtgcttctgcaccgccgtggccgcctacgcccaggcctgccacgacgccggcctgtgcgtgagctggagaacccccgacacctgccccctgttctgcgacttctacaacccccacggcggctgcgagtggcactaccagccctgcggcgccccctgcctgaagacctgcagaaaccccagcggccactgcctggtggacctgcccggcctggagggctgctaccccaagtgcccccccagccagcccttcttcaacgaggaccagatgaagtgcgtggcccagtgcggctgctacgacaaggacggcaactactacgacgtgggcgccagagtgcccaccgccgagaactgccagagctgcaactgcacccccagcggcatccagtgcgcccacagcctggaggcctgcacctgcacctacgaggacagaacctacagctaccaggacgtgatctacaacaccaccgacggcctgggcgcctgcctgatcgccatctgcggcagcaacggcaccatcatcagaaaggccgtggcctgccccggcacccccgccaccacccccttcaccttcaccaccgcctgggtgccccacagcaccaccagccccgccctgcccgtgagcaccgtgtgcgtgagagaggtgtgcagatggagcagctggtacaacggccacagacccgagcccggcctgggcggcggcgacttcgagaccttcgagaacctgagacagagaggctaccaggtgtgccccgtgctggccgacatcgagtgcagagccgcccagctgcccgacatgcccctggaggagctgggccagcaggtggactgcgacagaatgagaggcctgatgtgcgccaacagccagcagagcccccccctgtgccacgactacgagctgagagtgctgtgctgcgagtacgtgccctgcggccccagccccgcccccggcaccagcccccagcccagcctgagcgccagcaccgagcccgccgtgcccacccccacccagaccaccgccaccgagaagaccaccctgtgggtgacccccagcatcagaagcaccgccgccctgaccagccagaccggcagcagcagcggccccgtgaccgtgacccccagcgcccccggcaccaccacctgccagcccagatgccagtggaccgagtggttcgacgaggactaccccaagagcgagcagctgggcggcgacgtggagagctacgacaagatcagagccgccggcggccacctgtgccagcagcccaaggacatcgagtgccaggccgagagcttccccaactggaccctggcccaggtgggccagaaggtgcactgcgacgtgcacttcggcctggtgtgcagaaactgggagcaggagggcgtgttcaagatgtgctacaactacagaatcagagtgctgtgctgcagcgacgaccactgcagaggcagagccaccacccccccccccaccaccgagctggagaccgccaccaccaccaccacccaggccctgttcagcaccccccagcccaccagcagccccggcctgaccagagccccccccgccagcaccaccgccgtgcccaccctgagcgagggcctgaccagccccagatacaccagcaccctgggcaccgccaccaccggcggccccaccacccccgccggcagcaccgagcccaccgtgcccggcgtggccaccagcaccctgcccaccagaagcgccctgcccggcaccaccggcagcctgggcacctggagacccagccagccccccaccctggcccccaccaccatggccaccagcagagccagacccaccggcaccgccagcaccgccagcaaggagcccctgaccaccagcctggcccccaccctgaccagcgagctgagcaccagccaggccgagaccagcacccccagaaccgagaccaccatgagccccctgaccaacaccaccaccagccagggcaccaccagatgccagcccaagtgcgagtggaccgagtggttcgacgtggacttccccaccagcggcgtggccggcggcgacatggagaccttcgagaacatcagagccgccggcggcaagatgtgctgggcccccaagagcatcgagtgcagagccgagaactaccccgaggtgagcatcgaccaggtgggccaggtgctgacctgcagcctggagaccggcctgacctgcaagaacgaggaccagaccggcagattcaacatgtgcttcaactacaacgtgagagtgctgtgctgcgacgactacagccactgccccagcacccccgccaccagcagcaccgccacccccagcagcacccccggcaccacctggatcctgaccaagcccaccaccaccgccaccaccaccgccagcaccggcagcaccgccacccccaccagcaccctgagaaccgcccccccccccaaggtgctgaccaccaccgccaccacccccaccgtgaccagcagcaaggccacccccagcagcagccccggcaccgccaccgccctgcccgccctgagaagcaccgccaccacccccaccgccaccagcgtgacccccatccccagcagcagcctgggcaccacctggaccagactgagccagaccaccacccccaccgccaccatgagcaccgccacccccagcagcacccccgagaccgcccacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcaacaccgtgacccccagcagcgccctgggcaccacccacaccccccccgtgcccaacaccatggccaccacccacggcagaagcctgccccccagcagcccccacaccgtgagaaccgcctggaccagcgccaccagcggcatcctgggcaccacccacatcaccgagcccagcaccgtgaccagccacaccctggccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgagagcaccggcagcaccgccacccccagcagcacccccgccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccaccaccgccaccaccaccggcgccaccggcagcgtggccacccccagcagcacccccggcaccgcccacaccaccaaggtgctgaccaccaccaccaccggcttcaccgccacccccagcagcagccccggcaccgccagaaccctgcccgtgtggatcagcaccaccaccacccccaccaccagaggcagcaccgtgacccccagcagcatccccggcaccacccacacccccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccagagccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccgagcagaccaccgccgccaccaccaccgccaccaccggcagcaccgccatccccagcagcacccccggcaccgcccccccccccaaggtgctgaccagcaccgccaccacccccaccgccaccagcagcaaggccaccagcagcagcagccccagaaccgccaccaccctgcccgtgctgaccagcaccgccaccaagagcaccgccaccagcttcacccccatccccagcttcaccctgggcaccaccggcaccctgcccgagcagaccaccacccccatggccaccatgagcaccatccaccccagcagcacccccgagaccacccacaccagcaccgtgctgaccaccaaggccaccaccaccagagccaccagcagcatgagcacccccagcagcacccccggcaccacctggatcctgaccgagctgaccaccgccgccaccaccaccgccgccaccggccccaccgccacccccagcagcacccccggcaccacctggatcctgaccgagcccagcaccaccgccaccgtgaccgtgcccaccggcagcaccgccaccgccagcagcaccagagccaccgccggcaccctgaaggtgctgaccagcaccgccaccacccccaccgtgatcagcagcagagccacccccagcagcagccccggcaccgccaccgccctgcccgccctgagaagcaccgccaccacccccaccgccaccagcgtgaccgccatccccagcagcagcctgggcaccgcctggaccagactgagccagaccaccacccccaccgccaccatgagcaccgccacccccagcagcacccccgagaccgtgcacaccagcaccgtgctgaccaccaccaccaccaccaccagagccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgccccccagcagcccccacaccgtgagaaccgcctggaccagcgccaccagcggcatcctgggcaccacccacatcaccgagcccagcaccgtgaccagccacacccccgccgccaccaccagcaccacccagcacagcacccccgccctgagcagcccccaccccagcagcagaaccaccgagagcccccccagccccggcaccaccacccccggccacaccagaggcaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccaagctgaccaccaccgccaccaccaccgagagcaccggcagcaccgccacccccagcagcacccccggcgccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgcccacaccagcaccgtgctgaccaccaccgccaccaccaccagagccaccggcagcgtggccacccccagcagcacccccggcaccgcccacaccaccaaggtgcccaccaccaccaccaccggcttcaccgtgacccccagcagcagccccggcaccgccagaaccccccccgtgtggatcagcaccaccaccacccccaccaccagcggcagcaccgtgacccccagcagcgtgcccggcaccacccacacccccaccgtgctgaccaccaccaccaccaccgtggccaccggcagcatggccacccccagcagcagcacccagaccagcggcaccccccccagcctgatcaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgggcgagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgccagcaccggcagcaccgccacccccagcagcacccccggcaccgcccccccccccaaggtgctgaccagccccgccaccacccccaccgccaccagcagcaaggccaccagcagcagcagccccagaaccgccaccaccctgcccgtgctgaccagcaccgccaccaagagcaccgccaccagcgtgacccccatccccagcagcaccctgggcaccaccggcaccctgcccgagcagaccaccacccccgtggccaccatgagcaccatccaccccagcagcacccccgagaccacccacaccagcaccgtgctgaccaccaaggccaccaccaccagagccaccagcagcaccagcacccccagcagcacccccggcaccacctggatcctgaccgagctgaccaccgccgccaccaccaccgccgccaccggccccaccgccacccccagcagcacccccggcaccacctggatcctgaccgagctgaccaccaccgccaccaccaccgccagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccagcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccaccacccccaccaccagcggcagcaccgtgacccccagcagcatccccggcaccacccacaccgccagagtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcacccccgtgctgaccagcaccgccaccacccccgccgccaccagcagcaaggccaccagcagcagcagccccagaaccgccaccaccctgcccgtgctgaccagcaccgccaccaagagcaccgccaccagcttcacccccatccccagcagcaccctgtggaccacctggaccgtgcccgcccagaccaccacccccatgagcaccatgagcaccatccacaccagcagcacccccgagaccacccacaccagcaccgtgctgaccaccaccgccaccatgaccagagccaccaacagcaccgccacccccagcagcaccctgggcaccaccagaatcctgaccgagctgaccaccaccgccaccaccaccgccgccaccggcagcaccgccaccctgagcagcacccccggcaccacctggatcctgaccgagcccagcaccatcgccaccgtgatggtgcccaccggcagcaccgccaccgccagcagcaccctgggcaccgcccacacccccaaggtggtgaccaccatggccaccatgcccaccgccaccgccagcaccgtgcccagcagcagcaccgtgggcaccaccagaacccccgccgtgctgcccagcagcctgcccaccttcagcgtgagcaccgtgagcagcagcgtgctgaccaccctgagacccaccggcttccccagcagccacttcagcaccccctgcttctgcagagccttcggccagttcttcagccccggcgaggtgatctacaacaagaccgacagagccggctgccacttctacgccgtgtgcaaccagcactgcgacatcgacagattccagggcgcctgccccaccagccccccccccgtgagcagcgcccccctgagcagccccagccccgcccccggctgcgacaacgccatccccctgagacaggtgaacgagacctggaccctggagaactgcaccgtggccagatgcgtgggcgacaacagagtggtgctgctggaccccaagcccgtggccaacgtgacctgcgtgaacaagcacctgcccatcaaggtgagcgaccccagccagccctgcgacttccactacgagtgcgagtgcatctgcagcatgtggggcggcagccactacagcaccttcgacggcaccagctacaccttcagaggcaactgcacctacgtgctgatgagagagatccacgccagattcggcaacctgagcctgtacctggacaaccactactgcaccgccagcgccaccgccgccgccgccagatgccccagagccctgagcatccactacaagagcatggacatcgtgctgaccgtgaccatggtgcacggcaaggaggagggcctgatcctgttcgaccagatccccgtgagcagcggcttcagcaagaacggcgtgctggtgagcgtgctgggcaccaccaccatgagagtggacatccccgccctgggcgtgagcgtgaccttcaacggccaggtgttccaggccagactgccctacagcctgttccacaacaacaccgagggccagtgcggcacctgcaccaacaaccagagagacgactgcctgcagagagacggcaccaccgccgccagctgcaaggacatggccaagacctggctggtgcccgacagcagaaaggacggctgctgggcccccaccggcaccccccccaccgccagccccgccgcccccgtgagcagcacccccacccccaccccctgccccccccagcccctgtgcgacctgatgctgagccaggtgttcgccgagtgccacaacctggtgccccccggccccttcttcaacgcctgcatcagcgaccactgcagaggcagactggaggtgccctgccagagcctggaggcctacgccgagctgtgcagagccagaggcgtgtgcagcgactggagaggcgccaccggcggcctgtgcgacctgacctgcccccccaccaaggtgtacaagccctgcggccccatccagcccgccacctgcaacagcagaaaccagagcccccagctggagggcatggccgagggctgcttctgccccgaggaccagatcctgttcaacgcccacatgggcatctgcgtgcaggcctgcccctgcgtgggccccgacggcttccccaagttccccggcgagagatgggtgagcaactgccagagctgcgtgtgcgacgagggcagcgtgagcgtgcagtgcaagcccctgccctgcgacgcccagggccagccccccccctgcaacagacccggcttcgtgaccgtgaccagacccagagccgagaacccctgctgccccgagaccgtgtgcgtgtgcaacaccaccacctgcccccagagcctgcccgtgtgcccccccggccaggagagcatctgcacccaggaggagggcgactgctgccccaccttcagatgcagaccccagctgtgcagctacaacggcaccttctacggcgtgggcgccaccttccccggcgccctgccctgccacatgtgcacctgcctgagcggcgacacccaggaccccaccgtgcagtgccaggaggacgcctgcaacaacaccacctgcccccagggcttcgagtacaagagagtggccggccagtgctgcggcgagtgcgtgcagaccgcctgcctgacccccgacggccagcccgtgcagctgaacgagacctgggtgaacagccacgtggacaactgcaccgtgtacctgtgcgaggccgagggcggcgtgcacctgctgaccccccagcccgccagctgccccgacgtgagcagctgcagaggcagcctgagaaagaccggctgctgctacagctgcgaggaggacagctgccaggtgagaatcaacaccaccatcctgtggcaccagggctgcgagaccgaggtgaacatcaccttctgcgagggcagctgccccggcgccagcaagtacagcgccgaggcccaggccatgcagcaccagtgcacctgctgccaggagagaagagtgcacgaggagaccgtgcccctgcactgccccaacggcagcgccatcctgcacacctacacccacgtggacgagtgcggctgcacccccttctgcgtgcccgcccccatggcccccccccacaccagaggcttccccgcccaggaggccaccgccgtgtag

SEQ ID NO: 89539 - DNA, 16587 bp, Artificial Sequence
  Description of Artificial Sequence: Synthetic coding sequence
gcccccagaatgggcgcccccagcgcctgcagaaccctggtgctggccctggccgccatgctggtggtgccccaggccggcaagagcccccccctgagacccctgagcagaaacagcggcgccggcctggacggcggcgcccccaccagcagccccaccagaagagtgagcttcgtgccccccgtgaccgtgttccccagcctgagcagaaagcagatgctgcccctgcccgccggcaagggcgtgttcgccagccccaagggcggcggccccgacctgggcgtgcagctgccccccgccctgaaccccgcccacaacggcagagtgtgcagcacctggggcgacttccactacaagaccttcgacggcgacgtgttcagattccccggcctgtgcaactacgtgttcagcgagcactgcagagccgcctacgaggacttcaacgtgcagctgagaagaggcctggtgggcagcagacccgtggtgaccagagtggtgatcaaggcccagggcctggtgctggaggccagcaacggcagcgtgctgatcaacggccagagagaggagctgccctacagcagaaccggcctgctggtggagcagagcggcgactacatcaaggtgagcatcagactggtgctgaccttcctgtggaacggcgaggacagcgccctgctggagctggaccccaagtacgccaaccagacctgcggcctgtgcggcgacttcaacggcctgcccgccttcaacgagttctacgcccacaacgccagactgacccccctgcagttcggcaacctgcagaagctggacggccccaccgagcagtgccccgaccccctgcccctgcccgccggcaactgcaccgacgaggagggcatctgccacagaaccctgctgggccccgccttcgccgagtgccacgccctggtggacagcaccgcctacctggccgcctgcgcccaggacctgtgcagatgccccacctgcccctgcgccaccttcgtggagtacagcagacagtgcgcccacgccggcggccagcccagaaactggagatgccccgagctgtgccccagaacctgccccctgaacatgcagcaccaggagtgcggcagcccctgcaccgacacctgcagcaacccccagagagcccagctgtgcgaggaccactgcgtggacggctgcttctgcccccccggcagaagctgcaccgtgctggacgacatcacccacagcggctgcctgcccctgggccagtgcccctgcacccacggcggcagaacctacagccccggcaccagcttcaacaccacctgcagcagctgcacctgcagcggcggcctgtggcagtgccaggacctgccctgccccggcacctgcagcgtgcagggcggcgcccacatcagcacctacgacgagaagctgtacgacctgcacggcgactgcagctacgtgctgagcaagaagtgcgccgacagcagcttcaccgtgctggccgagctgagaaagtgcggcctgaccgacaacgagaactgcctgaaggccgtgaccctgagcctggacggcggcgacaccgccatcagagtgcaggccgacggcggcgtgttcctgaacagcatctacacccagctgcccctgagcgccgccaacatcaccctgttcacccccagcagcttcttcatcgtggtgcagaccggcctgggcctgcagctgctggtgcagctggtgcccctgatgcaggtgttcgtgagactggaccccgcccaccagggccagatgtgcggcctgtgcggcaacttcaaccagaaccaggccgacgacttcaccgccctgagcggcgtggtggaggccaccggcgccgccttcgccaacacctggaaggcccaggccgcctgcgccaacgccagaaacagcttcgaggacccctgcagcctgagcgtggagaacgagaactacgccagacactggtgcagcagactgaccgaccccaacagcgccttcagcagatgccacagcatcatcaaccccaagcccttccacagcaactgcatgttcgacacctgcaactgcgagagaagcgaggactgcctgtgcgccgccctgagcagctacgtgcacgcctgcgccgccaagggcgtgcagctgagcgactggagagacggcgtgtgcaccaagtacatgcagaactgccccaagagccagagatacgcctacgtggtggacgcctgccagcccacctgcagaggcctgagcgaggccgacgtgacctgcagcgtgagcttcgtgcccgtggacggctgcacctgccccgccggcaccttcctgaacgacgccggcgcctgcgtgcccgcccaggagtgcccctgctacgcccacggcaccgtgctggcccccggcgaggtggtgcacgacgagggcgccgtgtgcagctgcaccggcggcaagctgagctgcctgggcgccagcctgcagaagagcaccggctgcgccgcccccatggtgtacctggactgcagcaacagcagcgccggcacccccggcgccgagtgcctgagaagctgccacaccctggacgtgggctgcttcagcacccactgcgtgagcggctgcgtgtgcccccccggcctggtgagcgacggcagcggcggctgcatcgccgaggaggactgcccctgcgtgcacaacgaggccacctacaagcccggcgagaccatcagagtggactgcaacacctgcacctgcagaaacagaagatgggagtgcagccacagactgtgcctgggcacctgcgtggcctacggcgacggccacttcatcaccttcgacggcgacagatacagcttcgagggcagctgcgagtacatcctggcccaggactactgcggcgacaacaccacccacggcaccttcagaatcgtgaccgagaacatcccctgcggcaccaccggcaccacctgcagcaaggccatcaagctgttcgtggaggtgagaaccgcccccgccgtgagcacccccgaccccgccgccaacgagcccgcccccagagaggccagcgtgggcttcagacagagactgccccccctgcagagctacgagctgatcctgcaggagggcaccttcaaggccgtggccagaggccccggcggcgaccccccctacaagatcagatacatgggcatcttcctggtgatcgagacccacggcatggccgtgagctgggacagaaagaccagcgtgttcatcagactgcaccaggactacaagggcagagtgtgcggcctgtgcggcaacttcgacgacaacgccatcaacgacttcgccaccagaagcagaagcgtggtgggcgacgccctggagttcggcaacagctggaagctgagccccagctgccccgacgccctggcccccaaggacccctgcaccgccaaccccttcagaaagagctgggcccagaagcagtgcagcatcctgcacggccccaccttcgccgcctgcagaagccaggtggacagcaccaagtactacgaggcctgcgtgaacgacgcctgcgcctgcgacagcggcggcgactgcgagtgcttctgcaccgccgtggccgcctacgcccaggcctgccacgacgccggcctgtgcgtgagctggagaacccccgacacctgccccctgttctgcgacttctacaacccccacggcggctgcgagtggcactaccagccctgcggcgccccctgcctgaagacctgcagaaaccccagcggccactgcctggtggacctgcccggcctggagggctgctaccccaagtgcccccccagccagcccttcttcaacgaggaccagatgaagtgcgtggcccagtgcggctgctacgacaaggacggcaactactacgacgtgggcgccagagtgcccaccgccgagaactgccagagctgcaactgcacccccagcggcatccagtgcgcccacagcctggaggcctgcacctgcacctacgaggacagaacctacagctaccaggacgtgatctacaacaccaccgacggcctgggcgcctgcctgatcgccatctgcggcagcaacggcaccatcatcagaaaggccgtggcctgccccggcacccccgccaccacccccttcaccttcaccaccgcctgggtgccccacagcaccaccagccccgccctgcccgtgagcaccgtgtgcgtgagagaggtgtgcagatggagcagctggtacaacggccacagacccgagcccggcctgggcggcggcgacttcgagaccttcgagaacctgagacagagaggctaccaggtgtgccccgtgctggccgacatcgagtgcagagccgcccagctgcccgacatgcccctggaggagctgggccagcaggtggactgcgacagaatgagaggcctgatgtgcgccaacagccagcagagcccccccctgtgccacgactacgagctgagagtgctgtgctgcgagtacgtgccctgcggccccagccccgcccccggcaccagcccccagcccagcctgagcgccagcaccgagcccgccgtgcccacccccacccagaccaccgccaccgagaagaccaccctgtgggtgacccccagcatcagaagcaccgccgccctgaccagccagaccggcagcagcagcggccccgtgaccgtgacccccagcgcccccggcaccaccacctgccagcccagatgccagtggaccgagtggttcgacgaggactaccccaagagcgagcagctgggcggcgacgtggagagctacgacaagatcagagccgccggcggccacctgtgccagcagcccaaggacatcgagtgccaggccgagagcttccccaactggaccctggcccaggtgggccagaaggtgcactgcgacgtgcacttcggcctggtgtgcagaaactgggagcaggagggcgtgttcaagatgtgctacaactacagaatcagagtgctgtgctgcagcgacgaccactgcagaggcagagccaccacccccccccccaccaccgagctggagaccgccaccaccaccaccacccaggccctgttcagcaccccccagcccaccagcagccccggcctgaccagagccccccccgccagcaccaccgccgtgcccaccctgagcgagggcctgaccagccccagatacaccagcaccctgggcaccgccaccaccggcggccccaccacccccgccggcagcaccgagcccaccgtgcccggcgtggccaccagcaccctgcccaccagaagcgccctgcccggcaccaccggcagcctgggcacctggagacccagccagccccccaccctggcccccaccaccatggccaccagcagagccagacccaccggcaccgccagcaccgccagcaaggagcccctgaccaccagcctggcccccaccctgaccagcgagctgagcaccagccaggccgagaccagcacccccagaaccgagaccaccatgagccccctgaccaacaccaccaccagccagggcaccaccagatgccagcccaagtgcgagtggaccgagtggttcgacgtggacttccccaccagcggcgtggccggcggcgacatggagaccttcgagaacatcagagccgccggcggcaagatgtgctgggcccccaagagcatcgagtgcagagccgagaactaccccgaggtgagcatcgaccaggtgggccaggtgctgacctgcagcctggagaccggcctgacctgcaagaacgaggaccagaccggcagattcaacatgtgcttcaactacaacgtgagagtgctgtgctgcgacgactacagccactgccccagcacccccgccaccagcagcaccgccacccccagcagcacccccggcaccacctggatcctgaccaagcccaccaccaccgccaccaccaccgccagcaccggcagcaccgccacccccaccagcaccctgagaaccgcccccccccccaaggtgctgaccaccaccgccaccacccccaccgtgaccagcagcaaggccacccccagcagcagccccggcaccgccaccgccctgcccgccctgagaagcaccgccaccacccccaccgccaccagcgtgacccccatccccagcagcagcctgggcaccacctggaccagactgagccagaccaccacccccaccgccaccatgagcaccgccacccccagcagcacccccgagaccgcccacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccacccacaccccccccgtgcccaacaccatggccaccacccacggcagaagcctgccccccagcagcccccacaccgtgagaaccgcctggaccagcgccaccagcggcatcctgggcaccacccacatcaccgagcccagcaccgtgaccagccacaccctggccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgagagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccaccaccgccaccaccaccggcgccaccggcagcgtggccacccccagcagcacccccggcaccgcccacaccaccaaggtgctgaccaccaccaccaccggcttcaccgccacccccagcagcagccccggcaccgccagaaccctgcccgtgtggatcagcaccaccaccacccccaccaccagaggcagcaccgtgacccccagcagcatccccggcaccacccacacccccaccgtgctgaccaccaccaccaccaccgtggccaccggcagcatggccacccccagcagcagcacccagaccagcggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccagagccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccgagcagaccaccgccgccaccaccaccgccaccaccggcagcaccgccatccccagcagcacccccggcaccgcccccccccccaaggtgctgaccagcaccgccaccacccccaccgccaccagcagcaaggccaccagcagcagcagccccagaaccgccaccaccctgcccgtgctgaccagcaccgccaccaagagcaccgccaccagcttcacccccatccccagcttcaccctgggcaccaccggcaccctgcccgagcagaccaccacccccatggccaccatgagcaccatccaccccagcagcacccccgagaccacccacaccagcaccgtgctgaccaccaaggccaccaccaccagagccaccagcagcatgagcacccccagcagcacccccggcaccacctggatcctgaccgagctgaccaccgccgccaccaccaccgccgccaccggccccaccgccacccccagcagcacccccggcaccacctggatcctgaccgagcccagcaccaccgccaccgtgaccgtgcccaccggcagcaccgccaccgccagcagcaccagagccaccgccggcaccctgaaggtgctgaccagcaccgccaccacccccaccgtgatcagcagcagagccacccccagcagcagccccggcaccgccaccgccctgcccgccctgagaagcaccgccaccacccccaccgccaccagcgtgaccgccatccccagcagcagcctgggcaccgcctggaccagactgagccagaccaccacccccaccgccaccatgagcaccgccacccccagcagcacccccgagaccgtgcacaccagcaccgtgctgaccaccaccaccaccaccaccagagccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccacccacaccccccccgtgcccaacaccaccgccaccacccacggcagaagcctgccccccagcagcccccacaccgtgagaaccgcctggaccagcgccaccagcggcatcctgggcaccacccacatcaccgagcccagcaccgtgaccagccacacccccgccgccaccaccagcaccacccagcacagcacccccgccctgagcagcccccaccccagcagcagaaccaccgagagcccccccagccccggcaccaccacccccggccacaccagaggcaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccaagctgaccaccaccgccaccaccaccgagagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgcccacaccagcaccgtgctgaccaccaccgccaccaccaccagagccaccggcagcgtggccacccccagcagcacccccggcaccgcccacaccaccaaggtgcccaccaccaccaccaccggcttcaccgtgacccccagcagcagccccggcaccgccagaaccccccccgtgtggatcagcaccaccaccacccccaccaccagcggcagcaccgtgacccccagcagcgtgcccggcaccacccacacccccaccgtgctgaccaccaccaccaccaccgtggccaccggcagcatggccacccccagcagcagcacccagaccagcggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgggcgagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgccagcaccggcagcaccgccacccccagcagcacccccggcaccgcccccccccccaaggtgctgaccagccccgccaccacccccaccgccaccagcagcaaggccaccagcagcagcagccccagaaccgccaccaccctgcccgtgctgaccagcaccgccaccaagagcaccgccaccagcgtgacccccatccccagcagcaccctgggcaccaccggcaccctgcccgagcagaccaccacccccgtggccaccatgagcaccatccaccccagcagcacccccgagaccacccacaccagcaccgtgctgaccaccaaggccaccaccaccagagccaccagcagcaccagcacccccagcagcacccccggcaccacctggatcctgaccgagctgaccaccgccgccaccaccaccgccgccaccggccccaccgccacccccagcagcacccccggcaccacctggatcctgaccgagctgaccaccaccgccaccaccaccgccagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccagcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccaccaccacccccatgagcaccatgagcaccatccacaccagcagcacccccgagaccacccacaccagcaccgtgctgaccaccaccgccaccatgaccagagccaccaacagcaccgccacccccagcagcaccctgggcaccaccagaatcctgaccgagctgaccaccaccgccaccaccaccgccgccaccggcagcaccgccaccctgagcagcacccccggcaccacctggatcctgaccgagcccagcaccatcgccaccgtgatggtgcccaccggcagcaccgccaccgccagcagcaccctgggcaccgcccacacccccaaggtggtgaccaccatggccaccatgcccaccgccaccgccagcaccgtgcccagcagcagcaccgtgggcaccaccagaacccccgccgtgctgcccagcagcctgcccaccttcagcgtgagcaccgtgagcagcagcgtgctgaccaccctgagacccaccggcttccccagcagccacttcagcaccccctgcttctgcagagccttcggccagttcttcagccccggcgaggtgatctacaacaagaccgacagagccggctgccacttctacgccgtgtgcaaccagcactgcgacatcgacagattccagggcgcctgccccaccagccccccccccgtgagcagcgcccccctgagcagccccagccccgcccccggctgcgacaacgccatccccctgagacaggtgaacgagacctggaccctggagaactgcaccgtggccagatgcgtgggcgacaacagagtggtgctgctggaccccaagcccgtggccaacgtgacctgcgtgaacaagcacctgcccatcaaggtgagcgaccccagccagccctgcgacttccactacgagtgcgagtgcgagtgcgtgggcggcagaggcatcacccccggcgccggcatctgcagcatgtggggcggcagccactacagcaccttcgacggcaccagctacaccttcagaggcaactgcacctacgtgctgatgagagagatccacgccagattcggcaacctgagcctgtacctggacaaccactactgcaccgccagcgccaccgccgccgccgccagatgccccagagccctgagcatccactacaagagcatggacatcgtgctgaccgtgaccatggtgcacggcaaggaggagggcctgatcctgttcgaccagatccccgtgagcagcggcttcagcaagaacggcgtgctggtgagcgtgctgggcaccaccaccatgagagtggacatccccgccctgggcgtgagcgtgaccttcaacggccaggtgttccaggccagactgccctacagcctgttccacaacaacaccgagggccagtgcggcacctgcaccaacaaccagagagacgactgcctgcagagagacggcaccaccgccgccagctgcaaggacatggccaagacctggctggtgcccgacagcagaaaggacggctgctgggcccccaccggcaccccccccaccgccagccccgccgcccccgtgagcagcacccccacccccaccccctgccccccccagcccctgtgcgacctgatgctgagccaggtgttcgccgagtgccacaacctggtgccccccggccccttcttcaacgcctgcatcagcgaccactgcagaggcagactggaggtgccctgccagagcctggaggcctacgccgagctgtgcagagccagaggcgtgtgcagcgactggagaggcgccaccggcggcctgtgcgacctgacctgcccccccaccaaggtgtacaagccctgcggccccatccagcccgccacctgcaacagcagaaaccagagcccccagctggagggcatggccgagggctgcttctgccccgaggaccagatcctgttcaacgcccacatgggcatctgcgtgcaggcctgcccctgcgtgggccccgacggcttccccaagttccccggcgagagatgggtgagcaactgccagagctgcgtgtgcgacgagggcagcgtgagcgtgcagtgcaagcccctgccctgcgacgcccagggccagccccccccctgcaacagacccggcttcgtgaccgtgaccagacccagagccgagaacccctgctgccccgagaccgtgtgcgtgtgcaacaccaccacctgcccccagagcctgcccgtgtgcccccccggccaggagagcatctgcacccaggaggagggcgactgctgccccaccttcagatgcagaccccagctgtgcagctacaacggcaccttctacggcgtgggcgccaccttccccggcgccctgccctgccacatgtgcacctgcctgagcggcgacacccaggaccccaccgtgcagtgccaggaggacgcctgcaacaacaccacctgcccccagggcttcgagtacaagagagtggccggccagtgctgcggcgagtgcgtgcagaccgcctgcctgacccccgacggccagcccgtgcagctgaacgagacctgggtgaacagccacgtggacaactgcaccgtgtacctgtgcgaggccgagggcggcgtgcacctgctgaccccccagcccgccagctgccccgacgtgagcagctgcagaggcagcctgagaaagaccggctgctgctacagctgcgaggaggacagctgccaggtgagaatcaacaccaccatcctgtggcaccagggctgcgagaccgaggtgaacatcaccttctgcgagggcagctgccccggcgccagcaagtacagcgccgaggcccaggccatgcagcaccagtgcacctgctgccaggagagaagagtgcacgaggagaccgtgcccctgcactgccccaacggcagcgccatcctgcacacctacacccacgccgtgcaggtgctgtgcggcctgctggcctggggcctgcaggccggcggccacatcagaggcgccgtgcaggacccccagcagcccctgaaggaccaggaggccagcggcaaggccagacagggcggcggctacagacagaccgtggcctggggcgacaagagcaacgccagagcctggctgcagaagcccgtggtgtgggtgcagagcggcgccttccccacccccggccccgccagcgccctgtgcccctggtag

SEQ ID NO: 89540 - DNA, 17298 bp, Artificial Sequence
  Description of Artificial Sequence: Synthetic coding sequence
atgggcgcccccagcgcctgcagaaccctggtgctggccctggccgccatgctggtggtgccccaggccgagacccagggccccgtggagcccagctgggagaacgccggccacaccatggacggcggcgcccccaccagcagccccaccagaagagtgagcttcgtgccccccgtgaccgtgttccccagcctgagccccctgaaccccgcccacaacggcagagtgtgcagcacctggggcgacttccactacaagaccttcgacggcgacgtgttcagattccccggcctgtgcaactacgtgttcagcgagcactgcagagccgcctacgaggacttcaacgtgcagctgagaagaggcctggtgggcagcagacccgtggtgaccagagtggtgatcaaggcccagggcctggtgctggaggccagcaacggcagcgtgctgatcaacggccagagagaggagctgccctacagcagaaccggcctgctggtggagcagagcggcgactacatcaaggtgagcatcagactggtgctgaccttcctgtggaacggcgaggacagcgccctgctggagctggaccccaagtacgccaaccagacctgcggcctgtgcggcgacttcaacggcctgcccgccttcaacgagttctacgcccacaacgccagactgacccccctgcagttcggcaacctgcagaagctggacggccccaccgagcagtgccccgaccccctgcccctgcccgccggcaactgcaccgacgaggagggcatctgccacagaaccctgctgggccccgccttcgccgagtgccacgccctggtggacagcaccgcctacctggccgcctgcgcccaggacctgtgcagatgccccacctgcccctgcgccaccttcgtggagtacagcagacagtgcgcccacgccggcggccagcccagaaactggagatgccccgagctgtgccccagaacctgccccctgaacatgcagcaccaggagtgcggcagcccctgcaccgacacctgcagcaacccccagagagcccagctgtgcgaggaccactgcgtggacggctgcttctgcccccccggcagaagctgcaccgtgctggacgacatcacccacagcggctgcctgcccctgggccagtgcccctgcacccacggcggcagaacctacagccccggcaccagcttcaacaccacctgcagcagctgcacctgcagcggcggcctgtggcagtgccaggacctgccctgccccggcacctgcagcgtgcagggcggcgcccacatcagcacctacgacgagaagctgtacgacctgcacggcgactgcagctacgtgctgagcaagaagtgcgccgacagcagcttcaccgtgctggccgagctgagaaagtgcggcctgaccgacaacgagaactgcctgaaggccgtgaccctgagcctggacggcggcgacaccgccatcagagtgcaggccgacggcggcgtgttcctgaacagcatctacacccagctgcccctgagcgccgccaacatcaccctgttcacccccagcagcttcttcatcgtggtgcagaccggcctgggcctgcagctgctggtgcagctggtgcccctgatgcaggtgttcgtgagactggaccccgcccaccagggccagatgtgcggcctgtgcggcaacttcaaccagaaccaggccgacgacttcaccgccctgagcggcgtggtggaggccaccggcgccgccttcgccaacacctggaaggcccaggccgcctgcgccaacgccagaaacagcttcgaggacccctgcagcctgagcgtggagaacgagaactacgccagacactggtgcagcagactgaccgaccccaacagcgccttcagcagatgccacagcatcatcaaccccaagcccttccacagcaactgcatgttcgacacctgcaactgcgagagaagcgaggactgcctgtgcgccgccctgagcagctacgtgcacgcctgcgccgccaagggcgtgcagctgagcgactggagagacggcgtgtgcaccaagtacatgcagaactgccccaagagccagagatacgcctacgtggtggacgcctgccagcccacctgcagaggcctgagcgaggccgacgtgacctgcagcgtgagcttcgtgcccgtggacggctgcacctgccccgccggcaccttcctgaacgacgccggcgcctgcgtgcccgcccaggagtgcccctgctacgcccacggcaccgtgctggcccccggcgaggtggtgcacgacgagggcgccgtgtgcagctgcaccggcggcaagctgagctgcctgggcgccagcctgcagaagagcaccggctgcgccgcccccatggtgtacctggactgcagcaacagcagcgccggcacccccggcgccgagtgcctgagaagctgccacaccctggacgtgggctgcttcagcacccactgcgtgagcggctgcgtgtgcccccccggcctggtgagcgacggcagcggcggctgcatcgccgaggaggactgcccctgcgtgcacaacgaggccacctacaagcccggcgagaccatcagagtggactgcaacacctgcacctgcagaaacagaagatgggagtgcagccacagactgtgcctgggcacctgcgtggcctacggcgacggccacttcatcaccttcgacggcgacagatacagcttcgagggcagctgcgagtacatcctggcccaggactactgcggcgacaacaccacccacggcaccttcagaatcgtgaccgagaacatcccctgcggcaccaccggcaccacctgcagcaaggccatcaagctgttcgtggagagctacgagctgatcctgcaggagggcaccttcaaggccgtggccagaggccccggcggcgaccccccctacaagatcagatacatgggcatcttcctggtgatcgagacccacggcatggccgtgagctgggacagaaagaccagcgtgttcatcagactgcaccaggactacaagggcagagtgtgcggcctgtgcggcaacttcgacgacaacgccatcaacgacttcgccaccagaagcagaagcgtggtgggcgacgccctggagttcggcaacagctggaagctgagccccagctgccccgacgccctggcccccaaggacccctgcaccgccaaccccttcagaaagagctgggcccagaagcagtgcagcatcctgcacggccccaccttcgccgcctgcagaagccaggtggacagcaccaagtactacgaggcctgcgtgaacgacgcctgcgcctgcgacagcggcggcgactgcgagtgcttctgcaccgccgtggccgcctacgcccaggcctgccacgacgccggcctgtgcgtgagctggagaacccccgacacctgccccctgttctgcgacttctacaacccccacggcggctgcgagtggcactaccagccctgcggcgccccctgcctgaagacctgcagaaaccccagcggccactgcctggtggacctgcccggcctggagggctgctaccccaagtgcccccccagccagcccttcttcaacgaggaccagatgaagtgcgtggcccagtgcggctgctacgacaaggacggcaactactacgacgtgggcgccagagtgcccaccgccgagaactgccagagctgcaactgcacccccagcggcatccagtgcgcccacagcctggaggcctgcacctgcacctacgaggacagaacctacagctaccaggacgtgatctacaacaccaccgacggcctgggcgcctgcctgatcgccatctgcggcagcaacggcaccatcatcagaaaggccgtggcctgccccggcacccccgccaccacccccttcaccttcaccaccgcctgggtgccccacagcaccaccagccccgccctgcccgtgagcaccgtgtgcgtgagagaggtgtgcagatggagcagctggtacaacggccacagacccgagcccggcctgggcggcggcgacttcgagaccttcgagaacctgagacagagaggctaccaggtgtgccccgtgctggccgacatcgagtgcagagccgcccagctgcccgacatgcccctggaggagctgggccagcaggtggactgcgacagaatgagaggcctgatgtgcgccaacagccagcagagcccccccctgtgccacgactacgagctgagagtgctgtgctgcgagtacgtgccctgcggccccagccccgcccccggcaccagcccccagcccagcctgagcgccagcaccgagcccgccgtgcccacccccacccagaccaccgccaccgagaagaccaccctgtgggtgacccccagcatcagaagcaccgccgccctgaccagccagaccggcagcagcagcggccccgtgaccgtgacccccagcgcccccggcaccaccacctgccagcccagatgccagtggaccgagtggttcgacgaggactaccccaagagcgagcagctgggcggcgacgtggagagctacgacaagatcagagccgccggcggccacctgtgccagcagcccaaggacatcgagtgccaggccgagagcttccccaactggaccctggcccaggtgggccagaaggtgcactgcgacgtgcacttcggcctggtgtgcagaaactgggagcaggagggcgtgttcaagatgtgctacaactacagaatcagagtgctgtgctgcagcgacgaccactgcagaggcagagccaccacccccccccccaccaccgagctggagaccgccaccaccaccaccacccaggccctgttcagcaccccccagcccaccagcagccccggcctgaccagagccccccccgccagcaccaccgccgtgcccaccctgagcgagggcctgaccagccccagatacaccagcaccctgggcaccgccaccaccggcggccccaccacccccgccggcagcaccgagcccaccgtgcccggcgtggccaccagcaccctgcccaccagaagcgccctgcccggcaccaccggcagcctgggcacctggagacccagccagccccccaccctggcccccaccaccatggccaccagcagagccagacccaccggcaccgccagcaccgccagcaaggagcccctgaccaccagcctggcccccaccctgaccagcgagctgagcaccagccaggccgagaccagcacccccagaaccgagaccaccatgagccccctgaccaacaccaccaccagccagggcaccaccagatgccagcccaagtgcgagtggaccgagtggttcgacgtggacttccccaccagcggcgtggccggcggcgacatggagaccttcgagaacatcagagccgccggcggcaagatgtgctgggcccccaagagcatcgagtgcagagccgagaactaccccgaggtgagcatcgaccaggtgggccaggtgctgacctgcagcctggagaccggcctgacctgcaagaacgaggaccagaccggcagattcaacatgtgcttcaactacaacgtgagagtgctgtgctgcgacgactacagccactgccccagcacccccgccaccagcagcaccgccacccccagcagcacccccggcaccacctggatcctgaccaagcccaccaccaccgccaccaccaccgccagcaccggcagcaccgccacccccaccagcaccctgagaaccgcccccccccccaaggtgctgaccaccaccgccaccacccccaccgtgaccagcagcaaggccacccccagcagcagccccggcaccgccaccgccctgcccgccctgagaagcaccgccaccacccccaccgccaccagcgtgacccccatccccagcagcagcctgggcaccacctggaccagactgagccagaccaccacccccaccgccaccatgagcaccgccacccccagcagcacccccgagaccgcccacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcaacaccgtgacccccagcagcgccctgggcaccacccacaccccccccgtgcccaacaccatggccaccacccacggcagaagcctgccccccagcagcccccacaccgtgagaaccgcctggaccagcgccaccagcggcatcctgggcaccacccacatcaccgagcccagcaccgtgaccagccacaccctggccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgagagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccaccaccgccaccaccaccggcgccaccggcagcgtggccacccccagcagcacccccggcaccgcccacaccaccaaggtgctgaccaccaccaccaccggcttcaccgccacccccagcagcagccccggcaccgccagaaccctgcccgtgtggatcagcaccaccaccacccccaccaccagaggcagcaccgtgacccccagcagcatccccggcaccacccacacccccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccagagccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccgagcagaccaccgccgccaccaccaccgccaccaccggcagcaccgccatccccagcagcacccccggcaccgcccccccccccaaggtgctgaccagcaccgccaccacccccaccgccaccagcagcaaggccaccagcagcagcagccccagaaccgccaccaccctgcccgtgctgaccagcaccgccaccaagagcaccgccaccagcttcacccccatccccagcttcaccctgggcaccaccggcaccctgcccgagcagaccaccacccccatggccaccatgagcaccatccaccccagcagcacccccgagaccacccacaccagcaccgtgctgaccaccaaggccaccaccaccagagccaccagcagcatgagcacccccagcagcacccccggcaccacctggatcctgaccgagctgaccaccgccgccaccaccaccgccgccaccggccccaccgccacccccagcagcacccccggcaccacctggatcctgaccgagcccagcaccaccgccaccgtgaccgtgcccaccggcagcaccgccaccgccagcagcaccagagccaccgccggcaccctgaaggtgctgaccagcaccgccaccacccccaccgtgatcagcagcagagccacccccagcagcagccccggcaccgccaccgccctgcccgccctgagaagcaccgccaccacccccaccgccaccagcgtgaccgccatccccagcagcagcctgggcaccgcctggaccagactgagccagaccaccacccccaccgccaccatgagcaccgccacccccagcagcacccccgagaccgtgcacaccagcaccgtgctgaccaccaccaccaccaccaccagagccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgccccccagcagcccccacaccgtgagaaccgcctggaccagcgccaccagcggcatcctgggcaccacccacatcaccgagcccagcaccgtgaccagccacacccccgccgccaccaccagcaccacccagcacagcacccccgccctgagcagcccccaccccagcagcagaaccaccgagagcccccccagccccggcaccaccacccccggccacaccagaggcaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccaagctgaccaccaccgccaccaccaccgagagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgcccacaccagcaccgtgctgaccaccaccgccaccaccaccagagccaccggcagcgtggccacccccagcagcacccccggcaccgcccacaccaccaaggtgcccaccaccaccaccaccggcttcaccgtgacccccagcagcagccccggcaccgccagaaccccccccgtgtggatcagcaccaccaccacccccaccaccagcggcagcaccgtgacccccagcagcgtgcccggcaccacccacacccccaccgtgctgaccaccaccaccaccaccgtggccaccggcagcatggccacccccagcagcagcacccagaccagcggcaccccccccagcctgatcaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgggcgagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgccagcaccggcagcaccgccacccccagcagcacccccggcaccgcccccccccccaaggtgctgaccagccccgccaccacccccaccgccaccagcagcaaggccaccagcagcagcagccccagaaccgccaccaccctgcccgtgctgaccagcaccgccaccaagagcaccgccaccagcgtgacccccatccccagcagcaccctgggcaccaccggcaccctgcccgagcagaccaccacccccgtggccaccatgagcaccatccaccccagcagcacccccgagaccacccacaccagcaccgtgctgaccaccaaggccaccaccaccagagccaccagcagcaccagcacccccagcagcacccccggcaccacctggatcctgaccgagctgaccaccgccgccaccaccaccgccgccaccggccccaccgccacccccagcagcacccccggcaccacctggatcctgaccgagctgaccaccaccgccaccaccaccgccagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccagcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccaccacccccaccaccagcggcagcaccgtgacccccagcagcatccccggcaccacccacaccgccagagtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcacccccgtgctgaccagcaccgccaccacccccgccgccaccagcagcaaggccaccagcagcagcagccccagaaccgccaccaccctgcccgtgctgaccagcaccgccaccaagagcaccgccaccagcttcacccccatccccagcagcaccctgtggaccacctggaccgtgcccgcccagaccaccacccccatgagcaccatgagcaccatccacaccagcagcacccccgagaccacccacaccagcaccgtgctgaccaccaccgccaccatgaccagagccaccaacagcaccgccacccccagcagcaccctgggcaccaccagaatcctgaccgagctgaccaccaccgccaccaccaccgccgccaccggcagcaccgccaccctgagcagcacccccggcaccacctggatcctgaccgagcccagcaccatcgccaccgtgatggtgcccaccggcagcaccgccaccgccagcagcaccctgggcaccgcccacacccccaaggtggtgaccaccatggccaccatgcccaccgccaccgccagcaccgtgcccagcagcagcaccgtgggcaccaccagaacccccgccgtgctgcccagcagcctgcccaccttcagcgtgagcaccgtgagcagcagcgtgctgaccaccctgagacccaccggcttccccagcagccacttcagcaccccctgcttctgcagagccttcggccagttcttcagccccggcgaggtgatctacaacaagaccgacagagccggctgccacttctacgccgtgtgcaaccagcactgcgacatcgacagattccagggcgcctgccccaccagccccccccccgtgagcagcgcccccctgagcagccccagccccgcccccggctgcgacaacgccatccccctgagacaggtgaacgagacctggaccctggagaactgcaccgtggccagatgcgtgggcgacaacagagtggtgctgctggaccccaagcccgtggccaacgtgacctgcgtgaacaagcacctgcccatcaaggtgagcgaccccagccagccctgcgacttccactacgagtgcgagtgcatctgcagcatgtggggcggcagccactacagcaccttcgacggcaccagctacaccttcagaggcaactgcacctacgtgctgatgagagagatccacgccagattcggcaacctgagcctgtacctggacaaccactactgcaccgccagcgccaccgccgccgccgccagatgccccagagccctgagcatccactacaagagcatggacatcgtgctgaccgtgaccatggtgcacggcaaggaggagggcctgatcctgttcgaccagatccccgtgagcagcggcttcagcaagaacggcgtgctggtgagcgtgctgggcaccaccaccatgagagtggacatccccgccctgggcgtgagcgtgaccttcaacggccaggtgttccaggccagactgccctacagcctgttccacaacaacaccgagggccagtgcggcacctgcaccaacaaccagagagacgactgcctgcagagagacggcaccaccgccgccagctgcaaggacatggccaagacctggctggtgcccgacagcagaaaggacggctgctgggcccccaccggcaccccccccaccgccagccccgccgcccccgtgagcagcacccccacccccaccccctgccccccccagcccctgtgcgacctgatgctgagccaggtgttcgccgagtgccacaacctggtgccccccggccccttcttcaacgcctgcatcagcgaccactgcagaggcagactggaggtgccctgccagagcctggaggcctacgccgagctgtgcagagccagaggcgtgtgcagcgactggagaggcgccaccggcggcctgtgcgacctgacctgcccccccaccaaggtgtacaagccctgcggccccatccagcccgccacctgcaacagcagaaaccagagcccccagctggagggcatggccgagggctgcttctgccccgaggaccagatcctgttcaacgcccacatgggcatctgcgtgcaggcctgcccctgcgtgggccccgacggcttccccaagttccccggcgagagatgggtgagcaactgccagagctgcgtgtgcgacgagggcagcgtgagcgtgcagtgcaagcccctgccctgcgacgcccagggccagccccccccctgcaacagacccggcttcgtgaccgtgaccagacccagagccgagaacccctgctgccccgagaccgtgtgcgtgtgcaacaccaccacctgcccccagagcctgcccgtgtgcccccccggccaggagagcatctgcacccaggaggagggcgactgctgccccaccttcagatgcagaccccagctgtgcagctacaacggcaccttctacggcgtgggcgccaccttccccggcgccctgccctgccacatgtgcacctgcctgagcggcgacacccaggaccccaccgtgcagtgccaggaggacgcctgcaacaacaccacctgcccccagggcttcgagtacaagagagtggccggccagtgctgcggcgagtgcgtgcagaccgcctgcctgacccccgacggccagcccgtgcagctgaacgagacctgggtgaacagccacgtggacaactgcaccgtgtacctgtgcgaggccgagggcggcgtgcacctgctgaccccccagcccgccagctgccccgacgtgagcagctgcagaggcagcctgagaaagaccggctgctgctacagctgcgaggaggacagctgccaggtgagaatcaacaccaccatcctgtggcaccagggctgcgagaccgaggtgaacatcaccttctgcgagggcagctgccccggcgccagcaagtacagcgccgaggcccaggccatgcagcaccagtgcacctgctgccaggagagaagagtgcacgaggagaccgtgcccctgcactgccccaacggcagcgccatcctgcacacctacacccacgtggacgagtgcggctgcacccccttctgcgtgcccgcccccatggcccccccccacaccagaggcttccccgcccaggaggccaccgccgtgtag

SEQ ID NO: 89541 - DNA, 17289 bp, Artificial Sequence
  Description of Artificial Sequence: Synthetic coding sequence
atgggcgcccccagcgcctgcagaaccctggtgctggccctggccgccatgctggtggtgccccaggccgagacccagggccccgtggagcccagctgggagaacgccggccacaccatggacggcggcgcccccaccagcagccccaccagaagagtgagcttcgtgccccccgtgaccgtgttccccagcctgagccccctgaaccccgcccacaacggcagagtgtgcagcacctggggcgacttccactacaagaccttcgacggcgacgtgttcagattccccggcctgtgcaactacgtgttcagcgagcactgcagagccgcctacgaggacttcaacgtgcagctgagaagaggcctggtgggcagcagacccgtggtgaccagagtggtgatcaaggcccagggcctggtgctggaggccagcaacggcagcgtgctgatcaacggccagagagaggagctgccctacagcagaaccggcctgctggtggagcagagcggcgactacatcaaggtgagcatcagactggtgctgaccttcctgtggaacggcgaggacagcgccctgctggagctggaccccaagtacgccaaccagacctgcggcctgtgcggcgacttcaacggcctgcccgccttcaacgagttctacgcccacaacgccagactgacccccctgcagttcggcaacctgcagaagctggacggccccaccgagcagtgccccgaccccctgcccctgcccgccggcaactgcaccgacgaggagggcatctgccacagaaccctgctgggccccgccttcgccgagtgccacgccctggtggacagcaccgcctacctggccgcctgcgcccaggacctgtgcagatgccccacctgcccctgcgccaccttcgtggagtacagcagacagtgcgcccacgccggcggccagcccagaaactggagatgccccgagctgtgccccagaacctgccccctgaacatgcagcaccaggagtgcggcagcccctgcaccgacacctgcagcaacccccagagagcccagctgtgcgaggaccactgcgtggacggctgcttctgcccccccggcaccgtgctggacgacatcacccacagcggctgcctgcccctgggccagtgcccctgcacccacggcggcagaacctacagccccggcaccagcttcaacaccacctgcagcagctgcacctgcagcggcggcctgtggcagtgccaggacctgccctgccccggcacctgcagcgtgcagggcggcgcccacatcagcacctacgacgagaagctgtacgacctgcacggcgactgcagctacgtgctgagcaagaagtgcgccgacagcagcttcaccgtgctggccgagctgagaaagtgcggcctgaccgacaacgagaactgcctgaaggccgtgaccctgagcctggacggcggcgacaccgccatcagagtgcaggccgacggcggcgtgttcctgaacagcatctacacccagctgcccctgagcgccgccaacatcaccctgttcacccccagcagcttcttcatcgtggtgcagaccggcctgggcctgcagctgctggtgcagctggtgcccctgatgcaggtgttcgtgagactggaccccgcccaccagggccagatgtgcggcctgtgcggcaacttcaaccagaaccaggccgacgacttcaccgccctgagcggcgtggtggaggccaccggcgccgccttcgccaacacctggaaggcccaggccgcctgcgccaacgccagaaacagcttcgaggacccctgcagcctgagcgtggagaacgagaactacgccagacactggtgcagcagactgaccgaccccaacagcgccttcagcagatgccacagcatcatcaaccccaagcccttccacagcaactgcatgttcgacacctgcaactgcgagagaagcgaggactgcctgtgcgccgccctgagcagctacgtgcacgcctgcgccgccaagggcgtgcagctgagcgactggagagacggcgtgtgcaccaagtacatgcagaactgccccaagagccagagatacgcctacgtggtggacgcctgccagcccacctgcagaggcctgagcgaggccgacgtgacctgcagcgtgagcttcgtgcccgtggacggctgcacctgccccgccggcaccttcctgaacgacgccggcgcctgcgtgcccgcccaggagtgcccctgctacgcccacggcaccgtgctggcccccggcgaggtggtgcacgacgagggcgccgtgtgcagctgcaccggcggcaagctgagctgcctgggcgccagcctgcagaagagcaccggctgcgccgcccccatggtgtacctggactgcagcaacagcagcgccggcacccccggcgccgagtgcctgagaagctgccacaccctggacgtgggctgcttcagcacccactgcgtgagcggctgcgtgtgcccccccggcctggtgagcgacggcagcggcggctgcatcgccgaggaggactgcccctgcgtgcacaacgaggccacctacaagcccggcgagaccatcagagtggactgcaacacctgcacctgcagaaacagaagatgggagtgcagccacagactgtgcctgggcacctgcgtggcctacggcgacggccacttcatcaccttcgacggcgacagatacagcttcgagggcagctgcgagtacatcctggcccaggactactgcggcgacaacaccacccacggcaccttcagaatcgtgaccgagaacatcccctgcggcaccaccggcaccacctgcagcaaggccatcaagctgttcgtggagagctacgagctgatcctgcaggagggcaccttcaaggccgtggccagaggccccggcggcgaccccccctacaagatcagatacatgggcatcttcctggtgatcgagacccacggcatggccgtgagctgggacagaaagaccagcgtgttcatcagactgcaccaggactacaagggcagagtgtgcggcctgtgcggcaacttcgacgacaacgccatcaacgacttcgccaccagaagcagaagcgtggtgggcgacgccctggagttcggcaacagctggaagctgagccccagctgccccgacgccctggcccccaaggacccctgcaccgccaaccccttcagaaagagctgggcccagaagcagtgcagcatcctgcacggccccaccttcgccgcctgcagaagccaggtggacagcaccaagtactacgaggcctgcgtgaacgacgcctgcgcctgcgacagcggcggcgactgcgagtgcttctgcaccgccgtggccgcctacgcccaggcctgccacgacgccggcctgtgcgtgagctggagaacccccgacacctgccccctgttctgcgacttctacaacccccacggcggctgcgagtggcactaccagccctgcggcgccccctgcctgaagacctgcagaaaccccagcggccactgcctggtggacctgcccggcctggagggctgctaccccaagtgcccccccagccagcccttcttcaacgaggaccagatgaagtgcgtggcccagtgcggctgctacgacaaggacggcaactactacgacgtgggcgccagagtgcccaccgccgagaactgccagagctgcaactgcacccccagcggcatccagtgcgcccacagcctggaggcctgcacctgcacctacgaggacagaacctacagctaccaggacgtgatctacaacaccaccgacggcctgggcgcctgcctgatcgccatctgcggcagcaacggcaccatcatcagaaaggccgtggcctgccccggcacccccgccaccacccccttcaccttcaccaccgcctgggtgccccacagcaccaccagccccgccctgcccgtgagcaccgtgtgcgtgagagaggtgtgcagatggagcagctggtacaacggccacagacccgagcccggcctgggcggcggcgacttcgagaccttcgagaacctgagacagagaggctaccaggtgtgccccgtgctggccgacatcgagtgcagagccgcccagctgcccgacatgcccctggaggagctgggccagcaggtggactgcgacagaatgagaggcctgatgtgcgccaacagccagcagagcccccccctgtgccacgactacgagctgagagtgctgtgctgcgagtacgtgccctgcggccccagccccgcccccggcaccagcccccagcccagcctgagcgccagcaccgagcccgccgtgcccacccccacccagaccaccgccaccgagaagaccaccctgtgggtgacccccagcatcagaagcaccgccgccctgaccagccagaccggcagcagcagcggccccgtgaccgtgacccccagcgcccccggcaccaccacctgccagcccagatgccagtggaccgagtggttcgacgaggactaccccaagagcgagcagctgggcggcgacgtggagagctacgacaagatcagagccgccggcggccacctgtgccagcagcccaaggacatcgagtgccaggccgagagcttccccaactggaccctggcccaggtgggccagaaggtgcactgcgacgtgcacttcggcctggtgtgcagaaactgggagcaggagggcgtgttcaagatgtgctacaactacagaatcagagtgctgtgctgcagcgacgaccactgcagaggcagagccaccacccccccccccaccaccgagctggagaccgccaccaccaccaccacccaggccctgttcagcaccccccagcccaccagcagccccggcctgaccagagccccccccgccagcaccaccgccgtgcccaccctgagcgagggcctgaccagccccagatacaccagcaccctgggcaccgccaccaccggcggccccaccacccccgccggcagcaccgagcccaccgtgcccggcgtggccaccagcaccctgcccaccagaagcgccctgcccggcaccaccggcagcctgggcacctggagacccagccagccccccaccctggcccccaccaccatggccaccagcagagccagacccaccggcaccgccagcaccgccagcaaggagcccctgaccaccagcctggcccccaccctgaccagcgagctgagcaccagccaggccgagaccagcacccccagaaccgagaccaccatgagccccctgaccaacaccaccaccagccagggcaccaccagatgccagcccaagtgcgagtggaccgagtggttcgacgtggacttccccaccagcggcgtggccggcggcgacatggagaccttcgagaacatcagagccgccggcggcaagatgtgctgggcccccaagagcatcgagtgcagagccgagaactaccccgaggtgagcatcgaccaggtgggccaggtgctgacctgcagcctggagaccggcctgacctgcaagaacgaggaccagaccggcagattcaacatgtgcttcaactacaacgtgagagtgctgtgctgcgacgactacagccactgccccagcacccccgccaccagcagcaccgccacccccagcagcacccccggcaccacctggatcctgaccaagcccaccaccaccgccaccaccaccgccagcaccggcagcaccgccacccccaccagcaccctgagaaccgcccccccccccaaggtgctgaccaccaccgccaccacccccaccgtgaccagcagcaaggccacccccagcagcagccccggcaccgccaccgccctgcccgccctgagaagcaccgccaccacccccaccgccaccagcgtgacccccatccccagcagcagcctgggcaccacctggaccagactgagccagaccaccacccccaccgccaccatgagcaccgccacccccagcagcacccccgagaccgcccacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcaacaccgtgacccccagcagcgccctgggcaccacccacaccccccccgtgcccaacaccatggccaccacccacggcagaagcctgccccccagcagcccccacaccgtgagaaccgcctggaccagcgccaccagcggcatcctgggcaccacccacatcaccgagcccagcaccgtgaccagccacaccctggccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgagagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccaccaccgccaccaccaccggcgccaccggcagcgtggccacccccagcagcacccccggcaccgcccacaccaccaaggtgctgaccaccaccaccaccggcttcaccgccacccccagcagcagccccggcaccgccagaaccctgcccgtgtggatcagcaccaccaccacccccaccaccagaggcagcaccgtgacccccagcagcatccccggcaccacccacacccccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccagagccaccagcagaaccaccgccaccgccacccccagcaagaccagaaccagcaccctgctgcccagcagccccaccagcgcccccatcaccaccgtggtgaccatgggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccgagcagaccaccgccgccaccaccaccgccaccaccggcagcaccgccatccccagcagcacccccggcaccgcccccccccccaaggtgctgaccagcaccgccaccacccccaccgccaccagcagcaaggccaccagcagcagcagccccagaaccgccaccaccctgcccgtgctgaccagcaccgccaccaagagcaccgccaccagcttcacccccatccccagcttcaccctgggcaccaccggcaccctgcccgagcagaccaccacccccatggccaccatgagcaccatccaccccagcagcacccccgagaccacccacaccagcaccgtgctgaccaccaaggccaccaccaccagagccaccagcagcatgagcacccccagcagcacccccggcaccacctggatcctgaccgagctgaccaccgccgccaccaccaccgccgccaccggccccaccgccacccccagcagcacccccggcaccacctggatcctgaccgagcccagcaccaccgccaccgtgaccgtgcccaccggcagcaccgccaccgccagcagcaccagagccaccgccggcaccctgaaggtgctgaccagcaccgccaccacccccaccgtgatcagcagcagagccacccccagcagcagccccggcaccgccaccgccctgcccgccctgagaagcaccgccaccacccccaccgccaccagcgtgaccgccatccccagcagcagcctgggcaccgcctggaccagactgagccagaccaccacccccaccgccaccatgagcaccgccacccccagcagcacccccgagaccgtgcacaccagcaccgtgctgaccaccaccaccaccaccaccagagccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccagaggcagcaccgtgacccccagcagcatccccggcaccacccacaccgccaccgtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgccccccagcagcccccacaccgtgagaaccgcctggaccagcgccaccagcggcatcctgggcaccacccacatcaccgagcccagcaccgtgaccagccacacccccgccgccaccaccagcaccacccagcacagcacccccgccctgagcagcccccaccccagcagcagaaccaccgagagcccccccagccccggcaccaccacccccggccacaccagaggcaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgagagagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccacccccagcagcacccccggcaccacctggatcctgaccaagctgaccaccaccgccaccaccaccgagagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgcccacaccagcaccgtgctgaccaccaccgccaccaccaccagagccaccggcagcgtggccacccccagcagcacccccggcaccgcccacaccaccaaggtgcccaccaccaccaccaccggcttcaccgtgacccccagcagcagccccggcaccgccagaaccccccccgtgtggatcagcaccaccaccacccccaccaccagcggcagcaccgtgacccccagcagcgtgcccggcaccacccacacccccaccgtgctgaccaccaccaccaccaccgtggccaccggcagcatggccacccccagcagcagcacccagaccagcggcaccccccccagcctgatcaccaccgccaccaccatcaccgccaccggcagcaccaccaaccccagcagcacccccggcaccacccccatcccccccgtgctgaccaccaccgccaccacccccgccgccaccagcagcaccgtgacccccagcagcgccctgggcaccacccacaccccccccgtgcccaacaccaccgccaccacccacggcagaagcctgagccccagcagcccccacaccgtgagaaccgcctggaccagcgccaccagcggcaccctgggcaccacccacatcaccgagcccagcaccggcaccagccacacccccgccgccaccaccggcaccacccagcacagcacccccgccctgagcagcccccaccccagcagcagaaccaccgagagcccccccagccccggcaccaccacccccggccacaccaccgccaccagcagaaccaccgccaccgccacccccagcaagaccagaaccagcaccctgctgcccagcagccccaccagcgcccccatcaccaccgtggtgaccaccggctgcgagccccagtgcgcctggagcgagtggctggactacagctaccccatgcccggccccagcggcggcgacttcgacacctacagcaacatcagagccgccggcggcgccgtgtgcgagcagcccctgggcctggagtgcagagcccaggcccagcccggcgtgcccctgggcgagctgggccaggtggtggagtgcagcctggacttcggcctggtgtgcagaaacagagagcaggtgggcaagttcaagatgtgcttcaactacgagatcagagtgttctgctgcaactacggccactgccccagcacccccgccaccagcagcaccgccatgcccagcagcacccccggcaccacctggatcctgaccgagctgaccaccaccgccaccaccaccgccagcaccggcagcaccgccacccccagcagcacccccggcaccgcccccccccccaaggtgctgaccagccccgccaccacccccaccgccaccagcagcaaggccaccagcagcagcagccccagaaccgccaccaccctgcccgtgctgaccagcaccgccaccaagagcaccgccaccagcgtgacccccatccccagcagcaccctgggcaccaccggcaccctgcccgagcagaccaccacccccgtggccaccatgagcaccatccaccccagcagcacccccgagaccacccacaccagcaccgtgctgaccaccaaggccaccaccaccagagccaccagcagcaccagcacccccagcagcacccccggcaccacctggatcctgaccgagctgaccaccgccgccaccaccaccgccgccaccggccccaccgccacccccagcagcacccccggcaccacctggatcctgaccgagctgaccaccaccgccaccaccaccgccagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccagcagcagccccggcaccgccaccgccctgcccgccctgagaagcaccgccaccacccccaccgccaccagcttcaccgccatccccagcagcagcctgggcaccacctggaccagactgagccagaccaccacccccaccgccaccatgagcaccgccacccccagcagcacccccgagaccgtgcacaccagcaccgtgctgaccgccaccgccaccaccaccggcgccaccggcagcgtggccacccccagcagcacccccggcaccgcccacaccaccaaggtgcccaccaccaccaccaccggcttcaccgccacccccagcagcagccccggcaccgccctgaccccccccgtgtggatcagcaccaccaccacccccaccaccaccacccccaccaccagcggcagcaccgtgacccccagcagcatccccggcaccacccacaccgccagagtgctgaccaccaccaccaccaccgtggccaccggcagcatggccacccccagcagcagcacccagaccagcggcaccccccccagcctgaccaccaccgccaccaccatcaccgccaccggcagcaccaccaaccccagcagcacccccggcaccacccccatcacccccgtgctgaccagcaccgccaccacccccgccgccaccagcagcaaggccaccagcagcagcagccccagaaccgccaccaccctgcccgtgctgaccagcaccgccaccaagagcaccgccaccagcttcacccccatccccagcagcaccctgtggaccacctggaccgtgcccgcccagaccaccacccccatgagcaccatgagcaccatccacaccagcagcacccccgagaccacccacaccagcaccgtgctgaccaccaccgccaccatgaccagagccaccaacagcaccgccacccccagcagcaccctgggcaccaccagaatcctgaccgagctgaccaccaccgccaccaccaccgccgccaccggcagcaccgccaccctgagcagcacccccggcaccacctggatcctgaccgagcccagcaccatcgccaccgtgatggtgcccaccggcagcaccgccaccgccagcagcaccctgggcaccgcccacacccccaaggtggtgaccaccatggccaccatgcccaccgccaccgccagcaccgtgcccagcagcagcaccgtgggcaccaccagaacccccgccgtgctgcccagcagcctgcccaccttcagcgtgagcaccgtgagcagcagcgtgctgaccaccctgagacccaccggcttccccagcagccacttcagcaccccctgcttctgcagagccttcggccagttcttcagccccggcgaggtgatctacaacaagaccgacagagccggctgccacttctacgccgtgtgcaaccagcactgcgacatcgacagattccagggcgcctgccccaccagccccccccccgtgagcagcgcccccctgagcagccccagccccgcccccggctgcgacaacgccatccccctgagacaggtgaacgagacctggaccctggagaactgcaccgtggccagatgcgtgggcgacaacagagtggtgctgctggaccccaagcccgtggccaacgtgacctgcgtgaacaagcacctgcccatcaaggtgagcgaccccagccagccctgcgacttccactacgagtgcgagtgcatctgcagcatgtggggcggcagccactacagcaccttcgacggcaccagctacaccttcagaggcaactgcacctacgtgctgatgagagagatccacgccagattcggcaacctgagcctgtacctggacaaccactactgcaccgccagcgccaccgccgccgccgccagatgccccagagccctgagcatccactacaagagcatggacatcgtgctgaccgtgaccatggtgcacggcaaggaggagggcctgatcctgttcgaccagatccccgtgagcagcggcttcagcaagaacggcgtgctggtgagcgtgctgggcaccaccaccatgagagtggacatccccgccctgggcgtgagcgtgaccttcaacggccaggtgttccaggccagactgccctacagcctgttccacaacaacaccgagggccagtgcggcacctgcaccaacaaccagagagacgactgcctgcagagagacggcaccaccgccgccagctgcaaggacatggccaagacctggctggtgcccgacagcagaaaggacggctgctgggcccccaccggcaccccccccaccgccagccccgccgcccccgtgagcagcacccccacccccaccccctgccccccccagcccctgtgcgacctgatgctgagccaggtgttcgccgagtgccacaacctggtgccccccggccccttcttcaacgcctgcatcagcgaccactgcagaggcagactggaggtgccctgccagagcctggaggcctacgccgagctgtgcagagccagaggcgtgtgcagcgactggagaggcgccaccggcggcctgtgcgacctgacctgcccccccaccaaggtgtacaagccctgcggccccatccagcccgccacctgcaacagcagaaaccagagcccccagctggagggcatggccgagggctgcttctgccccgaggaccagatcctgttcaacgcccacatgggcatctgcgtgcaggcctgcccctgcgtgggccccgacggcttccccaagttccccggcgagagatgggtgagcaactgccagagctgcgtgtgcgacgagggcagcgtgagcgtgcagtgcaagcccctgccctgcgacgcccagggccagccccccccctgcaacagacccggcttcgtgaccgtgaccagacccagagccgagaacccctgctgccccgagaccgtgtgcgtgtgcaacaccaccacctgcccccagagcctgcccgtgtgcccccccggccaggagagcatctgcacccaggaggagggcgactgctgccccaccttcagatgcagaccccagctgtgcagctacaacggcaccttctacggcgtgggcgccaccttccccggcgccctgccctgccacatgtgcacctgcctgagcggcgacacccaggaccccaccgtgcagtgccaggaggacgcctgcaacaacaccacctgcccccagggcttcgagtacaagagagtggccggccagtgctgcggcgagtgcgtgcagaccgcctgcctgacccccgacggccagcccgtgcagctgaacgagacctgggtgaacagccacgtggacaactgcaccgtgtacctgtgcgaggccgagggcggcgtgcacctgctgaccccccagcccgccagctgccccgacgtgagcagctgcagaggcagcctgagaaagaccggctgctgctacagctgcgaggaggacagctgccaggtgagaatcaacaccaccatcctgtggcaccagggctgcgagaccgaggtgaacatcaccttctgcgagggcagctgccccggcgccagcaagtacagcgccgaggcccaggccatgcagcaccagtgcacctgctgccaggagagaagagtgcacgaggagaccgtgcccctgcactgccccaacggcagcgccatcctgcacacctacacccacgtggacgagtgcggctgcacccccttctgcgtgcccgcccccatggcccccccccacaccagaggcttccccgcccaggaggccaccgccgtgtag

SEQ ID NO: 89542 - DNA, 1611 bp, Artificial Sequence
  Description of Artificial Sequence: Synthetic coding sequence
gtgttctgctgcaactacggccactgcccccccagaccccccgccctgagaccctgccccccccccctgagaggcagacccggcagcaccgagctgaccaccaccgccaccaccaccgccagcaccggcagcaccgccacccccagcagcacccccggcaccgcccccccccccaaggtgctgaccagccccgccaccacccccaccgccaccagcagcaaggccaccagcagcagcagccccagaaccgccaccaccctgcccgtgctgaccagcaccgccaccaagagcaccgccaccagcgtgacccccatccccagcagcaccctgggcaccaccggcaccctgcccgagcagaccaccacccccgtggccaccatgagcaccatccaccccagcagcacccccgagaccacccacaccagcaccgtgctgaccaccaaggccaccaccaccagagccaccagcagcaccagcacccccagcagcacccccggcaccacctggatcctgaccgagctgaccaccgccgccaccaccaccgccgccaccggccccaccgccacccccagcagcacccccggcaccacctggatcctgaccgagctgaccaccaccgccaccaccaccgccagcaccggcagcaccgccacccccagcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccagcagcagccccggcaccgccaccgccctgcccgccctgagaagcaccgccaccacccacagctaccagctgtacagccaccccctgctgctgcccaccacctggaccagactgagccagaccaccacccccaccgccaccatgagcaccgccacccccagcagcacccccgagaccgtgcacaccagcaccgtgctgaccgccaccgccaccaccaccggccccgccctgtggcccccccccccccccccccaggagcagctgaccctgcccaagtgcagactgccccagcccagacacagccaccccctgctgcagcccagagacggcacccacgccagcagcgtggaccagcacaaccaccacacccacaaccaccacacccacaaccagtggctgcacggcgaccccctgctgcaccccggcgaccacccccacagacagagcgccgaccaccaccaccacaactgcaccggcagcatggccacccccagcagcagcacccagaccagcggcaccccccccagcctgaccaccaccgccaccaccatcaccgccaccggcagcaccaccaaccccagcagcacccccggcaccacccccatcacccccgtgctgaccagcaccgccaccacccccgccgccaccagcagcaaggccaccagcagcagcagccccagaaccgccaccaccctgcccgtgctgaccagcaccgccaccaagagcaccgccaccagcttcacccccatccccagcccctgcggccccagaggccccagctag

SEQ ID NO: 89543 - DNA, 561 bp, Artificial Sequence
  Description of Artificial Sequence: Synthetic coding sequence
agcagcacccccggcaccacctggatcctgaccgagcccagcaccaccgccaccgtgaccgtgcccaccggcagcaccgccaccgccagcagcacccaggccaccgccggcaccccccacgtgagcaccaccgccaccacccccaccgtgaccagcagcaaggccacccccttcagcagccccggcaccgccaccgccctgcccgccctgagaagcaccgccaccacccccaccgccaccagcttcaccgccatccccagcagctgggccccccccggccccgcctaccacagacccccccaccccagacccccctgcccccagccccaccccccccccctgcagagactgagcacccccccccagtgcctgccccccagaccccccagaggccacagactgtgcggccaccccctgctgcaccccagaaacagcagccactaccagagcgccgactaccacaaccacttcaccgccacccccagcagcagccccggcaccgccagaaccctgcccgtgtggatcagcaccaccaccacccccaccaccagaggcagctag

SEQ ID NO: 89544 - DNA, 960 bp, Artificial Sequence
  Description of Artificial Sequence: Synthetic coding sequence
accaaggccaccaccaccagagccaccagcagcatgagcacccccagcagcacccccggcaccacctggatcctgaccgagctgaccaccgccgccaccaccaccgccgccaccccccacggccaccccgtgctgcaccccagagaccacctggacccccacagagcccagcactacaccgtgaccgtgcccaccggcagcaccgccaccgccagcagcaccagagccaccgccggcaccctgaaggtgctgaccagccaccacacccacagccaccagctgcagagccacagcctgctgcagagcagagactgcaacagacccagcagcaccgagaagcacagccaccacacccacagctaccagagatacagccaccccctgttcctgcccaccgcctggaccagactgagccagaccaccacccccaccgccaccatgagcaccgccacccccagcagcacccccgagaccgtgcacaccagcaccgtgctgaccaccaccaccaccaccaccagagccaccctgtggcccccccccccccccccccaggagcagctgaccctgcccaagtgcagactgccccagcccagacacagccaccccctgctgcagcccagagacggcacccacgccagcagcgtggaccagcacaaccaccacacccacaaccagagactgcacggcgaccccctgctgcaccccaccacccacaccgccaccgtgctgaccaccaccaccaccacccccctggtgctgtggcagcacccccccctggcccacagacccgtggtgccccccagcctgaccaccaccgccaccaccatcaccgccaccggcagcaccaccaaccccagcagcacccccggcaccacccccatcccccccgtgctgaccaccaccgcccacacctgcagccaccagcagcacagcgacagcctgctgtgccccagagactag

SEQ ID NO: 89545 - DNA, 2007 bp, Artificial Sequence
  Description of Artificial Sequence: Synthetic coding sequence
atgagagagatccacgccagattcggcaacctgagcctgtacctggacaaccactactgcaccgccagcgccaccgccgccgccgccagatgccccagagccctgagcatccactacaagagcatggacatcgtgctgaccgtgaccatggtgcacggcaaggaggagggcctgatcctgttcgaccagatccccgtgagcagcggcttcagcaagaacggcgtgctggtgagcgtgctgggcaccaccaccatgagagtggacatccccgccctgggcgtgagcgtgaccttcaacggccaggtgttccaggccagactgccctacagcctgttccacaacaacaccgagggccagtgcggcacctgcaccaacaaccagagagacgactgcctgcagagagacggcaccaccgccgccagctgcaaggacatggccaagacctggctggtgcccgacagcagaaaggacggctgctgggcccccaccggcaccccccccaccgccagccccgccgcccccgtgagcagcacccccacccccaccccctgccccccccagcccctgtgcgacctgatgctgagccaggtgttcgccgagtgccacaacctggtgccccccggccccttcttcaacgcctgcatcagcgaccactgcagaggcagactggaggtgccctgccagagcctggaggcctacgccgagctgtgcagagccagaggcgtgtgcagcgactggagaggcgccaccggcggcctgtgcgacctgacctgcccccccaccaaggtgtacaagccctgcggccccatccagcccgccacctgcaacagcagaaaccagagcccccagctggagggcatggccgagggctgcttctgccccgaggaccagatcctgttcaacgcccacatgggcatctgcgtgcaggcctgcccctgcgtgggccccgacggcttccccaagttccccggcgagagatgggtgagcaactgccagagctgcgtgtgcgacgagggcagcgtgagcgtgcagtgcaagcccctgccctgcgacgcccagggccagccccccccctgcaacagacccggcttcgtgaccgtgaccagacccagagccgagaacccctgctgccccgagaccgtgtgcgtgtgcaacaccaccacctgcccccagagcctgcccgtgtgcccccccggccaggagagcatctgcacccaggaggagggcgactgctgccccaccttcagatgcagaccccagctgtgcagctacaacggcaccttctacggcgtgggcgccaccttccccggcgccctgccctgccacatgtgcacctgcctgagcggcgacacccaggaccccaccgtgcagtgccaggaggacgcctgcaacaacaccacctgcccccagggcttcgagtacaagagagtggccggccagtgctgcggcgagtgcgtgcagaccgcctgcctgacccccgacggccagcccgtgcagctgaacgagacctgggtgaacagccacgtggacaactgcaccgtgtacctgtgcgaggccgagggcggcgtgcacctgctgaccccccagcccgccagctgccccgacgtgagcagctgcagaggcagcctgagaaagaccggctgctgctacagctgcgaggaggacagctgccaggtgagaatcaacaccaccatcctgtggcaccagggctgcgagaccgaggtgaacatcaccttctgcgagggcagctgccccggcgccagcaagtacagcgccgaggcccaggccatgcagcaccagtgcacctgctgccaggagagaagagtgcacgaggagaccgtgcccctgcactgccccaacggcagcgccatcctgcacacctacacccacgtggacgagtgcggctgcacccccttctgcgtgcccgcccccatgagcccccccgcctgcgtgtggcaccccgccctgagagcccccgccgcccacctgggcctggcccccccctag

SEQ ID NO: 89546 - DNA, 7320 bp, Artificial Sequence
  Description of Artificial Sequence: Synthetic coding sequence
atggtgcagagatggctgctgctgagctgctgcggcgccctgctgagcgccggcctggccaacaccagctacaccagccccggcctgcagagactgaaggacagcccccagaccgcccccgacaagggccagtgcagcacctggggcgccggccacttcagcaccttcgaccaccacgtgtacgacttcagcggcacctgcaactacatcttcgccgccacctgcaaggacgccttccccaccttcagcgtgcagctgagaagaggccccgacggcagcatcagcagaatcatcgtggagctgggcgccagcgtggtgaccgtgagcgaggccatcatcagcgtgaaggacatcggcgtgatcagcctgccctacaccagcaacggcctgcagatcacccccttcggccagagcgtgagactggtggccaagcagctggagctggagctggaggtggtgtggggccccgacagccacctgatggtgctggtggagagaaagtacatgggccagatgtgcggcctgtgcggcaacttcgacggcaaggtgaccaacgagttcgtgagcgaggagggcaagttcctggagccccacaagttcgccgccctgcagaagctggacgaccccggcgagatctgcaccttccaggacatccccagcacccacgtgagacaggcccagcacgccagaatctgcacccagctgctgaccctggtggcccccgagtgcagcgtgagcaaggagcccttcgtgctgagctgccaggccgacgtggccgccgccccccagcccggcccccagaacagcagctgcgccaccctgagcgagtacagcagacagtgcagcatggtgggccagcccgtgagaagatggagaagccccggcctgtgcagcgtgggccagtgccccgccaaccaggtgtaccaggagtgcggcagcgcctgcgtgaagacctgcagcaacccccagcacagctgcagcagcagctgcaccttcggctgcttctgccccgagggcaccgtgctgaacgacctgagcaacaaccacacctgcgtgcccgtgacccagtgcccctgcgtgctgcacggcgccatgtacgcccccggcgaggtgaccatcgccgcctgccagacctgcagatgcaccctgggcagatgggtgtgcaccgagagaccctgccccggccactgcagcctggagggcggcagcttcgtgaccaccttcgacgccagaccctacagattccacggcacctgcacctacatcctgctgcagagcccccagctgcccgaggacggcgccctgatggccgtgtacgacaagagcggcgtgagccacagcgagaccagcctggtggccgtggtgtacctgagcagacaggacaagatcgtgatcagccaggacgaggtggtgaccaacaacggcgaggccaagtggctgccctacaagaccagaaacatcaccgtgttcagacagaccagcacccacctgcagatggccaccagcttcggcctggagctggtggtgcagctgagacccatcttccaggcctacgtgaccgtgggcccccagttcagaggccagaccagaggcctgtgcggcaacttcaacggcgacaccaccgacgacttcaccaccagcatgggcatcgccgagggcaccgccagcctgttcgtggacagctggagagccggcaactgccccgccgccctggagagagagaccgacccctgcagcatgagccagctgaacaaggtgtgcgccgagacccactgcagcatgctgctgagaaccggcaccgtgttcgagagatgccacgccaccgtgaaccccgcccccttctacaagagatgcgtgtaccaggcctgcaactacgaggagaccttcccccacatctgcgccgccctgggcgactacgtgcacgcctgcagcctgagaggcgtgctgctgtggggctggagaagcagcgtggacaactgcaccatcccctgcaccggcaacaccaccttcagctacaacagccaggcctgcgagagaacctgcctgagcctgagcgacagagccaccgagtgccaccacagcgccgtgcccgtggacggctgcaactgccccgacggcacctacctgaaccagaagggcgagtgcgtgagaaaggcccagtgcccctgcatcctggagggctacaagttcatcctggccgagcagagcaccgtgatcaacggcatcacctgccactgcatcaacggcagactgagctgcccccagagaccccagatgttcctggccagctgccaggcccccaagaccttcaagagctgcagccagagcagcgagaacaagttcggcgccgcctgcgcccccacctgccagatgctggccaccggcgtggcctgcgtgcccaccaagtgcgagcccggctgcgtgtgcgccgagggcctgtacgagaacgccgacggccagtgcgtgccccccgaggagtgcccctgcgagttcagcggcgtgagctaccccggcggcgccgagctgcacaccgactgcagaacctgcagctgcagcagaggcagatgggcctgccagcagggcacccactgccccagcacctgcaccctgtacggcgagggccacgtgatcaccttcgacggccagagattcgtgttcgacggcaactgcgagtacatcctggccaccgacgtgtgcggcgtgaacgacagccagcccaccttcaagatcctgaccgagaacgtgatctgcggcaacagcggcgtgacctgcagcagagccatcaagatcttcctgggcggcctgagcgtggtgctggccgacagaaactacaccgtgaccggcgaggagccccacgtgcagctgggcgtgacccccggcgccctgagcctggtggtggacatcagcatccccggcagatacaacctgaccctgatctggaacagacacatgaccatcctgatcagaatcgccagagccagccaggaccccctgtgcggcctgtgcggcaacttcaacggcaacatgaaggacgacttcgagaccagaagcagatacgtggccagcagcgagctggagctggtgaacagctggaaggagagccccctgtgcggcgacgtgagcttcgtgaccgacccctgcagcctgaacgccttcagaagaagctgggccgagagaaagtgcagcgtgatcaacagccagaccttcgccacctgccacagcaaggtgtaccacctgccctactacgaggcctgcgtgagagacgcctgcggctgcgacagcggcggcgactgcgagtgcctgtgcgacgccgtggccgcctacgcccaggcctgcctggacaagggcgtgtgcgtggactggagaacccccgccttctgccccatctactgcggcttctacaacacccacacccaggacggccacggcgagtaccagtacacccaggaggccaactgcacctggcactaccagccctgcctgtgccccagccagccccagagcgtgcccggcagcaacatcgagggctgctacaactgcagccaggacgagtacttcgaccacgaggagggcgtgtgcgtgccctgcatgccccccaccaccccccagccccccaccaccccccagctgcccaccaccggcagcagacccacccaggtgtggcccatgaccggcaccagcaccaccatcggcctgctgagcagcaccggccccagccccagcagcaaccacacccccgccagccccacccagacccccctgctgcccgccaccctgaccagcagcaagcccaccgccagcagcggcgagccccccagacccaccaccgccgtgaccccccaggccaccagcggcctgccccccaccgccaccctgagaagcaccgccaccaagcccaccgtgacccaggccaccaccagagccaccgccagcaccgccagccccgccaccaccagcaccgcccagagcaccaccagaaccaccatgaccctgcccacccccgccaccagcggcaccagccccaccctgcccaagagcaccaaccaggagctgcccggcaccaccgccacccagaccaccggccccagacccacccccgccagcaccaccggccccaccaccccccagcccggccagcccaccagacccaccgccaccgagaccacccagaccagaaccaccaccgagtacaccaccccccagaccccccacaccacccacagcccccccaccgccggcagccccgtgcccagcaccggccccgtgaccgccaccagcttccacgccaccaccacctaccccacccccagccaccccgagaccaccctgcccacccacgtgccccccttcagcaccagcctggtgacccccagcacccacaccgtgatcacccccacccacgcccagatggccaccagcgccagcaaccacagcgcccccaccggcaccatccccccccccaccaccctgaaggccaccggcagcacccacaccgccccccccatcacccccaccaccagcggcaccagccaggcccacagcagcttcagcaccaacaagacccccaccagcctgcacagccacaccagcagcacccaccaccccgaggtgacccccaccagcaccaccaccatcacccccaaccccaccagcaccagaaccagaacccccgtggcccacaccaacagcgccaccagcagcagaccccccccccccttcaccacccacagcccccccaccggcagcagccccttcagcagcaccggccccatgaccgccaccagcttcaagaccaccaccacctaccccacccccagccacccccagaccaccctgcccacccacgtgccccccttcagcaccagcctggtgacccccagcacccacaccgtgatcacccccacccacgcccagatggccaccagcgccagcatccacagcatgcccaccggcaccatccccccccccaccaccctgaaggccaccggcagcacccacaccgcccccaccatgaccctgaccaccagcggcaccagccaggccctgagcagcctgaacaccgccaagaccagcaccagcctgcacagccacaccagcagcacccaccacgccgaggccaccagcaccagcaccaccaacatcacccccaaccccaccagcaccggcaccccccccatgaccgtgaccaccagcggcaccagccagagcagaagcagcttcagcaccgccaagaccagcaccagcctgcacagccacaccagcagcacccaccaccccgaggtgaccagcaccagcaccaccagcatcacccccaaccacaccagcaccggcaccagaacccccgtggcccacaccaccagcgccaccagcagcagactgcccacccccttcaccacccacagcccccccaccggcaccacccccatcagcagcaccggccccgtgaccgccaccagcttccagaccaccaccacctaccccacccccagccacccccacaccaccctgcccacccacgtgcccagcttcagcaccagcctggtgacccccagcacccacaccgtgatcatccccacccacacccagatggccaccagcgccagcatccacagcatgcccaccggcaccatccccccccccaccaccatcaaggccaccggcagcacccacaccgccccccccatgacccccaccaccagcggcaccagccagagccccagcagcttcagcaccgccaagaccagcaccagcctgccctaccacaccagcagcacccaccaccccgaggtgacccccaccagcaccaccaacatcacccccaagcacaccagcaccggcaccagaacccccgtggcccacaccaccagcgccagcagcagcagactgcccacccccttcaccacccacagcccccccaccggcagcagccccttcagcagcaccggccccatgaccgccaccagcttccagaccaccaccacctaccccacccccagccacccccagaccaccctgcccacccacgtgccccccttcagcaccagcctggtgacccccagcacccacaccgtgatcatcaccacccacacccagatggccaccagcgccagcatccacagcacccccaccggcaccgtgcccccccccaccaccctgaaggccaccggcagcacccacaccgccccccccatgaccgtgaccaccagcggcaccagccagacccacagcagcttcagcaccgccaccgccagcagcagcttcatcagcagcagcagctggctgccccagaacagcagcagcagaccccccagcagccccatcaccacccagctgccccacctgagcagcgccaccacccccgtgagcaccaccaaccagctgagcagcagcttcagccccagccccagcgcccccagcaccgtgagcagctacgtgcccagcagccacagcagcccccagaccagcagccccagcgtgggcaccagcagcagcttcgtgagcgcccccgtgcacagcaccaccctgagcagcggcagccacagcagcctgagcacccaccccaccaccgccagcgtgagcgccagccccctgttccccagcagccccgccgccagcaccaccatcagagccaccctgccccacaccatcagcagccccttcaccctgagcgccctgctgcccatcagcaccgtgaccgtgagccccacccccagcagccacctggccagcagcaccatcgccttccccagcacccccagaaccaccgccagcacccacaccgcccccgccttcagcagccagagcaccaccagcagaagcaccagcctgaccaccagagtgcccaccagcggcttcgtgagcctgaccagcggcgtgaccggcatccccaccagccccgtgaccaacctgaccaccagacaccccggccccaccctgagccccaccaccagattcctgaccagcagcctgaccgcccacggcagcacccccgccagcgcccccgtgagcagcctgggcacccccacccccaccagccccggcgtgtgcagcgtgagagagcagcaggaggagatcaccttcaagggctgcatggccaacgtgaccgtgaccagatgcgagggcgcctgcatcagcgccgccagcttcaacatcatcacccagcaggtggacgccagatgcagctgctgcagacccctgcacagctacgagcagcagctggagctgccctgccccgaccccagcacccccggcagaagactggtgctgaccctgcaggtgttcagccactgcgtgtgcagcagcgtggcctgcggcgactag

SEQ ID NO: 89547 - DNA, 1134 bp, Artificial Sequence
  Description of Artificial Sequence: Synthetic coding sequence
atgaagaccctgcccctgttcgtgtgcatctgcgccctgagcgcctgcttcagcttcagcgagggcagagagagagaccacgagctgagacacagaagacaccaccaccagagccccaagagccacttcgagctgccccactaccccggcctgctggcccaccagaagcccttcatcagaaagagctacaagtgcctgcacaagagatgcagacccaagctgccccccagccccaacaacccccccaagttccccaacccccaccagccccccaagcaccccgacaagaacagcagcgtggtgaaccccaccctggtggccaccacccagatccccagcgtgaccttccccagcgccagcaccaagatcaccaccctgcccaacgtgaccttcctgccccagaacgccaccaccatcagcagcagagagaacgtgaacaccagcagcagcgtggccaccctggcccccgtgaacagccccgccccccaggacaccaccgccgccccccccacccccagcgccaccacccccgccccccccagcagcagcgccccccccgagaccaccgccgccccccccacccccagcgccaccacccaggccccccccagcagcagcgccccccccgagaccaccgccgccccccccaccccccccgccaccacccccgccccccccagcagcagcgccccccccgagaccaccgccgccccccccacccccagcgccaccacccccgcccccctgagcagcagcgccccccccgagaccaccgccgtgccccccacccccagcgccaccaccctggaccccagcagcgccagcgccccccccgagaccaccgccgccccccccacccccagcgccaccacccccgccccccccagcagccccgccccccaggagaccaccgccgcccccatcaccacccccaacagcagccccaccaccctggcccccgacaccagcgagaccagcgccgcccccacccaccagaccaccaccagcgtgaccacccagaccaccaccaccaagcagcccaccagcgcccccggccagaacaagatcagcagattcctgctgtacatgaagaacctgctgaacagaatcatcgacgacatggtggagcagtag

SEQ ID NO: 89548 - DNA, 1134 bp, Artificial Sequence; identical to SEQ ID NO: 89547
  Description of Artificial Sequence: Synthetic coding sequence

SEQ ID NO: 89549 - DNA, 1134 bp, Artificial Sequence; identical to SEQ ID NO: 89547
  Description of Artificial Sequence: Synthetic coding sequence

SEQ ID NO: 89550 - DNA, 411 bp, Artificial Sequence
  Description of Artificial Sequence: Synthetic coding sequence
atgaagaccctgcccctgttcgtgtgcatctgcgccctgagcgcctgcttcagcttcagcgagggcagagagagagaccacgagctgagacacagaagacaccaccaccagagccccaagagccacttcgagctgccccactaccccggcctgctggcccaccagaagcccttcatcagaaagagctacaagtgcctgcacaagagatgcagacccaagctgccccccagccccaacaacccccccaagttccccaacccccaccagccccccaagcaccccgacaagaacagcagcgtggtgaaccccaccctggtggccaccacccagatccccagcgtgaccttccccagcgccagcaccaagatcaccaccctgcccaacgtgaccttcctgccccagaacgcctag

SEQ ID NO: 89551 - DNA, 1743 bp, Artificial Sequence
  Description of Artificial Sequence: Synthetic coding sequence
atgaccgcccccgccggccccagaggcagcgagaccgagagactgctgacccccaaccccggctacggcacccaggccggccccagccccgccccccccaccccccccgaggaggaggacctgagaagaagactgaagtacttcttcatgagcccctgcgacaagttcagagccaagggcagaaagccctgcaagctgatgctgcaggtggtgaagatcctggtggtgaccgtgcagctgatcctgttcggcctgagcaaccagctggccgtgaccttcagagaggagaacaccatcgccttcagacacctgttcctgctgggctacagcgacggcgccgacgacaccttcgccgcctacaccagagagcagctgtaccaggccatcttccacgccgtggaccagtacctggccctgcccgacgtgagcctgggcagatacgcctacgtgagaggcggcggcgacccctggaccaacggcagcggcctggccctgtgccagagatactaccacagaggccacgtggaccccgccaacgacaccttcgacatcgaccccatggtggtgaccgactgcatccaggtggacccccccgagagacccccccccccccccagcgacgacctgaccctgctggagagcagcagcagctacaagaacctgaccctgaagttccacaagctggtgaacgtgaccatccacttcagactgaagaccatcaacctgcagagcctgatcaacaacgagatccccgactgctacaccttcagcgtgctgatcaccttcgacaacaaggcccacagcggcagaatccccatcagcctggagacccaggcccacatccaggagtgcaagcaccccagcgtgttccagcacggcgacaacagcttcagactgctgttcgacgtggtggtgatcctgacctgcagcctgagcttcctgctgtgcgccagaagcctgctgagaggcttcctgctgcagaacgagttcgtgggcttcatgtggagacagagaggcagagtgatcagcctgtgggagagactggagttcgtgaacggctggtacatcctgctggtgaccagcgacgtgctgaccatcagcggcaccatcatgaagatcggcatcgaggccaagaacctggccagctacgacgtgtgcagcatcctgctgggcaccagcaccctgctggtgtgggtgggcgtgatcagatacctgaccttcttccacaactacaacatcctgatcgccaccctgagagtggccctgcccagcgtgatgagattctgctgctgcgtggccgtgatctacctgggctactgcttctgcggctggatcgtgctgggcccctaccacgtgaagttcagaagcctgagcatggtgagcgagtgcctgttcagcctgatcaacggcgacgacatgttcgtgaccttcgccgccatgcaggcccagcagggcagaagcagcctggtgtggctgttcagccagctgtacctgtacagcttcatcagcctgttcatctacatggtgctgagcctgttcatcgccctgatcaccggcgcctacgacaccatcaagcaccccggcggcgccggcgccgaggagagcgagctgcaggcctacatcgcccagtgccaggacagccccaccagcggcaagttcagaagaggcagcggcagcgcctgcagcctgctgtgctgctgcggcagagaccccagcgaggagcacagcctgctggtgaactag

SEQ ID NO: 89552 - DNA, 1638 bp, Artificial Sequence
  Description of Artificial Sequence: Synthetic coding sequence
atgacccccagccagcccaccagaggcagcagctgcaccagacccagcagcatgctgtggaccagcacctggagatgcctgacctgccactgggccggcatgagaatgagcgtggtgggcgtgaccctgggccccatggcccagggcctgctgagcgccagcggcaccaccaccgaggccacctggaccagacccaccacccacctgaccctgatcagatggtggctgctgaccgccagcagatggatcccccccagcggccccctgagaccccccgccaccatcagccccagctggaaggccgcccccgtgaccagaaccagcagaagcaacagcaccagcaccgcctgcagcctggagggcggccccggctggggcagacagcacaccagacacagccaccccagcaactacttccccaaggtgggcaccggcccccccagacccagatggtgcctgctgggcgagcacttcccctgccagctgcagagccagcacgtggccggcgacgccggcacctggggcagaaagggccccgaggacgcccccgacccccaccccagcctgctgcccagactggtgaacgtgaccatccacttcagactgaagaccatcaacctgcagagcctgatcaacaacgagatccccgactgctacaccttcagcgtgctgatcaccttcgacaacaaggcccacagcggcagaatccccatcagcctggagacccaggcccacatccaggagtgcaagcaccccagcgtgttccagcacggcgacaacagcttcagactgctgttcgacgtggtggtgatcctgacctgcagcctgagcttcctgctgtgcgccagaagcctgctgagaggcttcctgctgcagaacgagttcgtgggcttcatgtggagacagagaggcagagtgatcagcctgtgggagagactggagttcgtgaacggctggtacatcctgctggtgaccagcgacgtgctgaccatcagcggcaccatcatgaagatcggcatcgaggccaagaacctggccagctacgacgtgtgcagcatcctgctgggcaccagcaccctgctggtgtgggtgggcgtgatcagatacctgaccttcttccacaactacaacatcctgatcgccaccctgagagtggccctgcccagcgtgatgagattctgctgctgcgtggccgtgatctacctgggctactgcttctgcggctggatcgtgctgggcccctaccacgtgaagttcagaagcctgagcatggtgagcgagtgcctgttcagcctgatcaacggcgacgacatgttcgtgaccttcgccgccatgcaggcccagcagggcagaagcagcctggtgtggctgttcagccagctgtacctgtacagcttcatcagcctgttcatctacatggtgctgagcctgttcatcgccctgatcaccggcgcctacgacaccatcaagcaccccggcggcgccggcgccgaggagagcgagctgcaggcctacatcgcccagtgccaggacagccccaccagcggcaagttcagaagaggcagcggcagcgcctgcagcctgctgtgctgctgcggcagagaccccagcgaggagcacagcctgctggtgaactag

SEQ ID NO: 89553 - DNA, 1701 bp, Artificial Sequence
  Description of Artificial Sequence: Synthetic coding sequence
atggccagacagccctacagattcccccaggccagaatccccgagagaggcagcggcgtgttcagactgaccgtgagaaacgccatggcccacagagacagcgagatgaaggaggagtgcctgagagaggacctgaagttctacttcatgagcccctgcgagaagtacagagccagaagacagatcccctggaagctgggcctgcagatcctgaagatcgtgatggtgaccacccagctggtgagattcggcctgagcaaccagctggtggtggccttcaaggaggacaacaccgtggccttcaagcacctgttcctgaagggctacagcggcaccgacgaggacgactacagctgcagcgtgtacacccaggaggacgcctacgagagcatcttcttcgccatcaaccagtaccaccagctgaaggacatcaccctgggcaccctgggctacggcgagaacgaggacaacagaatcggcctgaaggtgtgcaagcagcactacaagaagggcaccatgttccccagcaacgagaccctgaacatcgacaacgacgtggagctggactgcgtgcagctggacctgcaggacctgagcaagaagccccccgactggaagaacagcagcttcttcagactggagttctacagactgctgcaggtggagatcagcttccacctgaagggcatcgacctgcagaccatccacagcagagagctgcccgactgctacgtgttccagaacaccatcatcttcgacaacaaggcccacagcggcaagatcaagatctacttcgacagcgacgccaagatcgaggagtgcaaggacctgaacatcttcggcagcacccagaagaacgcccagtacgtgctggtgttcgacgccttcgtgatcgtgatctgcctggccagcctgatcctgtgcaccagaagcatcgtgctggccctgagactgagaaagagattcctgaacttcttcctggagaagtacaagagacccgtgtgcgacaccgaccagtgggagttcatcaacggctggtacgtgctggtgatcatcagcgacctgatgaccatcatcggcagcatcctgaagatggagatcaaggccaagaacctgaccaactacgacctgtgcagcatcttcctgggcaccagcaccctgctggtgtgggtgggcgtgatcagatacctgggctacttccaggcctacaacgtgctgatcctgaccatgcaggccagcctgcccaaggtgctgagattctgcgcctgcgccggcatgatctacctgggctacaccttctgcggctggatcgtgctgggcccctaccacgacaagttcgagaacctgaacaccgtggccgagtgcctgttcagcctggtgaacggcgacgacatgttcgccaccttcgcccagatccagcagaagagcatcctggtgtggctgttcagcagactgtacctgtacagcttcatcagcctgttcatctacatgatcctgagcctgttcatcgccctgatcaccgacagctacgacaccatcaagaagttccagcagaacggcttccccgagaccgacctgcaggagttcctgaaggagtgcagcagcaaggaggagtaccagaaggagagcagcgccttcctgagctgcatctgctgcagaagaagaaagagaagcgacgaccacctgatccccatcagctag

SEQ ID NO: 89554 - DNA, 1662 bp, Artificial Sequence
  Description of Artificial Sequence: Synthetic coding sequence
atggccgaccccgaggtggtggtgagcagctgcagcagccacgaggaggagaacagatgcaacttcaaccagcagaccagccccagcgaggagctgctgctggaggaccagatgagaagaaagctgaagttcttcttcatgaacccctgcgagaagttctgggccagaggcagaaagccctggaagctggccatccagatcctgaagatcgccatggtgaccatccagctggtgctgttcggcctgagcaaccagatggtggtggccttcaaggaggagaacaccatcgccttcaagcacctgttcctgaagggctacatggacagaatggacgacacctacgccgtgtacacccagagcgacgtgtacgaccagctgatcttcgccgtgaaccagtacctgcagctgtacaacgtgagcgtgggcaaccacgcctacgagaacaagggcaccaagcagagcgccatggccatctgccagcacttctacaagagaggcaacatctaccccggcaacgacaccttcgacatcgaccccgagatcgagaccgagtgcttcttcgtggagcccgacgagcccttccacatcggcacccccgccgagaacaagctgaacctgaccctggacttccacagactgctgaccgtggagctgcagttcaagctgaaggccatcaacctgcagaccgtgagacaccaggagctgcccgactgctacgacttcaccctgaccatcaccttcgacaacaaggcccacagcggcagaatcaagatcagcctggacaacgacatcagcatcagagagtgcaaggactggcacgtgagcggcagcatccagaagaacacccactacatgatgatcttcgacgccttcgtgatcctgacctgcctggtgagcctgatcctgtgcatcagaagcgtgatcagaggcctgcagctgcagcaggagttcgtgaacttcttcctgctgcactacaagaaggaggtgagcgtgagcgaccagatggagttcgtgaacggctggtacatcatgatcatcatcagcgacatcctgaccatcatcggcagcatcctgaagatggagatccaggccaagagcctgaccagctacgacgtgtgcagcatcctgctgggcaccagcaccatgctggtgtggctgggcgtgatcagatacctgggcttcttcgccaagtacaacctgctgatcctgaccctgcaggccgccctgcccaacgtgatcagattctgctgctgcgccgccatgatctacctgggctactgcttctgcggctggatcgtgctgggcccctaccacgacaagttcagaagcctgaacatggtgagcgagtgcctgttcagcctgatcaacggcgacgacatgttcgccaccttcgccaagatgcagcagaagagctacctggtgtggctgttcagcagaatctacctgtacagcttcatcagcctgttcatctacatgatcctgagcctgttcatcgccctgatcaccgacacctacgagaccatcaagcagtaccagcaggacggcttccccgagaccgagctgagaaccttcatcagcgagtgcaaggacctgcccaacagcggcaagtacagactggaggacgacccccccgtgagcctgttctgctgctgcaagaagtag

SEQ ID NO: 89555 - DNA, 1494 bp, Artificial Sequence
  Description of Artificial Sequence: Synthetic coding sequence
atggccgaccccgaggtggtggtgagcagctgcagcagccacgaggaggagaacagatgcaacttcaaccagcagaccagccccagcgaggagctgctgctggaggaccagatgagaagaaagctgaagttcttcttcatgaacccctgcgagaagttctgggccagaggcagaaagccctggaagctggccatccagatcctgaagatcgccatggtgaccatccagtacctgcagctgtacaacgtgagcgtgggcaaccacgcctacgagaacaagggcaccaagcagagcgccatggccatctgccagcacttctacaagagaggcaacatctaccccggcaacgacaccttcgacatcgaccccgagatcgagaccgagtgcttcttcgtggagcccgacgagcccttccacatcggcacccccgccgagaacaagctgaacctgaccctggacttccacagactgctgaccgtggagctgcagttcaagctgaaggccatcaacctgcagaccgtgagacaccaggagctgcccgactgctacgacttcaccctgaccatcaccttcgacaacaaggcccacagcggcagaatcaagatcagcctggacaacgacatcagcatcagagagtgcaaggactggcacgtgagcggcagcatccagaagaacacccactacatgatgatcttcgacgccttcgtgatcctgacctgcctggtgagcctgatcctgtgcatcagaagcgtgatcagaggcctgcagctgcagcaggagttcgtgaacttcttcctgctgcactacaagaaggaggtgagcgtgagcgaccagatggagttcgtgaacggctggtacatcatgatcatcatcagcgacatcctgaccatcatcggcagcatcctgaagatggagatccaggccaagagcctgaccagctacgacgtgtgcagcatcctgctgggcaccagcaccatgctggtgtggctgggcgtgatcagatacctgggcttcttcgccaagtacaacctgctgatcctgaccctgcaggccgccctgcccaacgtgatcagattctgctgctgcgccgccatgatctacctgggctactgcttctgcggctggatcgtgctgggcccctaccacgacaagttcagaagcctgaacatggtgagcgagtgcctgttcagcctgatcaacggcgacgacatgttcgccaccttcgccaagatgcagcagaagagctacctggtgtggctgttcagcagaatctacctgtacagcttcatcagcctgttcatctacatgatcctgagcctgttcatcgccctgatcaccgacacctacgagaccatcaagcagtaccagcaggacggcttccccgagaccgagctgagaaccttcatcagcgagtgcaaggacctgcccaacagcggcaagtacagactggaggacgacccccccgtgagcctgttctgctgctgcaagaagtag

SEQ ID NO: 89556 - DNA, 966 bp, Artificial Sequence
  Description of Artificial Sequence: Synthetic coding sequence
atggccgaccccgaggtggtggtgagcagctgcagcagccacgaggaggagaacagatgcaacttcaaccagcagaccagccccagcgaggagctgctgctggaggaccagatgagaagaaagctgaagttcttcttcatgaacccctgcgagaagttctgggccagaggcagaaagccctggaagctggccatccagatcctgaagatcgccatggtgaccatccagctggtgctgttcggcctgagcaaccagatggtggtggccttcaaggaggagaacaccatcgccttcaagcacctgttcctgaagggctacatggacagaatggacgacacctacgccgtgtacacccagagcgacgtgtacgaccagctgatcttcgccgtgaaccagtacctgcagctgtacaacgtgagcgtgggcaaccacgcctacgagaacaagggcaccaagcagagcgccatggccatctgccagcacttctacaagagaggcaacatctaccccggcaacgacaccttcgacatcgaccccgagatcgagaccgagtgcttcttcgtggagcccgacgagcccttccacatcggcacccccgccgagaacaagctgaacctgaccctggacttccacagactgctgaccgtggagctgcagttcaagctgaaggccatcaacctgcagaccgtgagacaccaggagctgcccgactgctacgacttcaccctgaccatcaccttcgacaacaaggcccacagcggcagaatcaagatcagcctggacaacgacatcagcatcagagagtgcaaggactggcacgtgagcggcagcatccagaagaacacccactacatgatgatcttcgacgccttcgtgatcctgacctgcctggtgagcctgatcctgtgcatcagaagcgtgatcagaggcctgcagctgcagcaggtgggcaacgtggccttctag

SEQ ID NO: 89557 - DNA, 1494 bp, Artificial Sequence; identical to SEQ ID NO: 89555
  Description of Artificial Sequence: Synthetic coding sequence

SEQ ID NO: 89558 - DNA, 1662 bp, Artificial Sequence; identical to SEQ ID NO: 89554
  Description of Artificial Sequence: Synthetic coding sequence

SEQ ID NO: 89559 - DNA, 2442 bp, Artificial Sequence
  Description of Artificial Sequence: Synthetic coding sequence
atgagcctgctgggcgaccccctgcaggccctgccccccagcgccgcccccaccggccccctgctggccccccccgccggcgccaccctgaacagactgagagagcccctgctgagaagactgagcgagctgctggaccaggcccccgagggcagaggctggagaagactggccgagctggccggcagcagaggcagactgagactgagctgcctggacctggagcagtgcagcctgaaggtgctggagcccgagggcagccccagcctgtgcctgctgaagctgatgggcgagaagggctgcaccgtgaccgagctgagcgacttcctgcaggccatggagcacaccgaggtgctgcagctgctgagcccccccggcatcaagatcaccgtgaaccccgagagcaaggccgtgctggccggccagttcgtgaagctgtgctgcagagccaccggccaccccttcgtgcagtaccagtggttcaagatgaacaaggagatccccaacggcaacaccagcgagctgatcttcaacgccgtgcacgtgaaggacgccggcttctacgtgtgcagagtgaacaacaacttcaccttcgagttcagccagtggagccagctggacgtgtgcgacatccccgagagcttccagagaagcgtggacggcgtgagcgagagcaagctgcagatctgcgtggagcccaccagccagaagctgatgcccggcagcaccctggtgctgcagtgcgtggccgtgggcagccccatcccccactaccagtggttcaagaacgagctgcccctgacccacgagaccaagaagctgtacatggtgccctacgtggacctggagcaccagggcacctactggtgccacgtgtacaacgacagagacagccaggacagcaagaaggtggagatcatcatcgacgagctgaacaacctgggccaccccgacaacaaggagcagaccaccgaccagcccctggccaaggacaaggtggccctgctgatcggcaacatgaactacagagagcaccccaagctgaaggcccccctggtggacgtgtacgagctgaccaacctgctgagacagctggacttcaaggtggtgagcctgctggacctgaccgagtacgagatgagaaacgccgtggacgagttcctgctgctgctggacaagggcgtgtacggcctgctgtactacgccggccacggctacgagaacttcggcaacagcttcatggtgcccgtggacgcccccaacccctacagaagcgagaactgcctgtgcgtgcagaacatcctgaagctgatgcaggagaaggagaccggcctgaacgtgttcctgctggacatgtgcagaaagagaaacgactacgacgacaccatccccatcctggacgccctgaaggtgaccgccaacatcgtgttcggctacgccacctgccagggcgccgaggccttcgagatccagcacagcggcctggccaacggcatcttcatgaagttcctgaaggacagactgctggaggacaagaagatcaccgtgctgctggacgaggtggccgaggacatgggcaagtgccacctgaccaagggcaagcaggccctggagatcagaagcagcctgagcgagaagagagccctgaccgaccccatccagggcaccgagtacagcgccgagagcctggtgagaaacctgcagtgggccaaggcccacgagctgcccgagagcatgtgcctgaagttcgactgcggcgtgcagatccagctgggcttcgccgccgagttcagcaacgtgatgatcatctacaccagcatcgtgtacaagccccccgagatcatcatgtgcgacgcctacgtgaccgacttccccctggacctggacatcgaccccaaggacgccaacaagggcacccccgaggagaccggcagctacctggtgagcaaggacctgcccaagcactgcctgtacaccagactgagcagcctgcagaagctgaaggagcacctggtgttcaccgtgtgcctgagctaccagtacagcggcctggaggacaccgtggaggacaagcaggaggtgaacgtgggcaagcccctgatcgccaagctggacatgcacagaggcctgggcagaaagacctgcttccagacctgcctgatgagcaacggcccctaccagagcagcgccgccaccagcggcggcgccggccactaccacagcctgcaggaccccttccacggcgtgtaccacagccaccccggcaaccccagcaacgtgacccccgccgacagctgccactgcagcagaacccccgacgccttcatcagcagcttcgcccaccacgccagctgccacttcagcagaagcaacgtgcccgtggagaccaccgacgagatccccttcagcttcagcgacagactgagaatcagcgagaagtag

SEQ ID NO: 89560 - DNA, 2475 bp, Artificial Sequence
  Description of Artificial Sequence: Synthetic coding sequence
atgagcctgctgggcgaccccctgcaggccctgccccccagcgccgcccccaccggccccctgctggccccccccgccggcgccaccctgaacagactgagagagcccctgctgagaagactgagcgagctgctggaccaggcccccgagggcagaggctggagaagactggccgagctggccggcagcagaggcagactgagactgagctgcctggacctggagcagtgcagcctgaaggtgctggagcccgagggcagccccagcctgtgcctgctgaagctgatgggcgagaagggctgcaccgtgaccgagctgagcgacttcctgcaggccatggagcacaccgaggtgctgcagctgctgagcccccccggcatcaagatcaccgtgaaccccgagagcaaggccgtgctggccggccagttcgtgaagctgtgctgcagagccaccggccaccccttcgtgcagtaccagtggttcaagatgaacaaggagatccccaacggcaacaccagcgagctgatcttcaacgccgtgcacgtgaaggacgccggcttctacgtgtgcagagtgaacaacaacttcaccttcgagttcagccagtggagccagctggacgtgtgcgacatccccgagagcttccagagaagcgtggacggcgtgagcgagagcaagctgcagatctgcgtggagcccaccagccagaagctgatgcccggcagcaccctggtgctgcagtgcgtggccgtgggcagccccatcccccactaccagtggttcaagaacgagctgcccctgacccacgagaccaagaagctgtacatggtgccctacgtggacctggagcaccagggcacctactggtgccacgtgtacaacgacagagacagccaggacagcaagaaggtggagatcatcatcggcagaaccgacgaggccgtggagtgcaccgaggacgagctgaacaacctgggccaccccgacaacaaggagcagaccaccgaccagcccctggccaaggacaaggtggccctgctgatcggcaacatgaactacagagagcaccccaagctgaaggcccccctggtggacgtgtacgagctgaccaacctgctgagacagctggacttcaaggtggtgagcctgctggacctgaccgagtacgagatgagaaacgccgtggacgagttcctgctgctgctggacaagggcgtgtacggcctgctgtactacgccggccacggctacgagaacttcggcaacagcttcatggtgcccgtggacgcccccaacccctacagaagcgagaactgcctgtgcgtgcagaacatcctgaagctgatgcaggagaaggagaccggcctgaacgtgttcctgctggacatgtgcagaaagagaaacgactacgacgacaccatccccatcctggacgccctgaaggtgaccgccaacatcgtgttcggctacgccacctgccagggcgccgaggccttcgagatccagcacagcggcctggccaacggcatcttcatgaagttcctgaaggacagactgctggaggacaagaagatcaccgtgctgctggacgaggtggccgaggacatgggcaagtgccacctgaccaagggcaagcaggccctggagatcagaagcagcctgagcgagaagagagccctgaccgaccccatccagggcaccgagtacagcgccgagagcctggtgagaaacctgcagtgggccaaggcccacgagctgcccgagagcatgtgcctgaagttcgactgcggcgtgcagatccagctgggcttcgccgccgagttcagcaacgtgatgatcatctacaccagcatcgtgtacaagccccccgagatcatcatgtgcgacgcctacgtgaccgacttccccctggacctggacatcgaccccaaggacgccaacaagggcacccccgaggagaccggcagctacctggtgagcaaggacctgcccaagcactgcctgtacaccagactgagcagcctgcagaagctgaaggagcacctggtgttcaccgtgtgcctgagctaccagtacagcggcctggaggacaccgtggaggacaagcaggaggtgaacgtgggcaagcccctgatcgccaagctggacatgcacagaggcctgggcagaaagacctgcttccagacctgcctgatgagcaacggcccctaccagagcagcgccgccaccagcggcggcgccggccactaccacagcctgcaggaccccttccacggcgtgtaccacagccaccccggcaaccccagcaacgtgacccccgccgacagctgccactgcagcagaacccccgacgccttcatcagcagcttcgcccaccacgccagctgccacttcagcagaagcaacgtgcccgtggagaccaccgacgagatccccttcagcttcagcgacagactgagaatcagcgagaagtag

SEQ ID NO: 89561 - DNA, 441 bp, Artificial Sequence
  Description of Artificial Sequence: Synthetic coding sequence
atgaccatgagaagcctgctgagaacccccttcctgtgcggcctgctgtgggccttctgcgcccccggcgccagagccgaggagcccgccgccagcttcagccagcccggcagcatgggcctggacaagaacaccgtgcacgaccaggagcacatcatggagcacctggagggcgtgatcaacaagcccgaggccgagatgagcccccaggagctgcagctgcactacttcaagatgcacgactacgacggcaacaacctgctggacggcctggagctgagcaccgccatcacccacgtgcacaaggaggagggcagcgagcaggcccccctgatgagcgaggacgagctgatcaacatcatcgacggcgtgctgagagacgacgacaagaacaacgacggctacatcgactacgccgagttcgccaagagcctgcagtag

SEQ ID NO: 89562 - DNA, 441 bp, Artificial Sequence; identical to SEQ ID NO: 89561
  Description of Artificial Sequence: Synthetic coding sequence

SEQ ID NO: 89563 - DNA, 285 bp, Artificial Sequence
  Description of Artificial Sequence: Synthetic coding sequence
atggagcacctggagggcgtgatcaacaagcccgaggccgagatgagcccccaggagctgcagctgcactacttcaagatgcacgactacgacggcaacaacctgctggacggcctggagctgagcaccgccatcacccacgtgcacaaggaggagggcagcgagcaggcccccctgatgagcgaggacgagctgatcaacatcatcgacggcgtgctgagagacgacgacaagaacaacgacggctacatcgactacgccgagttcgccaagagcctgcagtag

SEQ ID NO: 89564 - DNA, 441 bp, Artificial Sequence; identical to SEQ ID NO: 89561
  Description of Artificial Sequence: Synthetic coding sequence

SEQ ID NO: 89565 - DNA, 441 bp, Artificial Sequence; identical to SEQ ID NO: 89561
  Description of Artificial Sequence: Synthetic coding sequence

SEQ ID NO: 89566 - DNA, 285 bp, Artificial Sequence; identical to SEQ ID NO: 89563
  Description of Artificial Sequence: Synthetic coding sequence

SEQ ID NO: 89567 - DNA, 285 bp, Artificial Sequence; identical to SEQ ID NO: 89563
  Description of Artificial Sequence: Synthetic coding sequence

SEQ ID NO: 89568 - DNA, 441 bp, Artificial Sequence; identical to SEQ ID NO: 89561
  Description of Artificial Sequence: Synthetic coding sequence

SEQ ID NO: 89569 - DNA, 441 bp, Artificial Sequence; identical to SEQ ID NO: 89561
  Description of Artificial Sequence: Synthetic coding sequence

SEQ ID NO: 89570 - DNA, 186 bp, Artificial Sequence
  Description of Artificial Sequence: Synthetic coding sequence
atgaccatgagaagcctgctgagaacccccttcctgtgcggcctgctgtgggccttctgcgcccccggcgccagagccgaggagcccgccgccagcttcagccagcccggcagcatgggcctggacaagaacaccgtgcacgaccaggagcacatcatggagcacctggagggcgtgatcaactag

SEQ ID NO: 89571 - DNA, 384 bp, Artificial Sequence
  Description of Artificial Sequence: Synthetic coding sequence
atgctgagcgtgtgcagctgcagaaccagcagcggcatgagaagccagtggcccagcgccagacagagaagcagcagcctgagcaccttcagacacatcatggagcacctggagggcgtgatcaacaagcccgaggccgagatgagcccccaggagctgcagctgcactacttcaagatgcacgactacgacggcaacaacctgctggacggcctggagctgagcaccgccatcacccacgtgcacaaggaggagggcagcgagcaggcccccctgatgagcgaggacgagctgatcaacatcatcgacggcgtgctgagagacgacgacaagaacaacgacggctacatcgactacgccgagttcgccaagagcctgcagtag

SEQ ID NO: 89572 - DNA, 3423 bp, Artificial Sequence
  Description of Artificial Sequence: Synthetic coding sequence
atggtgatcagcctgaacagctgcctgagcttcatctgcctgctgctgtgccactggatcggcaccgccagccccctgaacctggaggaccccaacgtgtgcagccactgggagagctacagcgtgaccgtgcaggagagctacccccaccccttcgaccagatctactacaccagctgcaccgacatcctgaactggttcaagtgcaccagacacagagtgagctacagaaccgcctacagacacggcgagaagaccatgtacagaagaaagagccagtgctgccccggcttctacgagagcggcgagatgtgcgtgccccactgcgccgacaagtgcgtgcacggcagatgcatcgcccccaacacctgccagtgcgagcccggctggggcggcaccaactgcagcagcgcctgcgacggcgaccactggggcccccactgcaccagcagatgccagtgcaagaacggcgccctgtgcaaccccatcaccggcgcctgccactgcgccgccggcttcagaggctggagatgcgaggacagatgcgagcagggcacctacggcaacgactgccaccagagatgccagtgccagaacggcgccacctgcgaccacgtgaccggcgagtgcagatgcccccccggctacaccggcgccttctgcgaggacctgtgcccccccggcaagcacggcccccagtgcgagcagagatgcccctgccagaacggcggcgtgtgccaccacgtgaccggcgagtgcagctgccccagcggctggatgggcaccgtgtgcggccagccctgccccgagggcagattcggcaagaactgcagccaggagtgccagtgccacaacggcggcacctgcgacgccgccaccggccagtgccactgcagccccggctacaccggcgagagatgccaggacgagtgccccgtgggcacctacggcgtgctgtgcgccgagacctgccagtgcgtgaacggcggcaagtgctaccacgtgagcggcgcctgcctgtgcgaggccggcttcgccggcgagagatgcgaggccagactgtgccccgagggcctgtacggcatcaagtgcgacaagagatgcccctgccacctggagaacacccacagctgccaccccatgagcggcgagtgcgcctgcaagcccggctggagcggcctgtactgcaacgagacctgcagccccggcttctacggcgaggcctgccagcagatctgcagctgccagaacggcgccgactgcgacagcgtgaccggcaagtgcacctgcgcccccggcttcaagggcatcgactgcagcaccccctgccccctgggcacctacggcatcaactgcagcagcagatgcggctgcaagaacgacgccgtgtgcagccccgtggacggcagctgcacctgcaaggccggctggcacggcgtggactgcagcatcagatgccccagcggcacctggggcttcggctgcaacctgacctgccagtgcctgaacggcggcgcctgcaacaccctggacggcacctgcacctgcgcccccggctggagaggcgagaagtgcgagctgccctgccaggacggcacctacggcctgaactgcgccgagagatgcgactgcagccacgccgacggctgccaccccaccaccggccactgcagatgcctgcccggctggagcggcgtgcactgcgacagcgtgtgcgccgagggcagatggggccccaactgcagcctgccctgctactgcaagaacggcgccagctgcagccccgacgacggcatctgcgagtgcgcccccggcttcagaggcaccacctgccagagaatctgcagccccggcttctacggccacagatgcagccagacctgcccccagtgcgtgcacagcagcggcccctgccaccacatcaccggcctgtgcgactgcctgcccggcttcaccggcgccctgtgcaacgaggtgtgccccagcggcagattcggcaagaactgcgccggcatctgcacctgcaccaacaacggcacctgcaaccccatcgacagaagctgccagtgctaccccggctggatcggcagcgactgcagccagccctgcccccccgcccactggggccccaactgcatccacacctgcaactgccacaacggcgccttctgcagcgcctacgacggcgagtgcaagtgcacccccggctggaccggcctgtactgcacccagagatgccccctgggcttctacggcaaggactgcgccctgatctgccagtgccagaacggcgccgactgcgaccacatcagcggccagtgcacctgcagaaccggcttcatgggcagacactgcgagcagaagtgccccagcggcacctacggctacggctgcagacagatctgcgactgcctgaacaacagcacctgcgaccacatcaccggcacctgctactgcagccccggctggaagggcgccagatgcgaccaggccggcgtgatcatcgtgggcaacctgaacagcctgagcagaaccagcaccgccctgcccgccgacagctaccagatcggcgccatcgccggcatcatcatcctggtgctggtggtgctgttcctgctggccctgttcatcatctacagacacaagcagaagggcaaggagagcagcatgcccgccgtgacctacacccccgccatgagagtggtgaacgccgactacaccatcagcggcaccctgccccacagcaacggcggcaacgccaacagccactacttcaccaaccccagctaccacaccctgacccagtgcgccaccagcccccacgtgaacaacagagacagaatgaccgtgaccaagagcaagaacaaccagctgttcgtgaacctgaagaacgtgaaccccggcaagagaggccccgtgggcgactgcaccggcaccctgcccgccgactggaagcacggcggctacctgaacgagctgggcgccttcggcctggacagaagctacatgggcaagagcctgaaggacctgggcaagaacagcgagtacaacagcagcaactgcagcctgagcagcagcgagaacccctacgccaccatcaaggacccccccgtgctgatccccaagagcagcgagtgcggctacgtggagatgaagagccccgccagaagagacagcccctacgccgagatcaacaacagcaccagcgccaacagaaacgtgtacgaggtggagcccaccgtgagcgtggtgcagggcgtgttcagcaacaacggcagactgagccaggacccctacgacctgcccaagaacagccacatcccctgccactacgacctgctgcccgtgagagacagcagcagcagccccaagcaggaggacagcggcggcagcagcagcaacagcagcagcagcagcgagtag

SEQ ID NO: 89573 - DNA, 1704 bp, Artificial Sequence
  Description of Artificial Sequence: Synthetic coding sequence
atggtgatcagcctgaacagctgcctgagcttcatctgcctgctgctgtgccactggatcggcaccgccagccccctgaacctggaggaccccaacgtgtgcagccactgggagagctacagcgtgaccgtgcaggagagctacccccaccccttcgaccagatctactacaccagctgcaccgacatcctgaactggttcaagtgcaccagacacagagtgagctacagaaccgcctacagacacggcgagaagaccatgtacagaagaaagagccagtgctgccccggcttctacgagagcggcgagatgtgcgtgccccactgcgccgacaagtgcgtgcacggcagatgcatcgcccccaacacctgccagtgcgagcccggctggggcggcaccaactgcagcagcgcctgcgacggcgaccactggggcccccactgcaccagcagatgccagtgcaagaacggcgccctgtgcaaccccatcaccggcgcctgccactgcgccgccggcttcagaggctggagatgcgaggacagatgcgagcagggcacctacggcaacgactgccaccagagatgccagtgccagaacggcgccacctgcgaccacgtgaccggcgagtgcagatgcccccccggctacaccggcgccttctgcgaggacctgtgcccccccggcaagcacggcccccagtgcgagcagagatgcccctgccagaacggcggcgtgtgccaccacgtgaccggcgagtgcagctgccccagcggctggatgggcaccgtgtgcggccagccctgccccgagggcagattcggcaagaactgcagccaggagtgccagtgccacaacggcggcacctgcgacgccgccaccggccagtgccactgcagccccggctacaccggcgagagatgccaggacgagtgccccgtgggcacctacggcgtgctgtgcgccgagacctgccagtgcgtgaacggcggcaagtgctaccacgtgagcggcgcctgcctgtgcgaggccggcttcgccggcgagagatgcgaggccagactgtgccccgagggcctgtacggcatcaagtgcgacaagagatgcccctgccacctggagaacacccacagctgccaccccatgagcggcgagtgcgcctgcaagcccggctggagcggcctgtactgcaacgagacctgcagccccggcttctacggcgaggcctgccagcagatctgcagctgccagaacggcgccgactgcgacagcgtgaccggcaagtgcacctgcgcccccggcttcaagggcatcgactgcagcaccccctgccccctgggcacctacggcatcaactgcagcagcagatgcggctgcaagaacgacgccgtgtgcagccccgtggacggcagctgcacctgcaaggccggctggcacggcgtggactgcagcatcagatgccccagcggcacctggggcttcggctgcaacctgacctgccagtgcctgaacggcggcgcctgcaacaccctggacggcacctgcacctgcgcccccggctggagaggcgagaagtgcgagctgccctgccaggacggcacctacggcctgaactgcgccgagagatgcgactgcagccacgccgacggctgccaccccaccaccggccactgcagatgcctgcccggctggagcggcctgttctag

SEQ ID NO: 89574 - DNA, 3423 bp, Artificial Sequence; identical to SEQ ID NO: 89572
  Description of Artificial Sequence: Synthetic coding sequence

SEQ ID NO: 89575 - DNA, 2910 bp, Artificial Sequence
  Description of Artificial Sequence: Synthetic coding sequence
atgcacacccccagcatcagaagcatcacccacgacgcccagaccagcagcaccggcagcagcgcccccggcaccgccctgtgcaccgaggagtgcgtgcacggcagatgcgtgagccccgacacctgccactgcgagcccggctggggcggccccgactgcagcagcggctgcgacagcgaccactggggcccccactgcagcaacagatgccagtgccagaacggcgccctgtgcaaccccatcaccggcgcctgcgtgtgcgccgccggcttcagaggctggagatgcgaggagctgtgcgcccccggcacccacggcaagggctgccagctgccctgccagtgcagacacggcgccagctgcgaccccagagccggcgagtgcctgtgcgcccccggctacaccggcgtgtactgcgaggagctgtgcccccccggcagccacggcgcccactgcgagctgagatgcccctgccagaacggcggcacctgccaccacatcaccggcgagtgcgcctgcccccccggctggaccggcgccgtgtgcgcccagccctgcccccccggcaccttcggccagaactgcagccaggactgcccctgccaccacggcggccagtgcgaccacgtgaccggccagtgccactgcaccgccggctacatgggcgacagatgccaggaggagtgccccttcggcagcttcggcttccagtgcagccagcactgcgactgccacaacggcggccagtgcagccccaccaccggcgcctgcgagtgcgagcccggctacaagggccccagatgccaggagagactgtgccccgagggcctgcacggccccggctgcaccctgccctgcccctgcgacgccgacaacaccatcagctgccaccccgtgaccggcgcctgcacctgccagcccggctggagcggccaccactgcaacgagagctgccccgtgggctactacggcgacggctgccagctgccctgcacctgccagaacggcgccgactgccacagcatcaccggcggctgcacctgcgcccccggcttcatgggcgaggtgtgcgccgtgagctgcgccgccggcacctacggccccaactgcagcagcatctgcagctgcaacaacggcggcacctgcagccccgtggacggcagctgcacctgcaaggagggctggcagggcctggactgcaccctgccctgccccagcggcacctggggcctgaactgcaacgagagctgcacctgcgccaacggcgccgcctgcagccccatcgacggcagctgcagctgcacccccggctggctgggcgacacctgcgagctgccctgccccgacggcaccttcggcctgaactgcagcgagcactgcgactgcagccacgccgacggctgcgaccccgtgaccggccactgctgctgcctggccggctggaccggcatcagatgcgacagcacctgcccccccggcagatggggccccaactgcagcgtgagctgcagctgcgagaacggcggcagctgcagccccgaggacggcagctgcgagtgcgcccccggcttcagaggccccctgtgccagagaatctgcccccccggcttctacggccacggctgcgcccagccctgccccctgtgcgtgcacagcagcagaccctgccaccacatcagcggcatctgcgagtgcctgcccggcttcagcggcgccctgtgcaaccaggtgtgcgccggcggctacttcggccaggactgcgcccagctgtgcagctgcgccaacaacggcacctgcagccccatcgacggcagctgccagtgcttccccggctggatcggcaaggactgcagccaggcctgcccccccggcttctggggccccgcctgcttccacgcctgcagctgccacaacggcgccagctgcagcgccgaggacggcgcctgccactgcacccccggctggaccggcctgttctgcacccagagatgccccgccgccttcttcggcaaggactgcggcagagtgtgccagtgccagaacggcgccagctgcgaccacatcagcggcaagtgcacctgcagaaccggcttcaccggccagcactgcgagcagagatgcgcccccggcaccttcggctacggctgccagcagctgtgcgagtgcatgaacaacagcacctgcgaccacgtgaccggcacctgctactgcagccccggcttcaagggcatcagatgcgaccaggccgccctgatgatggaggagctgaacccctacaccaagatcagccccgccctgggcgccgagagacacagcgtgggcgccgtgaccggcatcatgctgctgctgttcctgatcgtggtgctgctgggcctgttcgcctggcacagaagaagacagaaggagaagggcagagacctggcccccagagtgagctacacccccgccatgagaatgaccagcaccgactacagcctgagcggcgcctgcggcatggacagaagacagaacacctacatcatggacaagggcttcaaggactacatgaaggagagcgtgtgcagcagcagcacctgcagcctgaacagcagcgagaacccctacgccaccatcaaggacccccccatcctgacctgcaagctgcccgagagcagctacgtggagatgaagagccccgtgcacatgggcagcccctacaccgacgtgcccagcctgagcaccagcaacaagaacatctacgaggtggagcccaccgtgagcgtggtgcaggagggctgcggccacaacagcagctacatccagaacgcctacgacctgcccagaaacagccacatccccggccactacgacctgctgcccgtgagacagagccccgccaacggccccagccaggacaagcagagctag

SEQ ID NO: 89576 - DNA, 2628 bp, Artificial Sequence
  Description of Artificial Sequence: Synthetic coding sequence
atggtgctgagcctgaccggcctgatcgccttcagcttcctgcaggccaccctggccctgaaccccgaggaccccaacgtgtgcagccactgggagagctacgccgtgaccgtgcaggagagctacgcccaccccttcgaccagatctactacaccagatgcaccgacatcctgaactggttcaagtgcaccagacacagaatcagctacaagaccgcctacagaagaggcctgagaaccatgtacagaagaagaagccagtgctgccccggctactacgagagcggcgacttctgcatccccctgtgcaccgaggagtgcgtgcacggcagatgcgtgagccccgacacctgccactgcgagcccggctggggcggccccgactgcagcagcggctgcgacagcgaccactggggcccccactgcagcaacagatgccagtgccagaacggcgccctgtgcaaccccatcaccggcgcctgcgtgtgcgccgccggcttcagaggctggagatgcgaggagctgtgcgcccccggcacccacggcaagggctgccagctgccctgccagtgcagacacggcgccagctgcgaccccagagccggcgagtgcctgtgcgcccccggctacaccggcgtgtactgcgaggagctgtgcccccccggcagccacggcgcccactgcgagctgagatgcccctgccagaacggcggcacctgccaccacatcaccggcgagtgcgcctgcccccccggctggaccggcgccgtgtgcgcccagccctgcccccccggcaccttcggccagaactgcagccaggactgcccctgccaccacggcggccagtgcgaccacgtgaccggccagtgccactgcaccgccggctacatgggcgacagatgccaggaggagtgccccttcggcagcttcggcttccagtgcagccagcactgcgactgccacaacggcggccagtgcagccccaccaccggcgcctgcgagtgcgagcccggctacaagggccccagatgccaggagagactgtgccccgagggcctgcacggccccggctgcaccctgccctgcccctgcgacgccgacaacaccatcagctgccaccccgtgaccggcgcctgcacctgccagcccggctggagcggccaccactgcaacgagagctgccccgtgggctactacggcgacggctgccagctgccctgcacctgccagaacggcgccgactgccacagcatcaccggcggctgcacctgcgcccccggcttcatgggcgaggtgtgcgccgtgagctgcgccgccggcacctacggccccaactgcagcagcatctgcagctgcaacaacggcggcacctgcagccccgtggacggcagctgcacctgcaaggagggctggcagggcctggactgcaccctgccctgccccagcggcacctggggcctgaactgcaacgagagctgcacctgcgccaacggcgccgcctgcagccccatcgacggcagctgcagctgcacccccggctggctgggcgacacctgcgagctgccctgccccgacggcaccttcggcctgaactgcagcgagcactgcgactgcagccacgccgacggctgcgaccccgtgaccggccactgctgctgcctggccggctggaccggcatcagatgcgacagcacctgcccccccggcagatggggccccaactgcagcgtgagctgcagctgcgagaacggcggcagctgcagccccgaggacggcagctgcgagtgcgcccccggcttcagaggccccctgtgccagagaatctgcccccccggcttctacggccacggctgcgcccagccctgccccctgtgcgtgcacagcagcagaccctgccaccacatcagcggcatctgcgagtgcctgcccggcttcagcggcgccctgtgcaaccaggtgtgcgccggcggctacttcggccaggactgcgcccagctgtgcagctgcgccaacaacggcacctgcagccccatcgacggcagctgccagtgcttccccggctggatcggcaaggactgcagccaggcctgcccccccggcttctggggccccgcctgcttccacgcctgcagctgccacaacggcgccagctgcagcgccgaggacggcgcctgccactgcacccccggctggaccggcctgttctgcacccagagaaagccccacctgctggccagccagcccctgagaatcccctgctgcggcctgctggccaccgtgggcatcgtgcagaccagcagagagggcggcatgcaggccgcccccggcctggtggtgcccgacagctgccccaccagaaccgaggagctgtgcagaggcagcagcagacccgactggatccagggcatcgacaagcccaaggtgctggagggccagggctgcaaggccgcccagcagcacttcctgggcagaaccgtgggcgcctacgccagcgtgagaatggcccccgccgtgaccaccagcgtggccagcgcccccgccgcccaggccagccccggcaacaccgtgagcagagacgtgccccaggagcccctggccatgggcgtgagcagctacgtgagcgcctag

SEQ ID NO: 89577 - DNA, 414 bp, Artificial Sequence
  Description of Artificial Sequence: Synthetic coding sequence
atgatggaggagctgaacccctacaccaagatcagccccgccctgggcgccgagagacacagcgtgggcgccgtgaccggcatcatgctgctgctgttcctgatcgtggtgctgctgggcctgttcgcctggcacagaagaagacagaaggagaagggcagagacctggcccccagagtgagctacacccccgccatgagaatgaccagcaccgactacagcctgagcgccagcaccaccccctggtggcccgtgatggagcacctggccagacccttcagccagagacccagaacccagctgagcaacaagagcctggacagagacaccgccggctggaccccctacagctacgtgaacgtgctggaccagtgccccggcggccaggtgcccgccagaggcctgctgcactag

SEQ ID NO: 89578 - DNA, 2910 bp, Artificial Sequence; identical to SEQ ID NO: 89575
  Description of Artificial Sequence: Synthetic coding sequence

SEQ ID NO: 89579 - DNA, 3135 bp, Artificial Sequence
  Description of Artificial Sequence: Synthetic coding sequence
atggtgctgagcctgaccggcctgatcgccttcagcttcctgcaggccaccctggccctgaaccccgaggaccccaacgtgtgcagccactgggagagctacgccgtgaccgtgcaggagagctacgcccaccccttcgaccagatctactacaccagatgcaccgacatcctgaactggttcaagtgcaccagacacagaatcagctacaagaccgcctacagaagaggcctgagaaccatgtacagaagaagaagccagtgctgccccggctactacgagagcggcgacttctgcatccccctgtgcaccgaggagtgcgtgcacggcagatgcgtgagccccgacacctgccactgcgagcccggctggggcggccccgactgcagcagcggctgcgacagcgaccactggggcccccactgcagcaacagatgccagtgccagaacggcgccctgtgcaaccccatcaccggcgcctgcgtgtgcgccgccggcttcagaggctggagatgcgaggagctgtgcgcccccggcacccacggcaagggctgccagctgccctgccagtgcagacacggcgccagctgcgaccccagagccggcgagtgcctgtgcgcccccggctacaccggcgtgtactgcgaggagctgtgcccccccggcagccacggcgcccactgcgagctgagatgcccctgccagaacggcggcacctgccaccacatcaccggcgagtgcgcctgcccccccggctggaccggcgccgtgtgcgcccagccctgcccccccggcaccttcggccagaactgcagccaggactgcccctgccaccacggcggccagtgcgaccacgtgaccggccagtgccactgcaccgccggctacatgggcgacagatgccaggaggagtgccccttcggcagcttcggcttccagtgcagccagcactgcgactgccacaacggcggccagtgcagccccaccaccggcgcctgcgagtgcgagcccggctacaagggccccagatgccaggagagactgtgccccgagggcctgcacggccccggctgcaccctgccctgcccctgcgacgccgacaacaccatcagctgccaccccgtgaccggcgcctgcacctgccagcccggctggagcggccaccactgcaacgagagctgccccgtgggctactacggcgacggctgccagctgccctgcacctgccagaacggcgccgactgccacagcatcaccggcggctgcacctgcgcccccggcttcatgggcgaggtgtgcgccgtgagctgcgccgccggcacctacggccccaactgcagcagcatctgcagctgcaacaacggcggcacctgcagccccgtggacggcagctgcacctgcaaggagggctggcagggcctggactgcaccctgccctgccccagcggcacctggggcctgaactgcaacgagagctgcacctgcgccaacggcgccgcctgcagccccatcgacggcagctgcagctgcacccccggctggctgggcgacacctgcgagctgccctgccccgacggcaccttcggcctgaactgcagcgagcactgcgactgcagccacgccgacggctgcgaccccgtgaccggccactgctgctgcctggccggctggaccggcatcagatgcgacagcacctgcccccccggcagatggggccccaactgcagcgtgagctgcagctgcgagaacggcggcagctgcagccccgaggacggcagctgcgagtgcgcccccggcttcagaggccccctgtgccagagaatctgcccccccggcttctacggccacggctgcgcccagccctgccccctgtgcgtgcacagcagcagaccctgccaccacatcagcggcatctgcgagtgcctgcccggcttcagcggcgccctgtgcaaccaggtgtgcgccggcggctacttcggccaggactgcgcccagctgtgcagctgcgccaacaacggcacctgcagccccatcgacggcagctgccagtgcttccccggctggatcggcaaggactgcagccaggcctgcccccccggcttctggggccccgcctgcttccacgcctgcagctgccacaacggcgccagctgcagcgccgaggacggcgcctgccactgcacccccggctggaccggcctgttctgcacccagagatgccccgccgccttcttcggcaaggactgcggcagagtgtgccagtgccagaacggcgccagctgcgaccacatcagcggcaagtgcacctgcagaaccggcttcaccggccagcactgcgagcagagatgcgcccccggcaccttcggctacggctgccagcagctgtgcgagtgcatgaacaacagcacctgcgaccacgtgaccggcacctgctactgcagccccggcttcaagggcatcagatgcgaccaggccgccctgatgatggaggagctgaacccctacaccaagatcagccccgccctgggcgccgagagacacagcgtgggcgccgtgaccggcatcatgctgctgctgttcctgatcgtggtgctgctgggcctgttcgcctggcacagaagaagacagaaggagaagggcagagacctggcccccagagtgagctacacccccgccatgagaatgaccagcaccgactacagcctgagcggcgcctgcggcatggacagaagacagaacacctacatcatggacaagggcttcaaggactacatgaaggagagcgtgtgcagcagcagcacctgcagcctgaacagcagcgagaacccctacgccaccatcaaggacccccccatcctgacctgcaagctgcccgagagcagctacgtggagatgaagagccccgtgcacatgggcagcccctacaccgacgtgcccagcctgagcaccagcaacaagaacatctacgaggtggagcccaccgtgagcgtggtgcaggagggctgcggccacaacagcagctacatccagaacgcctacgacctgcccagaaacagccacatccccggccactacgacctgctgcccgtgagacagagccccgccaacggccccagccaggacaagcagagctag

SEQ ID NO: 89580 - DNA, 3135 bp, Artificial Sequence; identical to SEQ ID NO: 89579
  Description of Artificial Sequence: Synthetic coding sequence

SEQ ID NO: 89581 - DNA, 3690 bp, Artificial Sequence
  Description of Artificial Sequence: Synthetic coding sequence
atgggcgccagcagagacagaggcctggccgccctgtggtgcctgggcctgctgggcggcctggccagagtggccggcacccactacagatacctgtggagaggctgctacccctgccacctgggccaggccggctaccccgtgagcgccggcgaccagagacccgacgtggacgagtgcagaacccacaacggcggctgccagcacagatgcgtgaacacccccggcagctacctgtgcgagtgcaagcccggcttcagactgcacaccgacagcagaacctgcctggccatcaacagctgcgccctgggcaacggcggctgccagcaccactgcgtgcagctgaccatcaccagacacagatgccagtgcagacccggcttccagctgcaggaggacggcagacactgcgtgagaagaagcccctgcgccaacagaaacggcagctgcatgcacagatgccaggtggtgagaggcctggccagatgcgagtgccacgtgggctaccagctggccgccgacggcaaggcctgcgaggacgtggacgagtgcgccgccggcctggcccagtgcgcccacggctgcctgaacacccagggcagcttcaagtgcgtgtgccacgccggctacgagctgggcgccgacggcagacagtgctacagaatcgagatggagatcgtgaacagctgcgaggccaacaacggcggctgcagccacggctgcagccacaccagcgccggccccctgtgcacctgccccagaggctacgagctggacaccgaccagagaacctgcatcgacgtggacgactgcgccgacagcccctgctgccagcaggtgtgcaccaacaaccccggcggctacgagtgcggctgctacgccggctacagactgagcgccgacggctgcggctgcgaggacgtggacgagtgcgccagcagcagaggcggctgcgagcaccactgcaccaacctggccggcagcttccagtgcagctgcgaggccggctacagactgcacgaggacagaagaggctgcagccccctggaggagcccatggtggacctggacggcgagctgcccttcgtgagacccctgccccacatcgccgtgctgcaggacgagctgccccagctgttccaggacgacgacgtgggcgccgacgaggaggaggccgagctgagaggcgagcacaccctgaccgagaagttcgtgtgcctggacgacagcttcggccacgactgcagcctgacctgcgacgactgcagaaacggcggcacctgcctgctgggcctggacggctgcgactgccccgagggctggaccggcctgatctgcaacgagacctgcccccccgacaccttcggcaagaactgcagcttcagctgcagctgccagaacggcggcacctgcgacagcgtgaccggcgcctgcagatgcccccccggcgtgagcggcaccaactgcgaggacggctgccccaagggctactacggcaagcactgcagaaagaagtgcaactgcgccaacagaggcagatgccacagactgtacggcgcctgcctgtgcgaccccggcctgtacggcagattctgccacctgacctgccccccctgggccttcggccccggctgcagcgaggagtgccagtgcgtgcagccccacacccagagctgcgacaagagagacggcagctgcagctgcaaggccggcttcagaggcgagagatgccaggccgagtgcgagctgggctacttcggccccggctgctggcaggcctgcacctgccccgtgggcgtggcctgcgacagcgtgagcggcgagtgcggcaagagatgccccgccggcttccagggcgaggactgcggccaggagtgccccgtgggcaccttcggcgtgaactgcagcagcagctgcagctgcggcggcgccccctgccacggcgtgaccggccagtgcagatgcccccccggcagaaccggcgaggactgcgaggccgactgccccgagggcagatggggcctgggctgccaggagatctgccccgcctgccagcacgccgccagatgcgaccccgagaccggcgcctgcctgtgcctgcccggcttcgtgggcagcagatgccaggacgtgtgccccgccggctggtacggccccagctgccagaccagatgcagctgcgccaacgacggccactgccaccccgccaccggccactgcagctgcgcccccggctggaccggcttcagctgccagagagcctgcgacaccggccactggggccccgactgcagccacccctgcaactgcagcgccggccacggcagctgcgacgccatcagcggcctgtgcctgtgcgaggccggctacgtgggccccagatgcgagcagcagtgcccccagggccacttcggccccggctgcgagcagagatgccagtgccagcacggcgccgcctgcgaccacgtgagcggcgcctgcacctgccccgccggctggagaggcaccttctgcgagcacgcctgccccgccggcttcttcggcctggactgcagaagcgcctgcaactgcaccgccggcgccgcctgcgacgccgtgaacggcagctgcctgtgccccgccggcagaagaggccccagatgcgccgagaagtgcctgcccagagacgtgagagccggctgcagacacagcggcggctgcctgaacggcggcctgtgcgacccccacaccggcagatgcctgtgccccgccggctggaccggcgacaagtgccagagcccctgcctgagaggctggttcggcgaggcctgcgcccagagatgcagctgcccccccggcgccgcctgccaccacgtgaccggcgcctgcagatgcccccccggcttcaccggcagcggctgcgagcagggctgcccccccggcagatacggccccggctgcgagcagctgtgcggctgcctgaacggcggcagctgcgacgccgccaccggcgcctgcagatgccccaccggcttcctgggcaccgactgcaacctgacctgcccccagggcagattcggccccaactgcacccacgtgtgcggctgcggccagggcgccgcctgcgaccccgtgaccggcacctgcctgtgcccccccggcagagccggcgtgagatgcgagagaggctgcccccagaacagattcggcgtgggctgcgagcacacctgcagctgcagaaacggcggcctgtgccacgccagcaacggcagctgcagctgcggcctgggctggaccggcagacactgcgagctggcctgcccccccggcagatacggcgccgcctgccacctggagtgcagctgccacaacaacagcacctgcgagcccgccaccggcacctgcagatgcggccccggcttctacggccaggcctgcgagcacagaagaagcggcgccacctgcaacctggactgcagaagaggccagttcggccccagctgcaccctgcactgcgactgcggcggcggcgccgactgcgaccccgtgagcggccagtgccactgcgtggacggctacatgggccccacctgcagagagggcggccccctgagactgcccgagaaccccagcctggcccagggcagcgccggcaccctgcccgccagcagcagacccaccagcagaagcggcggccccgccagacactag

SEQ ID NO: 89582 - DNA, 4626 bp, Artificial Sequence
  Description of Artificial Sequence: Synthetic coding sequence
atgagcttcctggaggaggccagagccgccggcagagccgtggtgctggccctggtgctgctgctgctgcccgccgtgcccgtgggcgccagcgtgccccccagacccctgctgcccctgcagcccggcatgccccacgtgtgcgccgagcaggagctgaccctggtgggcagaagacagccctgcgtgcaggccctgagccacaccgtgcccgtgtggaaggccggctgcggctggcaggcctggtgcgtgggccacgagagaagaaccgtgtactacatgggctacagacaggtgtacaccaccgaggccagaaccgtgctgagatgctgcagaggctggatgcagcagcccgacgaggagggctgcctgagcgccgagtgcagcgccagcctgtgcttccacggcggcagatgcgtgcccggcagcgcccagccctgccactgcccccccggcttccagggccccagatgccagtacgacgtggacgagtgcagaacccacaacggcggctgccagcacagatgcgtgaacacccccggcagctacctgtgcgagtgcaagcccggcttcagactgcacaccgacagcagaacctgcctggccatcaacagctgcgccctgggcaacggcggctgccagcaccactgcgtgcagctgaccatcaccagacacagatgccagtgcagacccggcttccagctgcaggaggacggcagacactgcgtgagaagaagcccctgcgccaacagaaacggcagctgcatgcacagatgccaggtggtgagaggcctggccagatgcgagtgccacgtgggctaccagctggccgccgacggcaaggcctgcgaggacgtggacgagtgcgccgccggcctggcccagtgcgcccacggctgcctgaacacccagggcagcttcaagtgcgtgtgccacgccggctacgagctgggcgccgacggcagacagtgctacagaatcgagatggagatcgtgaacagctgcgaggccaacaacggcggctgcagccacggctgcagccacaccagcgccggccccctgtgcacctgccccagaggctacgagctggacaccgaccagagaacctgcatcgacgtggacgactgcgccgacagcccctgctgccagcaggtgtgcaccaacaaccccggcggctacgagtgcggctgctacgccggctacagactgagcgccgacggctgcggctgcgaggacgtggacgagtgcgccagcagcagaggcggctgcgagcaccactgcaccaacctggccggcagcttccagtgcagctgcgaggccggctacagactgcacgaggacagaagaggctgcagccccctggaggagcccatggtggacctggacggcgagctgcccttcgtgagacccctgccccacatcgccgtgctgcaggacgagctgccccagctgttccaggacgacgacgtgggcgccgacgaggaggaggccgagctgagaggcgagcacaccctgaccgagaagttcgtgtgcctggacgacagcttcggccacgactgcagcctgacctgcgacgactgcagaaacggcggcacctgcctgctgggcctggacggctgcgactgccccgagggctggaccggcctgatctgcaacgagacctgcccccccgacaccttcggcaagaactgcagcttcagctgcagctgccagaacggcggcacctgcgacagcgtgaccggcgcctgcagatgcccccccggcgtgagcggcaccaactgcgaggacggctgccccaagggctactacggcaagcactgcagaaagaagtgcaactgcgccaacagaggcagatgccacagactgtacggcgcctgcctgtgcgaccccggcctgtacggcagattctgccacctgacctgccccccctgggccttcggccccggctgcagcgaggagtgccagtgcgtgcagccccacacccagagctgcgacaagagagacggcagctgcagctgcaaggccggcttcagaggcgagagatgccaggccgagtgcgagctgggctacttcggccccggctgctggcaggcctgcacctgccccgtgggcgtggcctgcgacagcgtgagcggcgagtgcggcaagagatgccccgccggcttccagggcgaggactgcggccaggagtgccccgtgggcaccttcggcgtgaactgcagcagcagctgcagctgcggcggcgccccctgccacggcgtgaccggccagtgcagatgcccccccggcagaaccggcgaggactgcgaggccgactgccccgagggcagatggggcctgggctgccaggagatctgccccgcctgccagcacgccgccagatgcgaccccgagaccggcgcctgcctgtgcctgcccggcttcgtgggcagcagatgccaggacgtgtgccccgccggctggtacggccccagctgccagaccagatgcagctgcgccaacgacggccactgccaccccgccaccggccactgcagctgcgcccccggctggaccggcttcagctgccagagagcctgcgacaccggccactggggccccgactgcagccacccctgcaactgcagcgccggccacggcagctgcgacgccatcagcggcctgtgcctgtgcgaggccggctacgtgggccccagatgcgagcagcagtgcccccagggccacttcggccccggctgcgagcagagatgccagtgccagcacggcgccgcctgcgaccacgtgagcggcgcctgcacctgccccgccggctggagaggcaccttctgcgagcacgcctgccccgccggcttcttcggcctggactgcagaagcgcctgcaactgcaccgccggcgccgcctgcgacgccgtgaacggcagctgcctgtgccccgccggcagaagaggccccagatgcgccgagacctgccccgcccacacctacggccacaactgcagccaggcctgcgcctgcttcaacggcgccagctgcgaccccgtgcacggccagtgccactgcgcccccggctggatgggccccagctgcctgcaggcctgccccgccggcctgtacggcgacaactgcagacacagctgcctgtgccagaacggcggcacctgcgaccccgtgagcggccactgcgcctgccccgagggctgggccggcctggcctgcgagaaggagtgcctgcccagagacgtgagagccggctgcagacacagcggcggctgcctgaacggcggcctgtgcgacccccacaccggcagatgcctgtgccccgccggctggaccggcgacaagtgccagagcccctgcctgagaggctggttcggcgaggcctgcgcccagagatgcagctgcccccccggcgccgcctgccaccacgtgaccggcgcctgcagatgcccccccggcttcaccggcagcggctgcgagcaggcctgcccccccggcagcttcggcgaggactgcgcccagatgtgccagtgccccggcgagaaccccgcctgccaccccgccaccggcacctgcagctgcgccgccggctaccacggccccagctgccagcagagatgcccccccggcagatacggccccggctgcgagcagctgtgcggctgcctgaacggcggcagctgcgacgccgccaccggcgcctgcagatgccccaccggcttcctgggcaccgactgcaacctgacctgcccccagggcagattcggccccaactgcacccacgtgtgcggctgcggccagggcgccgcctgcgaccccgtgaccggcacctgcctgtgcccccccggcagagccggcgtgagatgcgagagaggctgcccccagaacagattcggcgtgggctgcgagcacacctgcagctgcagaaacggcggcctgtgccacgccagcaacggcagctgcagctgcggcctgggctggaccggcagacactgcgagctggcctgcccccccggcagatacggcgccgcctgccacctggagtgcagctgccacaacaacagcacctgcgagcccgccaccggcacctgcagatgcggccccggcttctacggccaggcctgcgagcacccctgcccccccggcttccacggcgccggctgccagggcctgtgctggtgccagcacggcgccccctgcgaccccatcagcggcagatgcctgtgccccgccggcttccacggccacttctgcgagagaggctgcgagcccggcagcttcggcgagggctgccaccagagatgcgactgcgacggcggcgccccctgcgaccccgtgaccggcctgtgcctgtgcccccccggcagaagcggcgccacctgcaacctggactgcagaagaggccagttcggccccagctgcaccctgcactgcgactgcggcggcggcgccgactgcgaccccgtgagcggccagtgccactgcgtggacggctacatgggccccacctgcagagagggcggccccctgagactgcccgagaaccccagcctggcccagggcagcgccggcaccctgcccgccagcagcagacccaccagcagaagcggcggccccgccagacactag

SEQ ID NO: 89583 - DNA, 8538 bp, Artificial Sequence
  Description of Artificial Sequence: Synthetic coding sequence
atggccctgggcaaggtgctggccatggccctggtgctggccctggccgtgctgggcagcctgagccccggcgccagagccggcgactgcaagggccagagacaggtgctgagagaggcccccggcttcgtgaccgacggcgccggcaactacagcgtgaacggcaactgcgagtggctgatcgaggcccccagcccccagcacagaatcctgctggacttcctgttcctggacaccgagtgcacctacgactacctgttcgtgtacgacggcgacagccccagaggccccctgctggccagcctgagcggcagcaccagacccccccccatcgaggccagcagcggcaagatgctgctgcacctgttcagcgacgccaactacaacctgctgggcttcaacgccagcttcagattcagcctgtgccccggcggctgccagagccacggccagtgccagccccccggcgtgtgcgcctgcgagcccggctggggcggccccgactgcggcctgcaggagtgcagcgcctactgcggcagccacggcacctgcgccagccccctgggcccctgcagatgcgagcccggcttcctgggcagagcctgcgacctgcacctgtgggagaaccagggcgccggctggtggcacaacgtgagcgccagagaccccgccttcagcgccagaatcggcgccgccggcgccttcctgagcccccccggcctgctggccgtgttcggcggccaggacctgaacaacgccctgggcgacctggtgctgtacaacttcagcgccaacacctgggagagctgggacctgagccccgcccccgccgccagacacagccacgtggccgtggcctgggccggcagcctggtgctgatgggcggcgagctggccgacggcagcctgaccaacgacgtgtgggccttcagccccctgggcagaggccactgggagctgctggccccccccgccagcagcagcagcggcccccccggcctggccggccacgccgccgccctggtggacgacgtgtggctgtacgtgagcggcggcagaaccccccacgacctgttcagcagcggcctgttcagattcagactggacagcaccagcggcggctactgggagcaggtgatccccgccggcggcagaccccccgccgccaccggccacagcatggtgttccacgcccccagcagagccctgctggtgcacggcggccacagacccagcaccgccagattcagcgtgagagtgaacagcaccgagctgttccacgtggacagacacgtgtggaccaccctgaagggcagagacggcctgcagggccccagagagagagccttccacaccgccagcgtgctgggcaactacatggtggtgtacggcggcaacgtgcacacccactaccaggaggagaagtgctacgaggacggcatcttcttctaccacctgggctgccaccagtgggtgagcggcgccgagctggccccccccggcacccccgagggcagagccgccccccccagcggcagatacagccacgtggccgccgtgctgggcggcagcgtgctgctggtggccggcggctacagcggcagacccagaggcgacctgatggcctacaaggtgccccccttcgtgttccaggcccccgcccccgactaccacctggactactgcagcatgtacaccgaccacagcgtgtgcagcagagaccccgagtgcagctggtgccagggcgcctgccaggccgcccccccccccggcacccccctgggcgcctgccccgccgccagctgcctgggcctgggcagactgctgggcgactgccaggcctgcctggccttcagcagccccaccgccccccccagaggccccggcaccctgggctggtgcgtgcacaacgagagctgcctgcccagacccgagcaggccagatgcagaggcgagcagatcagcggcaccgtgggctggtggggccccgcccccgtgttcgtgaccagcctggaggcctgcgtgacccagagcttcctgcccggcctgcacctgctgaccttccagcagccccccaacaccagccagcccgacaaggtgagcatcgtgagaagcaccaccatcaccctgacccccagcgccgagaccgacgtgagcctggtgtacagaggcttcatctaccccatgctgcccggcggccccggcggccccggcgccgaggacgtggccgtgtggaccagagcccagagactgcacgtgctggccagaatggccagaggccccgacaccgagaacatggaggaggtgggcagatgggtggcccaccaggagaaggagaccagaagactgcagagacccggcagcgccagactgttccccctgcccggcagagaccacaagtacgccgtggagatccagggccagctgaacggcagcgccggccccggccacagcgagctgaccctgctgtgggacagaaccggcgtgcccggcggcagcgagatcagcttcttcttcctggagccctacagaagcagcagctgcaccagctacagcagctgcctgggctgcctggccgaccagggctgcggctggtgcctgaccagcgccacctgccacctgagacagggcggcgcccactgcggcgacgacggcgccggcggcagcctgctggtgctggtgcccaccctgtgccccctgtgcgaggagcacagagactgccacgcctgcacccaggaccccttctgcgagtggcaccagagcaccagcagaaagggcgacgccgcctgcagcagaagaggcagaggcagaggcgccctgaagagccccgaggagtgcccccccctgtgcagccagagactgacctgcgaggactgcctggccaacagcagccagtgcgcctggtgccagagcacccacacctgcttcctgttcgccgcctacctggccagatacccccacggcggctgcagaggctgggacgacagcgtgcacagcgagcccagatgcagaagctgcgacggcttcctgacctgccacgagtgcctgcagagccacgagtgcggctggtgcggcaacgaggacaaccccaccctgggcagatgcctgcagggcgacttcagcggccccctgggcggcggcaactgcagcctgtgggtgggcgagggcctgggcctgcccgtggccctgcccgccagatgggcctacgccagatgccccgacgtggacgagtgcagactgggcctggccagatgccaccccagagccacctgcctgaacacccccctgagctacgagtgccactgccagagaggctaccagggcgacggcatcagccactgcaacagaacctgcctggaggactgcggccacggcgtgtgcagcggcccccccgacttcacctgcgtgtgcgacctgggctggaccagcgacctgcccccccccacccccgcccccggcccccccgcccccagatgcagcagagactgcggctgcagcttccacagccactgcagaaagagaggccccggcttctgcgacgagtgccaggactggacctggggcgagcactgcgagagatgcagacccggcagcttcggcaacgccaccggcagcagaggctgcagaccctgccagtgcaacggccacggcgaccccagaagaggccactgcgacaacctgagcggcctgtgcttctgccaggaccacaccgagggcgcccactgccagctgtgcagccccggctactacggcgaccccagagccggcggcagctgcttcagagagtgcggcggcagagccctgctgaccaacgtgagcagcgtggccctgggcagcagaagagtgggcggcctgctgccccccggcggcggcgccgccagagccggccccggcctgagctactgcgtgtgggtggtgagcgccaccgaggagctgcagccctgcgcccccggcaccctgtgcccccccctgaccctgaccttcagccccgacagcagcaccccctgcaccctgagctacgtgctggccttcgacggcttccccagattcctggacaccggcgtggtgcagagcgacagaagcctgatcgccgccttctgcggccagagaagagacagacccctgaccgtgcaggccctgagcggcctgctggtgctgcactgggaggccaacggcagcagcagctggggcttcaacgccagcgtgggcagcgccagatgcggcagcggcggccccggcagctgccccgtgccccaggagtgcgtgccccaggacggcgccgccggcgccggcctgtgcagatgcccccagggctgggccggcccccactgcagaatggccctgtgccccgagaactgcaacgcccacaccggcgccggcacctgcaaccagagcctgggcgtgtgcatctgcgccgagggcttcggcggccccgactgcgccaccaagctggacggcggccagctggtgtgggagaccctgatggacagcagactgagcgccgacaccgccagcagattcctgcacagactgggccacaccatggtggacggccccgacgccaccctgtggatgttcggcggcctgggcctgccccagggcctgctgggcaacctgtacagatacagcgtgagcgagagaagatggacccagatgctggccggcgccgaggacggcggccccggccccagccccagaagcttccacgccgccgcctacgtgcccgccggcagaggcgccatgtacctgctgggcggcctgaccgccggcggcgtgaccagagacttctgggtgctgaacctgaccaccctgcagtggagacaggagaaggccccccagaccgtggagctgcccgccgtggccggccacaccctgaccgccagaagaggcctgagcctgctgctggtgggcggctacagccccgagaacggcttcaaccagcagctgctggagtaccagctggccaccggcacctgggtgagcggcgcccagagcggcaccccccccaccggcctgtacggccacagcgccgtgtaccacgaggccaccgacagcctgtacgtgttcggcggcttcagattccacgtggagctggccgcccccagccccgagctgtacagcctgcactgccccgacagaacctggagcctgctggcccccagccagggcgccaagagagacagaatgagaaacgtgagaggcagcagcagaggcctgggccaggtgcccggcgagcagcccggcagctggggcttcagagaggtgagaaagaagatggccctgtgggccgccctggccggcaccggcggcttcctggaggagatcagcccccacctgaaggagcccagacccagactgttccacgccagcgccctgctgggcgacaccatggtggtgctgggcggcagaagcgaccccgacgagttcagcagcgacgtgctgctgtaccaggtgaactgcaacgcctggctgctgcccgacctgaccagaagcgccagcgtgggcccccccatggaggagagcgtggcccacgccgtggccgccgtgggcagcagactgtacatcagcggcggcttcggcggcgtggccctgggcagactgctggccctgaccctgccccccgacccctgcagactgctgagcagccccgaggcctgcaaccagagcggcgcctgcacctggtgccacggcgcctgcctgagcggcgaccaggcccacagactgggctgcggcggcagcccctgcagccccatgcccagaagccccgaggagtgcagaagactgagaacctgcagcgagtgcctggccagacaccccagaaccctgcagcccggcgacggcgaggccagcacccccagatgcaagtggtgcaccaactgccccgagggcgcctgcatcggcagaaacggcagctgcaccagcgagaacgactgcagaatcaaccagagagaggtgttctgggccggcaactgcagcgaggccgcctgcggcgccgccgactgcgagcagtgcaccagagagggcaagtgcatgtggaccagacagttcaagagaaccggcgagaccagaagaatcctgagcgtgcagcccacctacgactggacctgcttcagccacagcctgctgaacgtgagccccatgcccgtggagagcagcccccccctgccctgccccaccccctgccacctgctgcccaactgcaccagctgcctggacagcaagggcgccgacggcggctggcagcactgcgtgtggagcagcagcctgcagcagtgcctgagccccagctacctgcccctgagatgcatggccggcggctgcggcagactgctgagaggccccgagagctgcagcctgggctgcgcccaggccacccagtgcgccctgtgcctgagaagaccccactgcggctggtgcgcctggggcggccaggacggcggcggcagatgcatggagggcggcctgagcggccccagagacggcctgacctgcggcagacccggcgccagctgggccttcctgagctgcccccccgaggacgagtgcgccaacggccaccacgactgcaacgagacccagaactgccacgaccagccccacggctacgagtgcagctgcaagaccggctacaccatggacaacatgaccggcctgtgcagacccgtgtgcgcccagggctgcgtgaacggcagctgcgtggagcccgaccactgcagatgccacttcggcttcgtgggcagaaactgcagcaccgagtgcagatgcaacagacacagcgagtgcgccggcgtgggcgccagagaccactgcctgctgtgcagaaaccacaccaagggcagccactgcgagcagtgcctgcccctgttcgtgggcagcgccgtgggcggcggcacctgcagaccctgccacgccttctgcagaggcaacagccacatctgcatcagcagaaaggagctgcagatgagcaagggcgagcccaagaagtacagcctggaccccgaggagatcgagaactgggtgaccgagggccccagcgaggacgaggccgtgtgcgtgaactgccagaacaacagctacggcgagaagtgcgagagctgcctgcagggctacttcctgctggacggcaagtgcaccaagtgccagtgcaacggccacgccgacacctgcaacgagcaggacggcaccggctgcccctgccagaacaacaccgagaccggcacctgccagggcagcagccccagcgacagaagagactgctacaagtaccagtgcgccaagtgcagagagagcttccacggcagccccctgggcggccagcagtgctacagactgatcagcgtggagcaggagtgctgcctggaccccaccagccagaccaactgcttccacgagcccaagagaagagccctgggccccggcagaaccgtgctgttcggcgtgcagcccaagttcaccaacgtggacatcagactgaccctggacgtgaccttcggcgccgtggacctgtacgtgagcaccagctacgacaccttcgtggtgagagtggcccccgacaccggcgtgcacaccgtgcacatccagcccccccccgcccccccccccccccccccccccgccgacggcggccccagaggcgccggcgaccccggcggcgccggcgccagcagcggccccggcgcccccgccgagcccagagtgagagaggtgtggcccagaggcctgatcacctacgtgaccgtgaccgagcccagcgccgtgctggtggtgagaggcgtgagagacagactggtgatcacctacccccacgagcaccacgccctgaagagcagcagattctacctgctgctgctgggcgtgggcgaccccagcggccccggcgccaacggcagcgccgacagccagggcctgctgttcttcagacaggaccaggcccacatcgacctgttcgtgttcttcagcgtgttcttcagctgcttcttcctgttcctgagcctgtgcgtgctgctgtggaaggccaagcaggccctggaccagagacaggagcagagaagacacctgcaggagatgaccaagatggccagcagacccttcgccaaggtgaccgtgtgcttcccccccgaccccaccgcccccgccagcgcctggaagcccgccggcctgcccccccccgccttcagaagaagcgagcccttcctggcccccctgctgctgaccggcgccggcggcccctggggccccatgggcggcggctgctgcccccccgccatccccgccaccaccgccggcctgagagccggccccatcaccctggagcccaccgaggacggcatggccggcgtggccaccctgctgctgcagctgcccggcggcccccacgcccccaacggcgcctgcctgggcagcgccctggtgaccctgagacacagactgcacgagtactgcggcggcggcggcggcgccggcggcagcggccacggcaccggcgccggcagaaagggcctgctgagccaggacaacctgaccagcatgagcctgtag

SEQ ID NO: 89584 - DNA, 8337 bp, Artificial Sequence
  Description of Artificial Sequence: Synthetic coding sequence
atggccctgggcaaggtgctggccatggccctggtgctggccctggccgtgctgggcagcctgagccccggcgccagagccggcgactgcaagggccagagacaggtgctgagagaggcccccggcttcgtgaccgacggcgccggcaactacagcgtgaacggcaactgcgagtggctgatcgaggcccccagcccccagcacagaatcctgctggacttcctgttcctggacaccgagtgcacctacgactacctgttcgtgtacgacggcgacagccccagaggccccctgctggccagcctgagcggcagcaccagacccccccccatcgaggccagcagcggcaagatgctgctgcacctgttcagcgacgccaactacaacctgctgggcttcaacgccagcttcagattcagcctgtgccccggcggctgccagagccacggccagtgccagccccccggcgtgtgcgcctgcgagcccggctggggcggccccgactgcggcctgcaggagtgcagcgcctactgcggcagccacggcacctgcgccagccccctgggcccctgcagatgcgagcccggcttcctgggcagagcctgcgacctgcacctgtgggagaaccagggcgccggctggtggcacaacgtgagcgccagagaccccgccttcagcgccagaatcggcgccgccggcgccttcctgagcccccccggcctgctggccgtgttcggcggccaggacctgaacaacgccctgggcgacctggtgctgtacaacttcagcgccaacacctgggagagctgggacctgagccccgcccccgccgccagacacagccacgtggccgtggcctgggccggcagcctggtgctgatgggcggcgagctggccgacggcagcctgaccaacgacgtgtgggccttcagccccctgggcagaggccactgggagctgctggccccccccgccagcagcagcagcggcccccccggcctggccggccacgccgccgccctggtggacgacgtgtggctgtacgtgagcggcggcagaaccccccacgacctgttcagcagcggcctgttcagattcagactggacagcaccagcggcggctactgggagcaggtgatccccgccggcggcagaccccccgccgccaccggccacagcatggtgttccacgcccccagcagagccctgctggtgcacggcggccacagacccagcaccgccagattcagcgtgagagtgaacagcaccgagctgttccacgtggacagacacgtgtggaccaccctgaagggcagagacggcctgcagggccccagagagagagccttccacaccgccagcgtgctgggcaactacatggtggtgtacggcggcaacgtgcacacccactaccaggaggagaagtgctacgaggacggcatcttcttctaccacctgggctgccaccagtgggtgagcggcgccgagctggccccccccggcacccccgagggcagagccgccccccccagcggcagatacagccacgtggccgccgtgctgggcggcagcgtgctgctggtggccggcggctacagcggcagacccagaggcgacctgatggcctacaaggtgccccccttcgtgttccaggcccccgcccccgactaccacctggactactgcagcatgtacaccgaccacagcgtgtgcagcagagaccccgagtgcagctggtgccagggcgcctgccaggccgcccccccccccggcacccccctgggcgcctgccccgccgccagctgcctgggcctgggcagactgctgggcgactgccaggcctgcctggccttcagcagccccaccgccccccccagaggccccggcaccctgggctggtgcgtgcacaacgagagctgcctgcccagacccgagcaggccagatgcagaggcgagcagatcagcggcaccgtgggctggtggggccccgcccccgtgttcgtgaccagcctggaggcctgcgtgacccagagcttcctgcccggcctgcacctgctgaccttccagcagccccccaacaccagccagcccgacaaggaggaggtgggcagatgggtggcccaccaggagaaggagaccagaagactgcagagacccggcagcgccagactgttccccctgcccggcagagaccacaagtacgccgtggagatccagggccagctgaacggcagcgccggccccggccacagcgagctgaccctgctgtgggacagaaccggcgtgcccggcggcagcgagatcagcttcttcttcctggagccctacagaagcagcagctgcaccagctacagcagctgcctgggctgcctggccgaccagggctgcggctggtgcctgaccagcgccacctgccacctgagacagggcggcgcccactgcggcgacgacggcgccggcggcagcctgctggtgctggtgcccaccctgtgccccctgtgcgaggagcacagagactgccacgcctgcacccaggaccccttctgcgagtggcaccagagcaccagcagaaagggcgacgccgcctgcagcagaagaggcagaggcagaggcgccctgaagagccccgaggagtgcccccccctgtgcagccagagactgacctgcgaggactgcctggccaacagcagccagtgcgcctggtgccagagcacccacacctgcttcctgttcgccgcctacctggccagatacccccacggcggctgcagaggctgggacgacagcgtgcacagcgagcccagatgcagaagctgcgacggcttcctgacctgccacgagtgcctgcagagccacgagtgcggctggtgcggcaacgaggacaaccccaccctgggcagatgcctgcagggcgacttcagcggccccctgggcggcggcaactgcagcctgtgggtgggcgagggcctgggcctgcccgtggccctgcccgccagatgggcctacgccagatgccccgacgtggacgagtgcagactgggcctggccagatgccaccccagagccacctgcctgaacacccccctgagctacgagtgccactgccagagaggctaccagggcgacggcatcagccactgcaacagaacctgcctggaggactgcggccacggcgtgtgcagcggcccccccgacttcacctgcgtgtgcgacctgggctggaccagcgacctgcccccccccacccccgcccccggcccccccgcccccagatgcagcagagactgcggctgcagcttccacagccactgcagaaagagaggccccggcttctgcgacgagtgccaggactggacctggggcgagcactgcgagagatgcagacccggcagcttcggcaacgccaccggcagcagaggctgcagaccctgccagtgcaacggccacggcgaccccagaagaggccactgcgacaacctgagcggcctgtgcttctgccaggaccacaccgagggcgcccactgccagctgtgcagccccggctactacggcgaccccagagccggcggcagctgcttcagagagtgcggcggcagagccctgctgaccaacgtgagcagcgtggccctgggcagcagaagagtgggcggcctgctgccccccggcggcggcgccgccagagccggccccggcctgagctactgcgtgtgggtggtgagcgccaccgaggagctgcagccctgcgcccccggcaccctgtgcccccccctgaccctgaccttcagccccgacagcagcaccccctgcaccctgagctacgtgctggccttcgacggcttccccagattcctggacaccggcgtggtgcagagcgacagaagcctgatcgccgccttctgcggccagagaagagacagacccctgaccgtgcaggccctgagcggcctgctggtgctgcactgggaggccaacggcagcagcagctggggcttcaacgccagcgtgggcagcgccagatgcggcagcggcggccccggcagctgccccgtgccccaggagtgcgtgccccaggacggcgccgccggcgccggcctgtgcagatgcccccagggctgggccggcccccactgcagaatggccctgtgccccgagaactgcaacgcccacaccggcgccggcacctgcaaccagagcctgggcgtgtgcatctgcgccgagggcttcggcggccccgactgcgccaccaagctggacggcggccagctggtgtgggagaccctgatggacagcagactgagcgccgacaccgccagcagattcctgcacagactgggccacaccatggtggacggccccgacgccaccctgtggatgttcggcggcctgggcctgccccagggcctgctgggcaacctgtacagatacagcgtgagcgagagaagatggacccagatgctggccggcgccgaggacggcggccccggccccagccccagaagcttccacgccgccgcctacgtgcccgccggcagaggcgccatgtacctgctgggcggcctgaccgccggcggcgtgaccagagacttctgggtgctgaacctgaccaccctgcagtggagacaggagaaggccccccagaccgtggagctgcccgccgtggccggccacaccctgaccgccagaagaggcctgagcctgctgctggtgggcggctacagccccgagaacggcttcaaccagcagctgctggagtaccagctggccaccggcacctgggtgagcggcgcccagagcggcaccccccccaccggcctgtacggccacagcgccgtgtaccacgaggccaccgacagcctgtacgtgttcggcggcttcagattccacgtggagctggccgcccccagccccgagctgtacagcctgcactgccccgacagaacctggagcctgctggcccccagccagggcgccaagagagacagaatgagaaacgtgagaggcagcagcagaggcctgggccaggtgcccggcgagcagcccggcagctggggcttcagagaggtgagaaagaagatggccctgtgggccgccctggccggcaccggcggcttcctggaggagatcagcccccacctgaaggagcccagacccagactgttccacgccagcgccctgctgggcgacaccatggtggtgctgggcggcagaagcgaccccgacgagttcagcagcgacgtgctgctgtaccaggtgaactgcaacgcctggctgctgcccgacctgaccagaagcgccagcgtgggcccccccatggaggagagcgtggcccacgccgtggccgccgtgggcagcagactgtacatcagcggcggcttcggcggcgtggccctgggcagactgctggccctgaccctgccccccgacccctgcagactgctgagcagccccgaggcctgcaaccagagcggcgcctgcacctggtgccacggcgcctgcctgagcggcgaccaggcccacagactgggctgcggcggcagcccctgcagccccatgcccagaagccccgaggagtgcagaagactgagaacctgcagcgagtgcctggccagacaccccagaaccctgcagcccggcgacggcgaggccagcacccccagatgcaagtggtgcaccaactgccccgagggcgcctgcatcggcagaaacggcagctgcaccagcgagaacgactgcagaatcaaccagagagaggtgttctgggccggcaactgcagcgaggccgcctgcggcgccgccgactgcgagcagtgcaccagagagggcaagtgcatgtggaccagacagttcaagagaaccggcgagaccagaagaatcctgagcgtgcagcccacctacgactggacctgcttcagccacagcctgctgaacgtgagccccatgcccgtggagagcagcccccccctgccctgccccaccccctgccacctgctgcccaactgcaccagctgcctggacagcaagggcgccgacggcggctggcagcactgcgtgtggagcagcagcctgcagcagtgcctgagccccagctacctgcccctgagatgcatggccggcggctgcggcagactgctgagaggccccgagagctgcagcctgggctgcgcccaggccacccagtgcgccctgtgcctgagaagaccccactgcggctggtgcgcctggggcggccaggacggcggcggcagatgcatggagggcggcctgagcggccccagagacggcctgacctgcggcagacccggcgccagctgggccttcctgagctgcccccccgaggacgagtgcgccaacggccaccacgactgcaacgagacccagaactgccacgaccagccccacggctacgagtgcagctgcaagaccggctacaccatggacaacatgaccggcctgtgcagacccgtgtgcgcccagggctgcgtgaacggcagctgcgtggagcccgaccactgcagatgccacttcggcttcgtgggcagaaactgcagcaccgagtgcagatgcaacagacacagcgagtgcgccggcgtgggcgccagagaccactgcctgctgtgcagaaaccacaccaagggcagccactgcgagcagtgcctgcccctgttcgtgggcagcgccgtgggcggcggcacctgcagaccctgccacgccttctgcagaggcaacagccacatctgcatcagcagaaaggagctgcagatgagcaagggcgagcccaagaagtacagcctggaccccgaggagatcgagaactgggtgaccgagggccccagcgaggacgaggccgtgtgcgtgaactgccagaacaacagctacggcgagaagtgcgagagctgcctgcagggctacttcctgctggacggcaagtgcaccaagtgccagtgcaacggccacgccgacacctgcaacgagcaggacggcaccggctgcccctgccagaacaacaccgagaccggcacctgccagggcagcagccccagcgacagaagagactgctacaagtaccagtgcgccaagtgcagagagagcttccacggcagccccctgggcggccagcagtgctacagactgatcagcgtggagcaggagtgctgcctggaccccaccagccagaccaactgcttccacgagcccaagagaagagccctgggccccggcagaaccgtgctgttcggcgtgcagcccaagttcaccaacgtggacatcagactgaccctggacgtgaccttcggcgccgtggacctgtacgtgagcaccagctacgacaccttcgtggtgagagtggcccccgacaccggcgtgcacaccgtgcacatccagcccccccccgcccccccccccccccccccccccgccgacggcggccccagaggcgccggcgaccccggcggcgccggcgccagcagcggccccggcgcccccgccgagcccagagtgagagaggtgtggcccagaggcctgatcacctacgtgaccgtgaccgagcccagcgccgtgctggtggtgagaggcgtgagagacagactggtgatcacctacccccacgagcaccacgccctgaagagcagcagattctacctgctgctgctgggcgtgggcgaccccagcggccccggcgccaacggcagcgccgacagccagggcctgctgttcttcagacaggaccaggcccacatcgacctgttcgtgttcttcagcgtgttcttcagctgcttcttcctgttcctgagcctgtgcgtgctgctgtggaaggccaagcaggccctggaccagagacaggagcagagaagacacctgcaggagatgaccaagatggccagcagacccttcgccaaggtgaccgtgtgcttcccccccgaccccaccgcccccgccagcgcctggaagcccgccggcctgcccccccccgccttcagaagaagcgagcccttcctggcccccctgctgctgaccggcgccggcggcccctggggccccatgggcggcggctgctgcccccccgccatccccgccaccaccgccggcctgagagccggccccatcaccctggagcccaccgaggacggcatggccggcgtggccaccctgctgctgcagctgcccggcggcccccacgcccccaacggcgcctgcctgggcagcgccctggtgaccctgagacacagactgcacgagtactgcggcggcggcggcggcgccggcggcagcggccacggcaccggcgccggcagaaagggcctgctgagccaggacaacctgaccagcatgagcctgtag

SEQ ID NO: 89585 - DNA, 1320 bp, Artificial Sequence
  Description of Artificial Sequence: Synthetic coding sequence
atgagagagctgcccgccggcctgctgccccccggcagagaggtgcaccagtgcgccaagtgcagagagagcttccacggcagccccctgggcggccagcagtgctacagactgatcagcgtggagcaggagtgctgcctggaccccaccagccagaccaactgcttccacgagcccaagagaagagccctgggccccggcagaaccgtgctgttcggcgtgcagcccaagttcaccaacgtggacatcagactgaccctggacgtgaccttcggcgccgtggacctgtacgtgagcaccagctacgacaccttcgtggtgagagtggcccccgacaccggcgtgcacaccgtgcacatccagcccccccccgcccccccccccccccccccccccgccgacggcggccccagaggcgccggcgaccccggcggcgccggcgccagcagcggccccggcgcccccgccgagcccagagtgagagaggtgtggcccagaggcctgatcacctacgtgaccgtgaccgagcccagcgccgtgctggtggtgagaggcgtgagagacagactggtgatcacctacccccacgagcaccacgccctgaagagcagcagattctacctgctgctgctgggcgtgggcgaccccagcggccccggcgccaacggcagcgccgacagccagggcctgctgttcttcagacaggaccaggcccacatcgacctgttcgtgttcttcagcgtgttcttcagctgcttcttcctgttcctgagcctgtgcgtgctgctgtggaaggccaagcaggccctggaccagagacaggagcagagaagacacctgcaggagatgaccaagatggccagcagacccttcgccaaggtgaccgtgtgcttcccccccgaccccaccgcccccgccagcgcctggaagcccgccggcctgcccccccccgccttcagaagaagcgagcccttcctggcccccctgctgctgaccggcgccggcggcccctggggccccatgggcggcggctgctgcccccccgccatccccgccaccaccgccggcctgagagccggccccatcaccctggagcccaccgaggacggcatggccggcgtggccaccctgctgctgcagctgcccggcggcccccacgcccccaacggcgcctgcctgggcagcgccctggtgaccctgagacacagactgcacgagtactgcggcggcggcggcggcgccggcggcagcggccacggcaccggcgccggcagaaagggcctgctgagccaggacaacctgaccagcatgagcctgtag

SEQ ID NO: 89586 - DNA, 1809 bp, Artificial Sequence
  Description of Artificial Sequence: Synthetic coding sequence
atgaacggcggcgccgagagagccatgagaagcctgcccagcctgggcggcctggccctgctgtgctgcgccgccgccgccgccgccgccgccgtggccagcgccgccagcgccggcaacgtgaccggcggcggcggcgccgccggccaggtggacgccagccccggccccggcctgagaggcgagcccagccaccccttccccagagccaccgcccccaccgcccaggcccccagaaccggcccccccagagccaccgtgcacagacccctggccgccaccagccccgcccagagccccgagaccacccccctgtgggccaccgccggccccagcagcaccaccttccaggcccccctgggccccagccccaccaccccccccgccgccgagagaaccagcaccaccagccaggcccccaccagacccgcccccaccaccctgagcaccaccaccggccccgcccccaccacccccgtggccaccaccgtgcccgcccccaccacccccagaacccccacccccgacctgcccagcagcagcaacagcagcgtgctgcccaccccccccgccaccgaggcccccagcagccccccccccgagtacgtgtgcaactgcagcgtggtgggcagcctgaacgtgaacagatgcaaccagaccaccggccagtgcgagtgcagacccggctaccagggcctgcactgcgagacctgcaaggagggcttctacctgaactacaccagcggcctgtgccagccctgcgactgcagcccccacggcgccctgagcatcccctgcaacagcagcggcaagtgccagtgcaaggtgggcgtgatcggcagcatctgcgacagatgccaggacggctactacggcttcagcaagaacggctgcctgccctgccagtgcaacaacagaagcgccagctgcgacgccctgaccggcgcctgcctgaactgccaggagaacagcaagggcaaccactgcgaggagtgcaaggagggcttctaccagagccccgacgccaccaaggagtgcctgagatgcccctgcagcgccgtgaccagcaccggcagctgcagcatcaagagcagcgagctggagcccgagtgcgaccagtgcaaggacggctacatcggccccaactgcaacaagtgcgagaacggctactacaacttcgacagcatctgcagaaagtgccagtgccacggccacgtggaccccgtgaagacccccaagatctgcaagcccgagagcggcgagtgcatcaactgcctgcacaacaccaccggcttctggtgcgagaactgcctggagggctacgtgcacgacctggagggcaactgcatcaagaaggaggtgatcctgcccacccccgagggcagcaccatcctggtgagcaacgccagcctgaccaccagcgtgcccacccccgtgatcaacagcaccttcacccccaccaccctgcagaccatcttcagcgtgagcaccagcgagaacagcaccagcgccctggccgacgtgagctggacccagttcaacatcatcatcctgaccgtgatcatcatcgtggtggtgctgctgatgggcttcgtgggcgccgtgtacatgtacagagagtaccagaacagaaagctgaacgcccccttctggaccatcgagctgaaggaggacaacatcagcttcagcagctaccacgacagcatccccaacgccgacgtgagcggcctgctggaggacgacggcaacgaggtggcccccaacggccagctgaccctgaccacccccatccacaactacaaggcctag

SEQ ID NO: 89587 - DNA, 1920 bp, Artificial Sequence
  Description of Artificial Sequence: Synthetic coding sequence
atgagaagcctgcccagcctgggcggcctggccctgctgtgctgcgccgccgccgccgccgccgccgccgtggccagcgccgccagcgccggcaacgtgaccggcggcggcggcgccgccggccaggtggacgccagccccggccccggcctgagaggcgagcccagccaccccttccccagagccaccgcccccaccgcccaggcccccagaaccggcccccccagagccaccgtgcacagacccctggccgccaccagccccgcccagagccccgagaccacccccctgtgggccaccgccggccccagcagcaccaccttccaggcccccctgggccccagccccaccaccccccccgccgccgagagaaccagcaccaccagccaggcccccaccagacccgcccccaccaccctgagcaccaccaccggccccgcccccaccacccccgtggccaccaccgtgcccgcccccaccacccccagaacccccacccccgacctgcccagcagcagcaacagcagcgtgctgcccaccccccccgccaccgaggcccccagcagccccccccccggccaccagtggcccgtggccaagatgccccagaagtacctgggcaagtacgcctgcgagagcaacctgaagagcaagtacctgcccctgacccagcccgtgatgaacctgagagtgagcgaggccgtgaagaccgagtacgtgtgcaactgcagcgtggtgggcagcctgaacgtgaacagatgcaaccagaccaccggccagtgcgagtgcagacccggctaccagggcctgcactgcgagacctgcaaggagggcttctacctgaactacaccagcggcctgtgccagccctgcgactgcagcccccacggcgccctgagcatcccctgcaacagcagcggcaagtgccagtgcaaggtgggcgtgatcggcagcatctgcgacagatgccaggacggctactacggcttcagcaagaacggctgcctgccctgccagtgcaacaacagaagcgccagctgcgacgccctgaccggcgcctgcctgaactgccaggagaacagcaagggcaaccactgcgaggagtgcaaggagggcttctaccagagccccgacgccaccaaggagtgcctgagatgcccctgcagcgccgtgaccagcaccggcagctgcagcatcaagagcagcgagctggagcccgagtgcgaccagtgcaaggacggctacatcggccccaactgcaacaagtgcgagaacggctactacaacttcgacagcatctgcagaaagtgccagtgccacggccacgtggaccccgtgaagacccccaagatctgcaagcccgagagcggcgagtgcatcaactgcctgcacaacaccaccggcttctggtgcgagaactgcctggagggctacgtgcacgacctggagggcaactgcatcaagaaggaggtgatcctgcccacccccgagggcagcaccatcctggtgagcaacgccagcctgaccaccagcgtgcccacccccgtgatcaacagcaccttcacccccaccaccctgcagaccatcttcagcgtgagcaccagcgagaacagcaccagcgccctggccgacgtgagctggacccagttcaacatcatcatcctgaccgtgatcatcatcgtggtggtgctgctgatgggcttcgtgggcgccgtgtacatgtacagagagtaccagaacagaaagctgaacgcccccttctggaccatcgagctgaaggaggacaacatcagcttcagcagctaccacgacagcatccccaacgccgacgtgagcggcctgctggaggacgacggcaacgaggtggcccccaacggccagctgaccctgaccacccccatccacaactacaaggcctag

SEQ ID NO: 89588 - DNA, 939 bp, Artificial Sequence
  Description of Artificial Sequence: Synthetic coding sequence
atgctgagagcccccggctgcctgctgagaaccagcgtggcccccgccgccgccctggccgccgccctgctgagcagcctggccagatgcagcctgctggagcccagagaccccgtggccagcagcctgagcccctacttcggcaccaagaccagatacgaggacgtgaaccccgtgctgctgagcggccccgaggccccctggagagaccccgagctgctggagggcacctgcacccccgtgcagctggtggccctgatcagacacggcaccagataccccaccgtgaagcagatcagaaagctgagacagctgcacggcctgctgcaggccagaggcagcagagacggcggcgccagcagcaccggcagcagagacctgggcgccgccctggccgactggcccctgtggtacgccgactggatggacggccagctggtggagaagggcagacaggacatgagacagctggccctgagactggccagcctgttccccgccctgttcagcagagagaactacggcagactgagactgatcaccagcagcaagcacagatgcatggacagcagcgccgccttcctgcagggcctgtggcagcactaccaccccggcctgcccccccccgacgtggccgacatggagttcggcccccccaccgtgaacgacaagctgatgagattcttcgaccactgcgagaagttcctgaccgaggtggagaagaacgccaccgccctgtaccacgtggaggccttcaagaccggccccgagatgcagaacatcctgaagaaggtggccgccaccctgcaggtgcccgtgaacgacctgaacgccggcctgagccagttcctgctgcagagcagcagcagcctggtgatgcagagactgttcttccactgcttcctgagctgggccaccagcaagaccagaaacccctag

SEQ ID NO: 89589 - DNA, 1464 bp, Artificial Sequence
  Description of Artificial Sequence: Synthetic coding sequence
atgctgagagcccccggctgcctgctgagaaccagcgtggcccccgccgccgccctggccgccgccctgctgagcagcctggccagatgcagcctgctggagcccagagaccccgtggccagcagcctgagcccctacttcggcaccaagaccagatacgaggacgtgaaccccgtgctgctgagcggccccgaggccccctggagagaccccgagctgctggagggcacctgcacccccgtgcagctggtggccctgatcagacacggcaccagataccccaccgtgaagcagatcagaaagctgagacagctgcacggcctgctgcaggccagaggcagcagagacggcggcgccagcagcaccggcagcagagacctgggcgccgccctggccgactggcccctgtggtacgccgactggatggacggccagctggtggagaagggcagacaggacatgagacagctggccctgagactggccagcctgttccccgccctgttcagcagagagaactacggcagactgagactgatcaccagcagcaagcacagatgcatggacagcagcgccgccttcctgcagggcctgtggcagcactaccaccccggcctgcccccccccgacgtggccgacatggagttcggcccccccaccgtgaacgacaagctgatgagattcttcgaccactgcgagaagttcctgaccgaggtggagaagaacgccaccgccctgtaccacgtggaggccttcaagaccggccccgagatgcagaacatcctgaagaaggtggccgccaccctgcaggtgcccgtgaacgacctgaacgccgacctgatccaggtggccttcttcacctgcagcttcgacctggccatcaagggcgtgaagagcccctggtgcgacgtgttcgacatcgacgacgccaaggtgctggagtacctgaacgacctgaagcagtactggaagagaggctacggctacaccatcaacagcagaagcagctgcaccctgttccaggacatcttccagcacctggacaaggccgtggagcagaagcagagaagccagcccatcagcagccccgtgatcctgcagttcggccacgccgagaccctgctgcccctgctgagcctgatgggctacttcaaggacaaggagcccctgaccgcctacaactacaagaagcagatgcacagaaagttcagaagcggcctgatcgtgccctacgccagcaacctgatcttcgtgctgtaccactgcgagaacgccaagacccccaaggagcagttcagagtgcagatgctgctgaacgagaaggtgctgcccctggcctacagccaggagaccgtgagcttctacgaggacctgaagaaccactacaaggacatcctgcagagctgccagaccagcgaggagtgcgagctggccagagccaacagcaccagcgacgagctgtag

SEQ ID NO: 89590 - DNA, 861 bp, Artificial Sequence
  Description of Artificial Sequence: Synthetic coding sequence
atgtgcctgttccagctgtgcggcctggtgagatacatggagttcggcccccccaccgtgaacgacaagctgatgagattcttcgaccactgcgagaagttcctgaccgaggtggagaagaacgccaccgccctgtaccacgtggaggccttcaagaccggccccgagatgcagaacatcctgaagaaggtggccgccaccctgcaggtgcccgtgaacgacctgaacgccgacctgatccaggtggccttcttcacctgcagcttcgacctggccatcaagggcgtgaagagcccctggtgcgacgtgttcgacatcgacgacgccaaggtgctggagtacctgaacgacctgaagcagtactggaagagaggctacggctacaccatcaacagcagaagcagctgcaccctgttccaggacatcttccagcacctggacaaggccgtggagcagaagcagagaagccagcccatcagcagccccgtgatcctgcagttcggccacgccgagaccctgctgcccctgctgagcctgatgggctacttcaaggacaaggagcccctgaccgcctacaactacaagaagcagatgcacagaaagttcagaagcggcctgatcgtgccctacgccagcaacctgatcttcgtgctgtaccactgcgagaacgccaagacccccaaggagcagttcagagtgcagatgctgctgaacgagaaggtgctgcccctggcctacagccaggagaccgtgagcttctacgaggacctgaagaaccactacaaggacatcctgcagagctgccagaccagcgaggagtgcgagctggccagagccaacagcaccagcgacgagctgtag

SEQ ID NO: 89591 - DNA, 1041 bp, Artificial Sequence
  Description of Artificial Sequence: Synthetic coding sequence
atggacggccagctggtggagaagggcagacaggacatgagacagctggccctgagactggccagcctgttccccgccctgttcagcagagagaactacggcagactgagactgatcaccagcagcaagcacagatgcatggacagcagcgccgccttcctgcagggcctgtggcagcactaccaccccggcctgcccccccccgacgtggccgacatggagttcggcccccccaccgtgaacgacaagctgatgagattcttcgaccactgcgagaagttcctgaccgaggtggagaagaacgccaccgccctgtaccacgtggaggccttcaagaccggccccgagatgcagaacatcctgaagaaggtggccgccaccctgcaggtgcccgtgaacgacctgaacgccgacctgatccaggtggccttcttcacctgcagcttcgacctggccatcaagggcgtgaagagcccctggtgcgacgtgttcgacatcgacgacgccaaggtgctggagtacctgaacgacctgaagcagtactggaagagaggctacggctacaccatcaacagcagaagcagctgcaccctgttccaggacatcttccagcacctggacaaggccgtggagcagaagcagagaagccagcccatcagcagccccgtgatcctgcagttcggccacgccgagaccctgctgcccctgctgagcctgatgggctacttcaaggacaaggagcccctgaccgcctacaactacaagaagcagatgcacagaaagttcagaagcggcctgatcgtgccctacgccagcaacctgatcttcgtgctgtaccactgcgagaacgccaagacccccaaggagcagttcagagtgcagatgctgctgaacgagaaggtgctgcccctggcctacagccaggagaccgtgagcttctacgaggacctgaagaaccactacaaggacatcctgcagagctgccagaccagcgaggagtgcgagctggccagagccaacagcaccagcgacgagctgtag

SEQ ID NO: 89592 - DNA, 6213 bp, Artificial Sequence
  Description of Artificial Sequence: Synthetic coding sequence
atgctggaggccatcgacaagaacagagccctgcacgccgccgagagactgcagaccaagctgagagagagaggcgacgtggccaacgaggacaagctgagcctgctgaagagcgtgctgcagagccccctgttcagccagatcctgagcctgcagaccagcgtgcagcagctgaaggaccaggtgaacatcgccaccagcgccaccagcaacatcgagtacgcccacgtgccccacctgagccccgccgtgatccccaccctgcagaacgagagcttcctgctgagccccaacaacggcaacctggaggccctgaccggccccggcatcccccacatcaacggcaagcccgcctgcgacgagttcgaccagctgatcaagaacatggcccagggcagacacgtggaggtgttcgagctgctgaagccccccagcggcggcctgggcttcagcgtggtgggcctgagaagcgagaacagaggcgagctgggcatcttcgtgcaggagatccaggagggcagcgtggcccacagagacggcagactgaaggagaccgaccagatcctggccatcaacggccaggccctggaccagaccatcacccaccagcaggccatcagcatcctgcagaaggccaaggacaccgtgcagctggtgatcgccagaggcagcctgccccagctggtgagccccatcgtgagcagaagccccagcgccgccagcaccatcagcgcccacagcaaccccgtgcactggcagcacatggagaccatcgagctggtgaacgacggcagcggcctgggcttcggcatcatcggcggcaaggccaccggcgtgatcgtgaagaccatcctgcccggcggcgtggccgaccagcacggcagactgtgcagcggcgaccacatcctgaagatcggcgacaccgacctggccggcatgagcagcgagcaggtggcccaggtgctgagacagtgcggcaacagagtgaagctgatgatcgccagaggcgccatcgaggagagaaccgcccccaccgccctgggcatcaccctgagcagcagccccaccagcacccccgagctgagagtggacgccagcacccagaagggcgaggagagcgagaccttcgacgtggagctgaccaagaacgtgcagggcctgggcatcaccatcgccggctacatcggcgacaagaagctggagcccagcggcatcttcgtgaagagcatcaccaagagcagcgccgtggagcacgacggcagaatccagatcggcgaccagatcatcgccgtggacggcaccaacctgcagggcttcaccaaccagcaggccgtggaggtgctgagacacaccggccagaccgtgctgctgaccctgatgagaagaggcatgaagcaggaggccgagctgatgagcagagaggacgtgaccaaggacgccgacctgagccccgtgaacgccagcatcatcaaggagaactacgagaaggacgaggacttcctgagcagcaccagaaacaccaacatcctgcccaccgaggaggagggctaccccctgctgagcgccgagatcgaggagatcgaggacgcccagaagcaggaggccgccctgctgaccaagtggcagagaatcatgggcatcaactacgagatcgtggtggcccacgtgagcaagttcagcgagaacagcggcctgggcatcagcctggaggccaccgtgggccaccacttcatcagaagcgtgctgcccgagggccccgtgggccacagcggcaagctgttcagcggcgacgagctgctggaggtgaacggcatcaccctgctgggcgagaaccaccaggacgtggtgaacatcctgaaggagctgcccatcgaggtgaccatggtgtgctgcagaagaaccgtgccccccaccacccagagcgagctggacagcctggacctgtgcgacatcgagctgaccgagaagccccacgtggacctgggcgagttcatcggcagcagcgagaccgaggaccccgtgctggccatgaccgacgccggccagagcaccgaggaggtgcaggcccccctggccatgtgggaggccggcatccagcacatcgagctggagaagggcagcaagggcctgggcttcagcatcctggactaccaggaccccatcgaccccgccagcaccgtgatcatcatcagaagcctggtgcccggcggcatcgccgagaaggacggcagactgctgcccggcgacagactgatgttcgtgaacgacgtgaacctggagaacagcagcctggaggaggccgtggaggccctgaagggcgcccccagcggcaccgtgagaatcggcgtggccaagcccctgcccctgagccccgaggagggctacgtgagcgccaaggaggacagcttcctgtaccccccccacagctgcgaggaggccggcctggccgacaagcccctgttcagagccgacctggccctggtgggcaccaacgacgccgacctggtggacgagagcaccttcgagagcccctacagccccgagaacgacagcatctacagcacccaggccagcatcctgagcctgcacggcagcagctgcggcgacggcctgaactacggcagcagcctgcccagcagcccccccaaggacgtgatcgagaacagctgcgaccccgtgctggacctgcacatgagcctggaggagctgtacacccagaacctgctgcagagacaggacgagaacacccccagcgtggacatcagcatgggccccgccagcggcttcaccatcaacgactacacccccgccaacgccatcgagcagcagtacgagtgcgagaacaccatcgtgtggaccgagagccacctgcccagcgaggtgatcagcagcgccgagctgcccagcgtgctgcccgacagcgccggcaagggcagcgagtacctgctggagcagagcagcctggcctgcaacgccgagtgcgtgatgctgcagaacgtgagcaaggagagcttcgagagaaccatcaacatcgccaagggcaacagcagcctgggcatgaccgtgagcgccaacaaggacggcctgggcatgatcgtgagaagcatcatccacggcggcgccatcagcagagacggcagaatcgccatcggcgactgcatcctgagcatcaacgaggagagcaccatcagcgtgaccaacgcccaggccagagccatgctgagaagacacagcctgatcggccccgacatcaagatcacctacgtgcccgccgagcacctggaggagttcaagatcagcctgggccagcagagcggcagagtgatggccctggacatcttcagcagctacaccggcagagacatccccgagctgcccgagagagaggagggcgagggcgaggagagcgagctgcagaacaccgcctacagcaactggaaccagcccagaagagtggagctgtggagagagcccagcaagagcctgggcatcagcatcgtgggcggcagaggcatgggcagcagactgagcaacggcgaggtgatgagaggcatcttcatcaagcacgtgctggaggacagccccgccggcaagaacggcaccctgaagcccggcgacagaatcgtggaggtggacggcatggacctgagagacgccagccacgagcaggccgtggaggccatcagaaaggccggcaaccccgtggtgttcatggtgcagagcatcatcaacagacccagaaagagccccctgcccagcctgctgcacaacctgtaccccaagtacaacttcagcagcaccaaccccttcgccgacagcctgcagatcaacgccgacaaggcccccagccagagcgagagcgagcccgagaaggcccccctgtgcagcgtgcccccccccccccccagcgccttcgccgagatgggcagcgaccacacccagagcagcgccagcaagatcagccaggacgtggacaaggaggacgagttcggctacagctggaagaacatcagagagagatacggcaccctgaccggcgagctgcacatgatcgagctggagaagggccacagcggcctgggcctgagcctggccggcaacaaggacagaagcagaatgagcgtgttcatcgtgggcatcgaccccaacggcgccgccggcaaggacggcagactgcagatcgccgacgagctgctggagatcaacggccagatcctgtacggcagaagccaccagaacgccagcagcatcatcaagtgcgcccccagcaaggtgaagatcatcttcatcagaaacaaggacgccgtgaaccagatggccgtgtgccccggcaacgccgtggagcccctgcccagcaacagcgagaacctgcagaacaaggagaccgagcccaccgtgaccaccagcgacgccgccgtggacctgagcagcttcaagaacgtgcagcacctggagctgcccaaggaccagggcggcctgggcatcgccatcagcgaggaggacaccctgagcggcgtgatcatcaagagcctgaccgagcacggcgtggccgccaccgacggcagactgaaggtgggcgaccagatcctggccgtggacgacgagatcgtggtgggctaccccatcgagaagttcatcagcctgctgaagaccgccaagatgaccgtgaagctgaccatccacgccgagaaccccgacagccaggccgtgcccagcgccgccggcgccgccagcggcgagaagaagaacagcagccagagcctgatggtgccccagagcggcagccccgagcccgagagcatcagaaacaccagcagaagcagcacccccgccatcttcgccagcgaccccgccacctgccccatcatccccggctgcgagaccaccatcgagatcagcaagggcagaaccggcctgggcctgagcatcgtgggcggcagcgacaccctgctgggcgccatcatcatccacgaggtgtacgaggagggcgccgcctgcaaggacggcagactgtgggccggcgaccagatcctggaggtgaacggcatcgacctgagaaaggccacccacgacgaggccatcaacgtgctgagacagaccccccagagagtgagactgaccctgtacagagacgaggccccctacaaggaggaggaggtgtgcgacaccctgaccatcgagctgcagaagaagcccggcaagggcctgggcctgagcatcgtgggcaagagaaacgacaccggcgtgttcgtgagcgacatcgtgaagggcggcatcgccgacgccgacggcagactgatgcagggcgaccagatcctgatggtgaacggcgaggacgtgagaaacgccacccaggaggccgtggccgccctgctgaagtgcagcctgggcaccgtgaccctggaggtgggcagaatcaaggccggccccttccacagcgagagaagacccagccagagcagccaggtgagcgagggcagcctgagcagcttcaccttccccctgagcggcagcagcaccagcgagagcctggagagcagcagcaagaagaacgccctggccagcgagatccagggcctgagaaccgtggagatgaagaagggccccaccgacagcctgggcatcagcatcgccggcggcgtgggcagccccctgggcgacgtgcccatcttcatcgccatgatgcaccccaccggcgtggccgcccagacccagaagctgagagtgggcgacagaatcgtgaccatctgcggcaccagcaccgagggcatgacccacacccaggccgtgaacctgctgaagaacgccagcggcagcatcgagatgcaggtggtggccggcggcgacgtgagcgtggtgaccggccaccagcaggagcccgccagcagcagcctgagcttcaccggcctgaccagcagcagcatcttccaggacgacctgggccccccccagtgcaagagcatcaccctggagagaggccccgacggcctgggcttcagcatcgtgggcggctacggcagcccccacggcgacctgcccatctacgtgaagaccgtgttcgccaagggcgccgccagcgaggacggcagactgaagagaggcgaccagatcatcgccgtgaacggccagagcctggagggcgtgacccacgaggaggccgtggccatcctgaagagaaccaagggcaccgtgaccctgatggtgctgagctag

SEQ ID NO: 89593 - DNA, 6213 bp, Artificial Sequence; identical to SEQ ID NO: 89592
  Description of Artificial Sequence: Synthetic coding sequence

SEQ ID NO: 89594 - DNA, 6126 bp, Artificial Sequence
  Description of Artificial Sequence: Synthetic coding sequence
atgctggaggccatcgacaagaacagagccctgcacgccgccgagagactgcagaccaagctgagagagagaggcgacgtggccaacgaggacaagctgagcctgctgaagagcgtgctgcagagccccctgttcagccagatcctgagcctgcagaccagcgtgcagcagctgaaggaccaggtgaacatcgccaccagcgccaccagcaacatcgagtacgcccacgtgccccacctgagccccgccgtgatccccaccctgcagaacgagagcttcctgctgagccccaacaacggcaacctggaggccctgaccggccccggcatcccccacatcaacggcaagcccgcctgcgacgagttcgaccagctgatcaagaacatggcccagggcagacacgtggaggtgttcgagctgctgaagccccccagcggcggcctgggcttcagcgtggtgggcctgagaagcgagaacagaggcgagctgggcatcttcgtgcaggagatccaggagggcagcgtggcccacagagacggcagactgaaggagaccgaccagatcctggccatcaacggccaggccctggaccagaccatcacccaccagcaggccatcagcatcctgcagaaggccaaggacaccgtgcagctggtgatcgccagaggcagcctgccccagctggtgagccccatcgtgagcagaagccccagcgccgccagcaccatcagcgcccacagcaaccccgtgcactggcagcacatggagaccatcgagctggtgaacgacggcagcggcctgggcttcggcatcatcggcggcaaggccaccggcgtgatcgtgaagaccatcctgcccggcggcgtggccgaccagcacggcagactgtgcagcggcgaccacatcctgaagatcggcgacaccgacctggccggcatgagcagcgagcaggtggcccaggtgctgagacagtgcggcaacagagtgaagctgatgatcgccagaggcgccatcgaggagagaaccgcccccaccgccctgggcatcaccctgagcagcagccccaccagcacccccgagctgagagtggacgccagcacccagaagggcgaggagagcgagaccttcgacgtggagctgaccaagaacgtgcagggcctgggcatcaccatcgccggctacatcggcgacaagaagctggagcccagcggcatcttcgtgaagagcatcaccaagagcagcgccgtggagcacgacggcagaatccagatcggcgaccagatcatcgccgtggacggcaccaacctgcagggcttcaccaaccagcaggccgtggaggtgctgagacacaccggccagaccgtgctgctgaccctgatgagaagaggcatgaagcaggaggccgagctgatgagcagagaggacgtgaccaaggacgccgacctgagccccgtgaacgccagcatcatcaaggagaactacgagaaggacgaggacttcctgagcagcaccagaaacaccaacatcctgcccaccgaggaggagggctaccccctgctgagcgccgagatcgaggagatcgaggacgcccagaagcaggaggccgccctgctgaccaagtggcagagaatcatgggcatcaactacgagatcgtggtggcccacgtgagcaagttcagcgagaacagcggcctgggcatcagcctggaggccaccgtgggccaccacttcatcagaagcgtgctgcccgagggccccgtgggccacagcggcaagctgttcagcggcgacgagctgctggaggtgaacggcatcaccctgctgggcgagaaccaccaggacgtggtgaacatcctgaaggagctgcccatcgaggtgaccatggtgtgctgcagaagaaccgtgccccccaccacccagagcgagctggacagcctggacctgtgcgacatcgagctgaccgagaagccccacgtggacctgggcgagttcatcggcagcagcgagaccgaggaccccgtgctggccatgaccgacgccggccagagcaccgaggaggtgcaggcccccctggccatgtgggaggccggcatccagcacatcgagctggagaagggcagcaagggcctgggcttcagcatcctggactaccaggaccccatcgaccccgccagcaccgtgatcatcatcagaagcctggtgcccggcggcatcgccgagaaggacggcagactgctgcccggcgacagactgatgttcgtgaacgacgtgaacctggagaacagcagcctggaggaggccgtggaggccctgaagggcgcccccagcggcaccgtgagaatcggcgtggccaagcccctgcccctgagccccgaggagggctacgtgagcgccaaggaggacagcttcctgtaccccccccacagctgcgaggaggccggcctggccgacaagcccctgttcagagccgacctggccctggtgggcaccaacgacgccgacctggtggacgagagcaccttcgagagcccctacagccccgagaacgacagcatctacagcacccaggccagcatcctgagcctgcacggcagcagctgcggcgacggcctgaactacggcagcagcctgcccagcagcccccccaaggacgtgatcgagaacagctgcgaccccgtgctggacctgcacatgagcctggaggagctgtacacccagaacctgctgcagagacaggacgagaacacccccagcgtggacatcagcatgggccccgccagcggcttcaccatcaacgactacacccccgccaacgccatcgagcagcagtacgagtgcgagaacaccatcgtgtggaccgagagccacctgcccagcgaggtgatcagcagcgccgagctgcccagcgtgctgcccgacagcgccggcaagggcagcgagtacctgctggagcagagcagcctggcctgcaacgccgagtgcgtgatgctgcagaacgtgagcaaggagagcttcgagagaaccatcaacatcgccaagggcaacagcagcctgggcatgaccgtgagcgccaacaaggacggcctgggcatgatcgtgagaagcatcatccacggcggcgccatcagcagagacggcagaatcgccatcggcgactgcatcctgagcatcaacgaggagagcaccatcagcgtgaccaacgcccaggccagagccatgctgagaagacacagcctgatcggccccgacatcaagatcacctacgtgcccgccgagcacctggaggagttcaagatcagcctgggccagcagagcggcagagtgatggccctggacatcttcagcagctacaccggcagagacatccccgagctgcccgagagagaggagggcgagggcgaggagagcgagctgcagaacaccgcctacagcaactggaaccagcccagaagagtggagctgtggagagagcccagcaagagcctgggcatcagcatcgtgggcggcagaggcatgggcagcagactgagcaacggcgaggtgatgagaggcatcttcatcaagcacgtgctggaggacagccccgccggcaagaacggcaccctgaagcccggcgacagaatcgtggaggtggacggcatggacctgagagacgccagccacgagcaggccgtggaggccatcagaaaggccggcaaccccgtggtgttcatggtgcagagcatcatcaacagacccagaaagagccccctgcccagcctgctgcacaacctgtaccccaagtacaacttcagcagcaccaaccccttcgccgacagcctgcagatcaacgccgacaaggcccccagccagagcgagagcgagcccgagaaggcccccctgtgcagcgtgcccccccccccccccagcgccttcgccgagatgggcagcgaccacacccagagcagcgccagcaagatcagccaggacgtggacaaggaggacgagttcggctacagctggaagaacatcagagagagatacggcaccctgaccggcgagctgcacatgatcgagctggagaagggccacagcggcctgggcctgagcctggccggcaacaaggacagaagcagaatgagcgtgttcatcgtgggcatcgaccccaacggcgccgccggcaaggacggcagactgcagatcgccgacgagctgctggagatcaacggccagatcctgtacggcagaagccaccagaacgccagcagcatcatcaagtgcgcccccagcaaggtgaagatcatcttcatcagaaacaaggacgccgtgaaccagatggccgtgtgccccggcaacgccgtggagcccctgcccagcaacagcgagaacctgcagaacaaggagaccgagcccaccgtgaccaccagcgacgccgccgtggacctgagcagcttcaagaacgtgcagcacctggagctgcccaaggaccagggcggcctgggcatcgccatcagcgaggaggacaccctgagcggcgtgatcatcaagagcctgaccgagcacggcgtggccgccaccgacggcagactgaaggtgggcgaccagatcctggccgtggacgacgagatcgtggtgggctaccccatcgagaagttcatcagcctgctgaagaccgccaagatgaccgtgaagctgaccatccacgccgagaaccccgacagccaggccgtgcccagcgccgccggcgccgccagcggcgagaagaagaacagcagccagagcctgatggtgccccagagcggcagccccgagcccgagagcatcagaaacaccagcagaagcagcacccccgccatcttcgccagcgaccccgccacctgccccatcatccccggctgcgagaccaccatcgagatcagcaagggcagaaccggcctgggcctgagcatcgtgggcggcagcgacaccctgctgggcgccatcatcatccacgaggtgtacgaggagggcgccgcctgcaaggacggcagactgtgggccggcgaccagatcctggaggtgaacggcatcgacctgagaaaggccacccacgacgaggccatcaacgtgctgagacagaccccccagagagtgagactgaccctgtacagagacgaggccccctacaaggaggaggaggtgtgcgacaccctgaccatcgagctgcagaagaagcccggcaagggcctgggcctgagcatcgtgggcaagagaaacgacaccggcgtgttcgtgagcgacatcgtgaagggcggcatcgccgacgccgacggcagactgatgcagggcgaccagatcctgatggtgaacggcgaggacgtgagaaacgccacccaggaggccgtggccgccctgctgaaggtgagcgagggcagcctgagcagcttcaccttccccctgagcggcagcagcaccagcgagagcctggagagcagcagcaagaagaacgccctggccagcgagatccagggcctgagaaccgtggagatgaagaagggccccaccgacagcctgggcatcagcatcgccggcggcgtgggcagccccctgggcgacgtgcccatcttcatcgccatgatgcaccccaccggcgtggccgcccagacccagaagctgagagtgggcgacagaatcgtgaccatctgcggcaccagcaccgagggcatgacccacacccaggccgtgaacctgctgaagaacgccagcggcagcatcgagatgcaggtggtggccggcggcgacgtgagcgtggtgaccggccaccagcaggagcccgccagcagcagcctgagcttcaccggcctgaccagcagcagcatcttccaggacgacctgggccccccccagtgcaagagcatcaccctggagagaggccccgacggcctgggcttcagcatcgtgggcggctacggcagcccccacggcgacctgcccatctacgtgaagaccgtgttcgccaagggcgccgccagcgaggacggcagactgaagagaggcgaccagatcatcgccgtgaacggccagagcctggagggcgtgacccacgaggaggccgtggccatcctgaagagaaccaagggcaccgtgaccctgatggtgctgagctag

SEQ ID NO: 89595 - DNA, 5853 bp, Artificial Sequence
  Description of Artificial Sequence: Synthetic coding sequence
atgctggaggccatcgacaagaacagagccctgcacgccgccgagagactgcagaccaagctgagagagagaggcgacgtggccaacgaggacaagctgagcctgctgaagagcgtgctgcagagccccctgttcagccagatcctgagcctgcagaccagcgtgcagcagctgaaggaccaggtgaacatcgccaccagcgccaccagcaacatcgagtacgcccacgtgccccacctgagccccgccgtgatccccaccctgcagaacgagagcttcctgctgagccccaacaacggcaacctggaggccctgaccggccccggcatcccccacatcaacggcaagcccgcctgcgacgagttcgaccagctgatcaagaacatggcccagggcagacacgtggaggtgttcgagctgctgaagccccccagcggcggcctgggcttcagcgtggtgggcctgagaagcgagaacagaggcgagctgggcatcttcgtgcaggagatccaggagggcagcgtggcccacagagacggcagactgaaggagaccgaccagatcctggccatcaacggccaggccctggaccagaccatcacccaccagcaggccatcagcatcctgcagaaggccaaggacaccgtgcagctggtgatcgccagaggcagcctgccccagctggtgagccccatcgtgagcagaagccccagcgccgccagcaccatcagcgcccacagcaaccccgtgcactggcagcacatggagaccatcgagctggtgaacgacggcagcggcctgggcttcggcatcatcggcggcaaggccaccggcgtgatcgtgaagaccatcctgcccggcggcgtggccgaccagcacggcagactgtgcagcggcgaccacatcctgaagatcggcgacaccgacctggccggcatgagcagcgagcaggtggcccaggtgctgagacagtgcggcaacagagtgaagctgatgatcgccagaggcgccatcgaggagagaaccgcccccaccgccctgggcatcaccctgagcagcagccccaccagcacccccgagctgagagtggacgccagcacccagaagggcgaggagagcgagaccttcgacgtggagctgaccaagaacgtgcagggcctgggcatcaccatcgccggctacatcggcgacaagaagctggagcccagcggcatcttcgtgaagagcatcaccaagagcagcgccgtggagcacgacggcagaatccagatcggcgaccagatcatcgccgtggacggcaccaacctgcagggcttcaccaaccagcaggccgtggaggtgctgagacacaccggccagaccgtgctgctgaccctgatgagaagaggcatgaagcaggaggccgagctgatgagcagagaggacgtgaccaaggacgccgacctgagccccgtgaacgccagcatcatcaaggagaactacgagaaggacgaggacttcctgagcagcaccagaaacaccaacatcctgcccaccgaggaggagggctaccccctgctgagcgccgagatcgaggagatcgaggacgcccagaagcaggaggccgccctgctgaccaagtggcagagaatcatgggcatcaactacgagatcgtggtggcccacgtgagcaagttcagcgagaacagcggcctgggcatcagcctggaggccaccgtgggccaccacttcatcagaagcgtgctgcccgagggccccgtgggccacagcggcaagctgttcagcggcgacgagctgctggaggtgaacggcatcaccctgctgggcgagaaccaccaggacgtggtgaacatcctgaaggagctgcccatcgaggtgaccatggtgtgctgcagaagaaccgtgccccccaccacccagagcgagctggacagcctgggcatccagcacatcgagctggagaagggcagcaagggcctgggcttcagcatcctggactaccaggaccccatcgaccccgccagcaccgtgatcatcatcagaagcctggtgcccggcggcatcgccgagaaggacggcagactgctgcccggcgacagactgatgttcgtgaacgacgtgaacctggagaacagcagcctggaggaggccgtggaggccctgaagggcgcccccagcggcaccgtgagaatcggcgtggccaagcccctgcccctgagccccgaggagggctacgtgagcgccaaggaggacagcttcctgtaccccccccacagctgcgaggaggccggcctggccgacaagcccctgttcagagccgacctggccctggtgggcaccaacgacgccgacctggtggacgagagcaccttcgagagcccctacagccccgagaacgacagcatctacagcacccaggccagcatcctgagcctgcacggcagcagctgcggcgacggcctgaactacggcagcagcctgcccagcagcccccccaaggacgtgatcgagaacagctgcgaccccgtgctggacctgcacatgagcctggaggagctgtacacccagaacctgctgcagagacaggacgagaacacccccagcgtggacatcagcatgggccccgccagcggcttcaccatcaacgactacacccccgccaacgccatcgagcagcagtacgagtgcgagaacaccatcgtgtggaccgagagccacctgcccagcgaggtgatcagcagcgccgagctgcccagcgtgctgcccgacagcgccggcaagggcagcgagtacctgctggagcagagcagcctggcctgcaacgccgagtgcgtgatgctgcagaacgtgagcaaggagagcttcgagagaaccatcaacatcgccaagggcaacagcagcctgggcatgaccgtgagcgccaacaaggacggcctgggcatgatcgtgagaagcatcatccacggcggcgccatcagcagagacggcagaatcgccatcggcgactgcatcctgagcatcaacgaggagagcaccatcagcgtgaccaacgcccaggccagagccatgctgagaagacacagcctgatcggccccgacatcaagatcacctacgtgcccgccgagcacctggaggagttcaagatcagcctgggccagcagagcggcagagtgatggccctggacatcttcagcagctacaccggcagagacatccccgagctgcccgagagagaggagggcgagggcgaggagagcgagctgcagaacaccgcctacagcaactggaaccagcccagaagagtggagctgtggagagagcccagcaagagcctgggcatcagcatcgtgggcggcagaggcatgggcagcagactgagcaacggcgaggtgatgagaggcatcttcatcaagcacgtgctggaggacagccccgccggcaagaacggcaccctgaagcccggcgacagaatcgtggaggcccccagccagagcgagagcgagcccgagaaggcccccctgtgcagcgtgcccccccccccccccagcgccttcgccgagatgggcagcgaccacacccagagcagcgccagcaagatcagccaggacgtggacaaggaggacgagttcggctacagctggaagaacatcagagagagatacggcaccctgaccggcgagctgcacatgatcgagctggagaagggccacagcggcctgggcctgagcctggccggcaacaaggacagaagcagaatgagcgtgttcatcgtgggcatcgaccccaacggcgccgccggcaaggacggcagactgcagatcgccgacgagctgctggagatcaacggccagatcctgtacggcagaagccaccagaacgccagcagcatcatcaagtgcgcccccagcaaggtgaagatcatcttcatcagaaacaaggacgccgtgaaccagatggccgtgtgccccggcaacgccgtggagcccctgcccagcaacagcgagaacctgcagaacaaggagaccgagcccaccgtgaccaccagcgacgccgccgtggacctgagcagcttcaagaacgtgcagcacctggagctgcccaaggaccagggcggcctgggcatcgccatcagcgaggaggacaccctgagcggcgtgatcatcaagagcctgaccgagcacggcgtggccgccaccgacggcagactgaaggtgggcgaccagatcctggccgtggacgacgagatcgtggtgggctaccccatcgagaagttcatcagcctgctgaagaccgccaagatgaccgtgaagctgaccatccacgccgagaaccccgacagccaggccgtgcccagcgccgccggcgccgccagcggcgagaagaagaacagcagccagagcctgatggtgccccagagcggcagccccgagcccgagagcatcagaaacaccagcagaagcagcacccccgccatcttcgccagcgaccccgccacctgccccatcatccccggctgcgagaccaccatcgagatcagcaagggcagaaccggcctgggcctgagcatcgtgggcggcagcgacaccctgctgggcgccatcatcatccacgaggtgtacgaggagggcgccgcctgcaaggacggcagactgtgggccggcgaccagatcctggaggtgaacggcatcgacctgagaaaggccacccacgacgaggccatcaacgtgctgagacagaccccccagagagtgagactgaccctgtacagagacgaggccccctacaaggaggaggaggtgtgcgacaccctgaccatcgagctgcagaagaagcccggcaagggcctgggcctgagcatcgtgggcaagagaaacgacaccggcgtgttcgtgagcgacatcgtgaagggcggcatcgccgacgccgacggcagactgatgcagggcgaccagatcctgatggtgaacggcgaggacgtgagaaacgccacccaggaggccgtggccgccctgctgaagtgcagcctgggcaccgtgaccctggaggtgggcagaatcaaggccggccccttccacagcgagagaagacccagccagagcagccaggtgagcgagggcagcctgagcagcttcaccttccccctgagcggcagcagcaccagcgagagcctggagagcagcagcaagaagaacgccctggccagcgagatccagggcctgagaaccgtggagatgaagaagggccccaccgacagcctgggcatcagcatcgccggcggcgtgggcagccccctgggcgacgtgcccatcttcatcgccatgatgcaccccaccggcgtggccgcccagacccagaagctgagagtgggcgacagaatcgtgaccatctgcggcaccagcaccgagggcatgacccacacccaggccgtgaacctgctgaagaacgccagcggcagcatcgagatgcaggtggtggccggcggcgacgtgagcgtggtgaccggccaccagcaggagcccgccagcagcagcctgagcttcaccggcctgaccagcagcagcatcttccaggacgacctgggccccccccagtgcaagagcatcaccctggagagaggccccgacggcctgggcttcagcatcgtgggcggctacggcagcccccacggcgacctgcccatctacgtgaagaccgtgttcgccaagggcgccgccagcgaggacggcagactgaagagaggcgaccagatcatcgccgtgaacggccagagcctggagggcgtgacccacgaggaggccgtggccatcctgaagagaaccaagggcaccgtgaccctgatggtgctgagctag

SEQ ID NO: 89596 - DNA, 915 bp, Artificial Sequence
  Description of Artificial Sequence: Synthetic coding sequence
atgcagggcgaccagatcctgatggtgaacggcgaggacgtgagaaacgccacccaggaggccgtggccgccctgctgaagtgcagcctgggcaccgtgaccctggaggtgggcagaatcaaggccggccccttccacagcgagagaagacccagccagagcagccaggtgagcgagggcagcctgagcagcttcaccttccccctgagcggcagcagcaccagcgagagcctggagagcagcagcaagaagaacgccctggccagcgagatccagggcctgagaaccgtggagatgaagaagggccccaccgacagcctgggcatcagcatcgccggcggcgtgggcagccccctgggcgacgtgcccatcttcatcgccatgatgcaccccaccggcgtggccgcccagacccagaagctgagagtgggcgacagaatcgtgaccatctgcggcaccagcaccgagggcatgacccacacccaggccgtgaacctgctgaagaacgccagcggcagcatcgagatgcaggtggtggccggcggcgacgtgagcgtggtgaccggccaccagcaggagcccgccagcagcagcctgagcttcaccggcctgaccagcagcagcatcttccaggacgacctgggccccccccagtgcaagagcatcaccctggagagaggccccgacggcctgggcttcagcatcgtgggcggctacggcagcccccacggcgacctgcccatctacgtgaagaccgtgttcgccaagggcgccgccagcgaggacggcagactgaagagaggcgaccagatcatcgccgtgaacggccagagcctggagggcgtgacccacgaggaggccgtggccatcctgaagagaaccaagggcaccgtgaccctgatggtgctgagctag

SEQ ID NO: 89597 - DNA, 6126 bp, Artificial Sequence; identical to SEQ ID NO: 89594
  Description of Artificial Sequence: Synthetic coding sequence

SEQ ID NO: 89598 - DNA, 6114 bp, Artificial Sequence
  Description of Artificial Sequence: Synthetic coding sequence
atgctggaggccatcgacaagaacagagccctgcacgccgccgagagactgcagaccaagctgagagagagaggcgacgtggccaacgaggacaagctgagcctgctgaagagcgtgctgcagagccccctgttcagccagatcctgagcctgcagaccagcgtgcagcagctgaaggaccaggtgaacatcgccaccagcgccaccagcaacatcgagtacgcccacgtgccccacctgagccccgccgtgatccccaccctgcagaacgagagcttcctgctgagccccaacaacggcaacctggaggccctgaccggccccggcatcccccacatcaacggcaagcccgcctgcgacgagttcgaccagctgatcaagaacatggcccagggcagacacgtggaggtgttcgagctgctgaagccccccagcggcggcctgggcttcagcgtggtgggcctgagaagcgagaacagaggcgagctgggcatcttcgtgcaggagatccaggagggcagcgtggcccacagagacggcagactgaaggagaccgaccagatcctggccatcaacggccaggccctggaccagaccatcacccaccagcaggccatcagcatcctgcagaaggccaaggacaccgtgcagctggtgatcgccagaggcagcctgccccagctggtgagccccatcgtgagcagaagccccagcgccgccagcaccatcagcgcccacagcaaccccgtgcactggcagcacatggagaccatcgagctggtgaacgacggcagcggcctgggcttcggcatcatcggcggcaaggccaccggcgtgatcgtgaagaccatcctgcccggcggcgtggccgaccagcacggcagactgtgcagcggcgaccacatcctgaagatcggcgacaccgacctggccggcatgagcagcgagcaggtggcccaggtgctgagacagtgcggcaacagagtgaagctgatgatcgccagaggcgccatcgaggagagaaccgcccccaccgccctgggcatcaccctgagcagcagccccaccagcacccccgagctgagagtggacgccagcacccagaagggcgaggagagcgagaccttcgacgtggagctgaccaagaacgtgcagggcctgggcatcaccatcgccggctacatcggcgacaagaagctggagcccagcggcatcttcgtgaagagcatcaccaagagcagcgccgtggagcacgacggcagaatccagatcggcgaccagatcatcgccgtggacggcaccaacctgcagggcttcaccaaccagcaggccgtggaggtgctgagacacaccggccagaccgtgctgctgaccctgatgagaagaggcatgaagcaggaggccgagctgatgagcagagaggacgtgaccaaggacgccgacctgagccccgtgaacgccagcatcatcaaggagaactacgagaaggacgaggacttcctgagcagcaccagaaacaccaacatcctgcccaccgaggaggagggctaccccctgctgagcgccgagatcgaggagatcgaggacgcccagaagcaggaggccgccctgctgaccaagtggcagagaatcatgggcatcaactacgagatcgtggtggcccacgtgagcaagttcagcgagaacagcggcctgggcatcagcctggaggccaccgtgggccaccacttcatcagaagcgtgctgcccgagggccccgtgggccacagcggcaagctgttcagcggcgacgagctgctggaggtgaacggcatcaccctgctgggcgagaaccaccaggacgtggtgaacatcctgaaggagctgcccatcgaggtgaccatggtgtgctgcagaagaaccgtgccccccaccacccagagcgagctggacagcctggacctgtgcgacatcgagctgaccgagaagccccacgtggacctgggcgagttcatcggcagcagcgagaccgaggaccccgtgctggccatgaccgacgccggccagagcaccgaggaggtgcaggcccccctggccatgtgggaggccggcatccagcacatcgagctggagaagggcagcaagggcctgggcttcagcatcctggactaccaggaccccatcgaccccgccagcaccgtgatcatcatcagaagcctggtgcccggcggcatcgccgagaaggacggcagactgctgcccggcgacagactgatgttcgtgaacgacgtgaacctggagaacagcagcctggaggaggccgtggaggccctgaagggcgcccccagcggcaccgtgagaatcggcgtggccaagcccctgcccctgagccccgaggagggctacgtgagcgccaaggaggacagcttcctgtaccccccccacagctgcgaggaggccggcctggccgacaagcccctgttcagagccgacctggccctggtgggcaccaacgacgccgacctggtggacgagagcaccttcgagagcccctacagccccgagaacgacagcatctacagcacccaggccagcatcctgagcctgcacggcagcagctgcggcgacggcctgaactacggcagcagcctgcccagcagcccccccaaggacgtgatcgagaacagctgcgaccccgtgctggacctgcacatgagcctggaggagctgtacacccagaacctgctgcagagacaggacgagaacacccccagcgtggacatcagcatgggccccgccagcggcttcaccatcaacgactacacccccgccaacgccatcgagcagcagtacgagtgcgagaacaccatcgtgtggaccgagagccacctgcccagcgaggtgatcagcagcgccgagctgcccagcgtgctgcccgacagcgccggcaagggcagcgagtacctgctggagcagagcagcctggcctgcaacgccgagtgcgtgatgctgcagaacgtgagcaaggagagcttcgagagaaccatcaacatcgccaagggcaacagcagcctgggcatgaccgtgagcgccaacaaggacggcctgggcatgatcgtgagaagcatcatccacggcggcgccatcagcagagacggcagaatcgccatcggcgactgcatcctgagcatcaacgaggagagcaccatcagcgtgaccaacgcccaggccagagccatgctgagaagacacagcctgatcggccccgacatcaagatcacctacgtgcccgccgagcacctggaggagttcaagatcagcctgggccagcagagcggcagagtgatggccctggacatcttcagcagctacaccggcagagacatccccgagctgcccgagagagaggagggcgagggcgaggagagcgagctgcagaacaccgcctacagcaactggaaccagcccagaagagtggagctgtggagagagcccagcaagagcctgggcatcagcatcgtgggcggcagaggcatgggcagcagactgagcaacggcgaggtgatgagaggcatcttcatcaagcacgtgctggaggacagccccgccggcaagaacggcaccctgaagcccggcgacagaatcgtggaggtggacggcatggacctgagagacgccagccacgagcaggccgtggaggccatcagaaaggccggcaaccccgtggtgttcatggtgcagagcatcatcaacagacccagagcccccagccagagcgagagcgagcccgagaaggcccccctgtgcagcgtgcccccccccccccccagcgccttcgccgagatgggcagcgaccacacccagagcagcgccagcaagatcagccaggacgtggacaaggaggacgagttcggctacagctggaagaacatcagagagagatacggcaccctgaccggcgagctgcacatgatcgagctggagaagggccacagcggcctgggcctgagcctggccggcaacaaggacagaagcagaatgagcgtgttcatcgtgggcatcgaccccaacggcgccgccggcaaggacggcagactgcagatcgccgacgagctgctggagatcaacggccagatcctgtacggcagaagccaccagaacgccagcagcatcatcaagtgcgcccccagcaaggtgaagatcatcttcatcagaaacaaggacgccgtgaaccagatggccgtgtgccccggcaacgccgtggagcccctgcccagcaacagcgagaacctgcagaacaaggagaccgagcccaccgtgaccaccagcgacgccgccgtggacctgagcagcttcaagaacgtgcagcacctggagctgcccaaggaccagggcggcctgggcatcgccatcagcgaggaggacaccctgagcggcgtgatcatcaagagcctgaccgagcacggcgtggccgccaccgacggcagactgaaggtgggcgaccagatcctggccgtggacgacgagatcgtggtgggctaccccatcgagaagttcatcagcctgctgaagaccgccaagatgaccgtgaagctgaccatccacgccgagaaccccgacagccaggccgtgcccagcgccgccggcgccgccagcggcgagaagaagaacagcagccagagcctgatggtgccccagagcggcagccccgagcccgagagcatcagaaacaccagcagaagcagcacccccgccatcttcgccagcgaccccgccacctgccccatcatccccggctgcgagaccaccatcgagatcagcaagggcagaaccggcctgggcctgagcatcgtgggcggcagcgacaccctgctgggcgccatcatcatccacgaggtgtacgaggagggcgccgcctgcaaggacggcagactgtgggccggcgaccagatcctggaggtgaacggcatcgacctgagaaaggccacccacgacgaggccatcaacgtgctgagacagaccccccagagagtgagactgaccctgtacagagacgaggccccctacaaggaggaggaggtgtgcgacaccctgaccatcgagctgcagaagaagcccggcaagggcctgggcctgagcatcgtgggcaagagaaacgacaccggcgtgttcgtgagcgacatcgtgaagggcggcatcgccgacgccgacggcagactgatgcagggcgaccagatcctgatggtgaacggcgaggacgtgagaaacgccacccaggaggccgtggccgccctgctgaagtgcagcctgggcaccgtgaccctggaggtgggcagaatcaaggccggccccttccacagcgagagaagacccagccagagcagccaggtgagcgagggcagcctgagcagcttcaccttccccctgagcggcagcagcaccagcgagagcctggagagcagcagcaagaagaacgccctggccagcgagatccagggcctgagaaccgtggagatgaagaagggccccaccgacagcctgggcatcagcatcgccggcggcgtgggcagccccctgggcgacgtgcccatcttcatcgccatgatgcaccccaccggcgtggccgcccagacccagaagctgagagtgggcgacagaatcgtgaccatctgcggcaccagcaccgagggcatgacccacacccaggccgtgaacctgctgaagaacgccagcggcagcatcgagatgcaggtggtggccggcggcgacgtgagcgtggtgaccggccaccagcaggagcccgccagcagcagcctgagcttcaccggcctgaccagcagcagcatcttccaggacgacctgggccccccccagtgcaagagcatcaccctggagagaggccccgacggcctgggcttcagcatcgtgggcggctacggcagcccccacggcgacctgcccatctacgtgaagaccgtgttcgccaagggcgccgccagcgaggacggcagactgaagagaggcgaccagatcatcgccgtgaacggccagagcctggagggcgtgacccacgaggaggccgtggccatcctgaagagaaccaagggcaccgtgaccctgatggtgctgagctag

SEQ ID NO: 89599 - DNA, 6027 bp, Artificial Sequence
  Description of Artificial Sequence: Synthetic coding sequence
atgctggaggccatcgacaagaacagagccctgcacgccgccgagagactgcagaccaagctgagagagagaggcgacgtggccaacgaggacaagctgagcctgctgaagagcgtgctgcagagccccctgttcagccagatcctgagcctgcagaccagcgtgcagcagctgaaggaccaggtgaacatcgccaccagcgccaccagcaacatcgagtacgcccacgtgccccacctgagccccgccgtgatccccaccctgcagaacgagagcttcctgctgagccccaacaacggcaacctggaggccctgaccggccccggcatcccccacatcaacggcaagcccgcctgcgacgagttcgaccagctgatcaagaacatggcccagggcagacacgtggaggtgttcgagctgctgaagccccccagcggcggcctgggcttcagcgtggtgggcctgagaagcgagaacagaggcgagctgggcatcttcgtgcaggagatccaggagggcagcgtggcccacagagacggcagactgaaggagaccgaccagatcctggccatcaacggccaggccctggaccagaccatcacccaccagcaggccatcagcatcctgcagaaggccaaggacaccgtgcagctggtgatcgccagaggcagcctgccccagctggtgagccccatcgtgagcagaagccccagcgccgccagcaccatcagcgcccacagcaaccccgtgcactggcagcacatggagaccatcgagctggtgaacgacggcagcggcctgggcttcggcatcatcggcggcaaggccaccggcgtgatcgtgaagaccatcctgcccggcggcgtggccgaccagcacggcagactgtgcagcggcgaccacatcctgaagatcggcgacaccgacctggccggcatgagcagcgagcaggtggcccaggtgctgagacagtgcggcaacagagtgaagctgatgatcgccagaggcgccatcgaggagagaaccgcccccaccgccctgggcatcaccctgagcagcagccccaccagcacccccgagctgagagtggacgccagcacccagaagggcgaggagagcgagaccttcgacgtggagctgaccaagaacgtgcagggcctgggcatcaccatcgccggctacatcggcgacaagaagctggagcccagcggcatcttcgtgaagagcatcaccaagagcagcgccgtggagcacgacggcagaatccagatcggcgaccagatcatcgccgtggacggcaccaacctgcagggcttcaccaaccagcaggccgtggaggtgctgagacacaccggccagaccgtgctgctgaccctgatgagaagaggcatgaagcaggaggccgagctgatgagcagagaggacgtgaccaaggacgccgacctgagccccgtgaacgccagcatcatcaaggagaactacgagaaggacgaggacttcctgagcagcaccagaaacaccaacatcctgcccaccgaggaggagggctaccccctgctgagcgccgagatcgaggagatcgaggacgcccagaagcaggaggccgccctgctgaccaagtggcagagaatcatgggcatcaactacgagatcgtggtggcccacgtgagcaagttcagcgagaacagcggcctgggcatcagcctggaggccaccgtgggccaccacttcatcagaagcgtgctgcccgagggccccgtgggccacagcggcaagctgttcagcggcgacgagctgctggaggtgaacggcatcaccctgctgggcgagaaccaccaggacgtggtgaacatcctgaaggagctgcccatcgaggtgaccatggtgtgctgcagaagaaccgtgccccccaccacccagagcgagctggacagcctggacctgtgcgacatcgagctgaccgagaagccccacgtggacctgggcgagttcatcggcagcagcgagaccgaggaccccgtgctggccatgaccgacgccggccagagcaccgaggaggtgcaggcccccctggccatgtgggaggccggcatccagcacatcgagctggagaagggcagcaagggcctgggcttcagcatcctggactaccaggaccccatcgaccccgccagcaccgtgatcatcatcagaagcctggtgcccggcggcatcgccgagaaggacggcagactgctgcccggcgacagactgatgttcgtgaacgacgtgaacctggagaacagcagcctggaggaggccgtggaggccctgaagggcgcccccagcggcaccgtgagaatcggcgtggccaagcccctgcccctgagccccgaggagggctacgtgagcgccaaggaggacagcttcctgtaccccccccacagctgcgaggaggccggcctggccgacaagcccctgttcagagccgacctggccctggtgggcaccaacgacgccgacctggtggacgagagcaccttcgagagcccctacagccccgagaacgacagcatctacagcacccaggccagcatcctgagcctgcacggcagcagctgcggcgacggcctgaactacggcagcagcctgcccagcagcccccccaaggacgtgatcgagaacagctgcgaccccgtgctggacctgcacatgagcctggaggagctgtacacccagaacctgctgcagagacaggacgagaacacccccagcgtggacatcagcatgggccccgccagcggcttcaccatcaacgactacacccccgccaacgccatcgagcagcagtacgagtgcgagaacaccatcgtgtggaccgagagccacctgcccagcgaggtgatcagcagcgccgagctgcccagcgtgctgcccgacagcgccggcaagggcagcgagtacctgctggagcagagcagcctggcctgcaacgccgagtgcgtgatgctgcagaacgtgagcaaggagagcttcgagagaaccatcaacatcgccaagggcaacagcagcctgggcatgaccgtgagcgccaacaaggacggcctgggcatgatcgtgagaagcatcatccacggcggcgccatcagcagagacggcagaatcgccatcggcgactgcatcctgagcatcaacgaggagagcaccatcagcgtgaccaacgcccaggccagagccatgctgagaagacacagcctgatcggccccgacatcaagatcacctacgtgcccgccgagcacctggaggagttcaagatcagcctgggccagcagagcggcagagtgatggccctggacatcttcagcagctacaccggcagagacatccccgagctgcccgagagagaggagggcgagggcgaggagagcgagctgcagaacaccgcctacagcaactggaaccagcccagaagagtggagctgtggagagagcccagcaagagcctgggcatcagcatcgtgggcggcagaggcatgggcagcagactgagcaacggcgaggtgatgagaggcatcttcatcaagcacgtgctggaggacagccccgccggcaagaacggcaccctgaagcccggcgacagaatcgtggaggtggacggcatggacctgagagacgccagccacgagcaggccgtggaggccatcagaaaggccggcaaccccgtggtgttcatggtgcagagcatcatcaacagacccagagcccccagccagagcgagagcgagcccgagaaggcccccctgtgcagcgtgcccccccccccccccagcgccttcgccgagatgggcagcgaccacacccagagcagcgccagcaagatcagccaggacgtggacaaggaggacgagttcggctacagctggaagaacatcagagagagatacggcaccctgaccggcgagctgcacatgatcgagctggagaagggccacagcggcctgggcctgagcctggccggcaacaaggacagaagcagaatgagcgtgttcatcgtgggcatcgaccccaacggcgccgccggcaaggacggcagactgcagatcgccgacgagctgctggagatcaacggccagatcctgtacggcagaagccaccagaacgccagcagcatcatcaagtgcgcccccagcaaggtgaagatcatcttcatcagaaacaaggacgccgtgaaccagatggccgtgtgccccggcaacgccgtggagcccctgcccagcaacagcgagaacctgcagaacaaggagaccgagcccaccgtgaccaccagcgacgccgccgtggacctgagcagcttcaagaacgtgcagcacctggagctgcccaaggaccagggcggcctgggcatcgccatcagcgaggaggacaccctgagcggcgtgatcatcaagagcctgaccgagcacggcgtggccgccaccgacggcagactgaaggtgggcgaccagatcctggccgtggacgacgagatcgtggtgggctaccccatcgagaagttcatcagcctgctgaagaccgccaagatgaccgtgaagctgaccatccacgccgagaaccccgacagccaggccgtgcccagcgccgccggcgccgccagcggcgagaagaagaacagcagccagagcctgatggtgccccagagcggcagccccgagcccgagagcatcagaaacaccagcagaagcagcacccccgccatcttcgccagcgaccccgccacctgccccatcatccccggctgcgagaccaccatcgagatcagcaagggcagaaccggcctgggcctgagcatcgtgggcggcagcgacaccctgctgggcgccatcatcatccacgaggtgtacgaggagggcgccgcctgcaaggacggcagactgtgggccggcgaccagatcctggaggtgaacggcatcgacctgagaaaggccacccacgacgaggccatcaacgtgctgagacagaccccccagagagtgagactgaccctgtacagagacgaggccccctacaaggaggaggaggtgtgcgacaccctgaccatcgagctgcagaagaagcccggcaagggcctgggcctgagcatcgtgggcaagagaaacgacaccggcgtgttcgtgagcgacatcgtgaagggcggcatcgccgacgccgacggcagactgatgcagggcgaccagatcctgatggtgaacggcgaggacgtgagaaacgccacccaggaggccgtggccgccctgctgaaggtgagcgagggcagcctgagcagcttcaccttccccctgagcggcagcagcaccagcgagagcctggagagcagcagcaagaagaacgccctggccagcgagatccagggcctgagaaccgtggagatgaagaagggccccaccgacagcctgggcatcagcatcgccggcggcgtgggcagccccctgggcgacgtgcccatcttcatcgccatgatgcaccccaccggcgtggccgcccagacccagaagctgagagtgggcgacagaatcgtgaccatctgcggcaccagcaccgagggcatgacccacacccaggccgtgaacctgctgaagaacgccagcggcagcatcgagatgcaggtggtggccggcggcgacgtgagcgtggtgaccggccaccagcaggagcccgccagcagcagcctgagcttcaccggcctgaccagcagcagcatcttccaggacgacctgggccccccccagtgcaagagcatcaccctggagagaggccccgacggcctgggcttcagcatcgtgggcggctacggcagcccccacggcgacctgcccatctacgtgaagaccgtgttcgccaagggcgccgccagcgaggacggcagactgaagagaggcgaccagatcatcgccgtgaacggccagagcctggagggcgtgacccacgaggaggccgtggccatcctgaagagaaccaagggcaccgtgaccctgatggtgctgagctag

SEQ ID NO: 89600 - DNA, 1089 bp, Artificial Sequence
  Description of Artificial Sequence: Synthetic coding sequence
atggagaccgacgccccccagcccggcctggccagccccgacagcccccacgacccctgcaagatgttcatcggcggcctgagctggcagaccacccaggagggcctgagagagtacttcggccagttcggcgaggtgaaggagtgcctggtgatgagagaccccctgaccaagagaagcagaggcttcggcttcgtgaccttcatggaccaggccggcgtggacaaggtgctggcccagagcagacacgagctggacagcaagaccatcgaccccaaggtggccttccccagaagagcccagcccaagatggtgaccagaaccaagaagatcttcgtgggcggcctgagcgtgaacaccaccgtggaggacgtgaagcagtacttcgagcagttcggcaaggtggacgacgccatgctgatgttcgacaagaccaccaacagacacagaggcttcggcttcgtgaccttcgagagcgaggacatcgtggagaaggtgtgcgagatccacttccacgagatcaacaacaagatggtggagtgcaagaaggcccagcccaaggaggtgatgagccccaccggcagcgccagaggcagaagcagagtgatgccctacggcatggacgccttcatgctgggcatcggcatgctgggctaccccggcttccaggccaccacctacgccagcagaagctacaccggcctggcccccggctacacctaccagttccccgagttcagagtggagagaacccccctgcccagcgcccccgtgctgcccgagctgaccgccatccccctgaccgcctacggccccatggccgccgccgccgccgccgccgccgtggtgagaggcaccggcagccacccctggaccatggcccccccccccggcagcacccccagcagaaccggcggcttcctgggcaccaccagccccggccccatggccgagctgtacggcgccgccaaccaggacagcggcgtgagcagctacatcagcgccgccagccccgcccccagcaccggcttcggccacagcctgggcggccccctgatcgccaccgccttcaccaacggctaccactag

SEQ ID NO: 89601 - DNA, 627 bp, Artificial Sequence
  Description of Artificial Sequence: Synthetic coding sequence
atggccaccagcgccgtgcccagcgacaacctgcccacctacaagctggtggtggtgggcgacggcggcgtgggcaagagcgccctgaccatccagttcttccagaagatcttcgtgcccgactacgaccccaccatcgaggacagctacctgaagcacaccgagatcgacaaccagtgggccatcctggacgtgctggacaccgccggccaggaggagttcagcgccatgagagagcagtacatgagaaccggcgacggcttcctgatcgtgtacagcgtgaccgacaaggccagcttcgagcacgtggacagattccaccagctgatcctgagagtgaaggacagagagagcttccccatgatcctggtggccaacaaggtggacctgatgcacctgagaaagatcaccagagagcagggcaaggagatggccaccaagcacaacatcccctacatcgagaccagcgccaaggacccccccctgaacgtggacaaggccttccacgacctggtgagagtgatcagacagcagatccccgagaagagccagaagaagaagaagaagaccaagtggagaggcgacagagccaccggcacccacaagctgcagtgcgtgatcctgtag

SEQ ID NO: 89602 - DNA, 627 bp, Artificial Sequence; identical to SEQ ID NO: 89601
  Description of Artificial Sequence: Synthetic coding sequence

SEQ ID NO: 89603 - DNA, 399 bp, Artificial Sequence
  Description of Artificial Sequence: Synthetic coding sequence
atgagagagcagtacatgagaaccggcgacggcttcctgatcgtgtacagcgtgaccgacaaggccagcttcgagcacgtggacagattccaccagctgatcctgagagtgaaggacagagagagcttccccatgatcctggtggccaacaaggtggacctgatgcacctgagaaagatcaccagagagcagggcaaggagatggccaccaagcacaacatcccctacatcgagaccagcgccaaggacccccccctgaacgtggacaaggccttccacgacctggtgagagtgatcagacagcagatccccgagaagagccagaagaagaagaagaagaccaagtggagaggcgacagagccaccggcacccacaagctgcagtgcgtgatcctgtag

SEQ ID NO: 89604 - DNA, 627 bp, Artificial Sequence; identical to SEQ ID NO: 89601
  Description of Artificial Sequence: Synthetic coding sequence

SEQ ID NO: 89605 - DNA, 72 bp, Artificial Sequence
  Description of Artificial Sequence: Synthetic coding sequence
atggccaccagcgccgtgcccagcgacaacctgcccacctacaagctggtggtggtgggcgacggcggctag

SEQ ID NO: 89606 - DNA, 2628 bp, Artificial Sequence
  Description of Artificial Sequence: Synthetic coding sequence
atgagagagctggtgaacatccccctggtgcacatcctgaccctggtggccttcagcggcaccgagaagctgcccaaggcccccgtgatcaccacccccctggagaccgtggacgccctggtggaggaggtggccaccttcatgtgcgccgtggagagctacccccagcccgagatcagctggaccagaaacaagatcctgatcaagctgttcgacaccagatacagcatcagagagaacggccagctgctgaccatcctgagcgtggaggacagcgacgacggcatctactgctgcaccgccaacaacggcgtgggcggcgccgtggagagctgcggcgccctgcaggtgaagatgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggaggtgttcgccagaatcctgagagcccccgagagccacaacgtgaccttcggcagcttcgtgaccctgcactgcaccgccaccggcatccccgtgcccaccatcacctggatcgagaacggcaacgccgtgagcagcggcagcatccaggagagcgtgaaggacagagtgatcgacagcagactgcagctgttcatcaccaagcccggcctgtacacctgcatcgccaccaacaagcacggcgagaagttcagcaccgccaaggccgccgccaccatcagcatcgccgagatgctgttcatcagcagcttcagcaagccccagaaggacaacaagggctactgcgcccagtacagaggcgaggtgtgcaacgccgtgctggccaaggacgccctggtgttcctgaacaccagctacgccgaccccgaggaggcccaggagctgctggtgcacaccgcctggaacgagctgaaggtggtgagccccgtgtgcagacccgccgccgaggccctgctgtgcaaccacatcttccaggagtgcagccccggcgtggtgcccacccccatccccatctgcagagagtactgcctggccgtgaaggagctgttctgcgccaaggagtggctggtgatggaggagaagacccacagaggcctgtacagaagcgagatgcacctgctgagcgtgcccgagtgcagcaagctgcccagcatgcactgggaccccaccgcctgcgccagactgccccacctggactacaacaaggagaacctgaagaccttcccccccatgaccagcagcaagcccagcgtggacatccccaacctgcccagcagcagcagcagcagcttcagcgtgagccccacctacagcatgaccgtgatcatcagcatcatgagcagcttcgccatcttcgtgctgctgaccatcaccaccctgtactgctgcagaagaagaaagcagtggaagaacaagaagagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcgtgtgcgccgtgggcaagcccatgtgcctgctgttcgagtacatggcctacggcgacctgaacgagttcctgagaagcatgagcccccacaccgtgtgcagcctgagccacagcgacctgagcatgagagcccaggtgagcagccccggccccccccccctgagctgcgccgagcagctgtgcatcgccagacaggtggccgccggcatggcctacctgagcgagagaaagttcgtgcacagagacctggccaccagaaactgcctggtgggcgagaacatggtggtgaagatcgccgacttcggcctgagcagaaacatctacagcgccgactactacaaggccaacgagaacgacgccatccccatcagatggatgccccccgagagcatcttctacaacagatacaccaccgagagcgacgtgtgggcctacggcgtggtgctgtgggagatcttcagctacggcctgcagccctactacggcatggcccacgaggaggtgatctactacgtgagagacggcaacatcctgagctgccccgagaactgccccgtggagctgtacaacctgatgagactgtgctggagcaagctgcccgccgacagacccagcttcaccagcatccacagaatcctggagagaatgtgcgagagagccgagggcaccgtgagcgtgtag

SEQ ID NO: 89607 - DNA, 570 bp, Artificial Sequence
  Description of Artificial Sequence: Synthetic coding sequence
atggccggcaacggcagagaggacccccagagaaccctgcagatcagagacgccttcgccgtgagagccagaatgcagcaggccagccagcacgccctgggcccccacggcctgtgccagaccgccaccagcagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcatgaagatccaggtgagaatctgcatcagcagcgagaacagaggcttccccagcttcagccccctggtgagagccttcagcttcagcccctag

SEQ ID NO: 89608 - DNA, 351 bp, Artificial Sequence
  Description of Artificial Sequence: Synthetic coding sequence
atgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggagggcgccaagggcatccacacccagttcgtggccagcgccctgcagctgagaagcttcctgagctgcccccagatctag

SEQ ID NO: 89609 - DNA, 351 bp, Artificial Sequence; identical to SEQ ID NO: 89608
  Description of Artificial Sequence: Synthetic coding sequence

SEQ ID NO: 89610 - DNA, 570 bp, Artificial Sequence; identical to SEQ ID NO: 89607
  Description of Artificial Sequence: Synthetic coding sequence

SEQ ID NO: 89611 - DNA, 2352 bp, Artificial Sequence
  Description of Artificial Sequence: Synthetic coding sequence
atgagagagctggtgaacatccccctggtgcacatcctgaccctggtggccttcagcggcaccgagaagctgcccaaggcccccgtgatcaccacccccctggagaccgtggacgccctggtggaggaggtggccaccttcatgtgcgccgtggagagctacccccagcccgagatcagctggaccagaaacaagatcctgatcaagctgttcgacaccagatacagcatcagagagaacggccagctgctgaccatcctgagcgtggaggacagcgacgacggcatctactgctgcaccgccaacaacggcgtgggcggcgccgtggagagctgcggcgccctgcaggtgaagatgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggaggaggagagcgagcccgagcaggacaccaaggtgttcgccagaatcctgagagcccccgagagccacaacgtgaccttcggcagcttcgtgaccctgcactgcaccgccaccggcatccccgtgcccaccatcacctggatcgagaacggcaacgccgtgagcagcggcagcatccaggagagcgtgaaggacagagtgatcgacagcagactgcagctgttcatcaccaagcccggcctgtacacctgcatcgccaccaacaagcacggcgagaagttcagcaccgccaaggccgccgccaccatcagcatcgccgacttcagagagtactgcctggccgtgaaggagctgttctgcgccaaggagtggctggtgatggaggagaagacccacagaggcctgtacagaagcgagatgcacctgctgagcgtgcccgagtgcagcaagctgcccagcatgcactgggaccccaccgcctgcgccagactgccccacctggccttcccccccatgaccagcagcaagcccagcgtggacatccccaacctgcccagcagcagcagcagcagcttcagcgtgagccccacctacagcatgaccgtgatcatcagcatcatgagcagcttcgccatcttcgtgctgctgaccatcaccaccctgtactgctgcagaagaagaaagcagtggaagaacaagaagagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcgtgtgcgccgtgggcaagcccatgtgcctgctgttcgagtacatggcctacggcgacctgaacgagttcctgagaagcatgagcccccacaccgtgtgcagcctgagccacagcgacctgagcatgagagcccaggtgagcagccccggccccccccccctgagctgcgccgagcagctgtgcatcgccagacaggtggccgccggcatggcctacctgagcgagagaaagttcgtgcacagagacctggccaccagaaactgcctggtgggcgagaacatggtggtgaagatcgccgacttcggcctgagcagaaacatctacagcgccgactactacaaggccaacgagaacgacgccatccccatcagatggatgccccccgagagcatcttctacaacagatacaccaccgagagcgacgtgtgggcctacggcgtggtgctgtgggagatcttcagctacggcctgcagccctactacggcatggcccacgaggaggtgatctactacgtgagagacggcaacatcctgagctgccccgagaactgccccgtggagctgtacaacctgatgagactgtgctggagcaagctgcccgccgacagacccagcttcaccagcatccacagaatcctggagagaatgtgcgagagagccgagggcaccgtgagcgtgtag

SEQ ID NO: 89612 - DNA, 2610 bp, Artificial Sequence
  Description of Artificial Sequence: Synthetic coding sequence
atgagagagctggtgaacatccccctggtgcacatcctgaccctggtggccttcagcggcaccgagaagctgcccaaggcccccgtgatcaccacccccctggagaccgtggacgccctggtggaggaggtggccaccttcatgtgcgccgtggagagctacccccagcccgagatcagctggaccagaaacaagatcctgatcaagctgttcgacaccagatacagcatcagagagaacggccagctgctgaccatcctgagcgtggaggacagcgacgacggcatctactgctgcaccgccaacaacggcgtgggcggcgccgtggagagctgcggcgccctgcaggtgaagatgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggaggtgttcgccagaatcctgagagcccccgagagccacaacgtgaccttcggcagcttcgtgaccctgcactgcaccgccaccggcatccccgtgcccaccatcacctggatcgagaacggcaacgccgtgagcagcggcagcatccaggagagcgtgaaggacagagtgatcgacagcagactgcagctgttcatcaccaagcccggcctgtacacctgcatcgccaccaacaagcacggcgagaagttcagcaccgccaaggccgccgccaccatcagcatcgccgagtggagcaagccccagaaggacaacaagggctactgcgcccagtacagaggcgaggtgtgcaacgccgtgctggccaaggacgccctggtgttcctgaacaccagctacgccgaccccgaggaggcccaggagctgctggtgcacaccgcctggaacgagctgaaggtggtgagccccgtgtgcagacccgccgccgaggccctgctgtgcaaccacatcttccaggagtgcagccccggcgtggtgcccacccccatccccatctgcagagagtactgcctggccgtgaaggagctgttctgcgccaaggagtggctggtgatggaggagaagacccacagaggcctgtacagaagcgagatgcacctgctgagcgtgcccgagtgcagcaagctgcccagcatgcactgggaccccaccgcctgcgccagactgccccacctggactacaacaaggagaacctgaagaccttcccccccatgaccagcagcaagcccagcgtggacatccccaacctgcccagcagcagcagcagcagcttcagcgtgagccccacctacagcatgaccgtgatcatcagcatcatgagcagcttcgccatcttcgtgctgctgaccatcaccaccctgtactgctgcagaagaagaaagcagtggaagaacaagaagagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcgtgtgcgccgtgggcaagcccatgtgcctgctgttcgagtacatggcctacggcgacctgaacgagttcctgagaagcatgagcccccacaccgtgtgcagcctgagccacagcgacctgagcatgagagcccaggtgagcagccccggccccccccccctgagctgcgccgagcagctgtgcatcgccagacaggtggccgccggcatggcctacctgagcgagagaaagttcgtgcacagagacctggccaccagaaactgcctggtgggcgagaacatggtggtgaagatcgccgacttcggcctgagcagaaacatctacagcgccgactactacaaggccaacgagaacgacgccatccccatcagatggatgccccccgagagcatcttctacaacagatacaccaccgagagcgacgtgtgggcctacggcgtggtgctgtgggagatcttcagctacggcctgcagccctactacggcatggcccacgaggaggtgatctactacgtgagagacggcaacatcctgagctgccccgagaactgccccgtggagctgtacaacctgatgagactgtgctggagcaagctgcccgccgacagacccagcttcaccagcatccacagaatcctggagagaatgtgcgagagagccgagggcaccgtgagcgtgtag

SEQ ID NO: 89613 - DNA, 2604 bp, Artificial Sequence
  Description of Artificial Sequence: Synthetic coding sequence
atgagagagctggtgaacatccccctggtgcacatcctgaccctggtggccttcagcggcaccgagaagctgcccaaggcccccgtgatcaccacccccctggagaccgtggacgccctggtggaggaggtggccaccttcatgtgcgccgtggagagctacccccagcccgagatcagctggaccagaaacaagatcctgatcaagctgttcgacaccagatacagcatcagagagaacggccagctgctgaccatcctgagcgtggaggacagcgacgacggcatctactgctgcaccgccaacaacggcgtgggcggcgccgtggagagctgcggcgccctgcaggtgaagatgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggaggtgttcgccagaatcctgagagcccccgagagccacaacgtgaccttcggcagcttcgtgaccctgcactgcaccgccaccggcatccccgtgcccaccatcacctggatcgagaacggcaacgccgtgagcagcggcagcatccaggagagcgtgaaggacagagtgatcgacagcagactgcagctgttcatcaccaagcccggcctgtacacctgcatcgccaccaacaagcacggcgagaagttcagcaccgccaaggccgccgccaccatcagcatcgccgagatgctgttcatcagcagcttcagcaagccccagaaggacaacaagggctactgcgcccagtacagaggcgaggtgtgcaacgccgtgctggccaaggacgccctggtgttcctgaacaccagctacgccgaccccgaggaggcccaggagctgctggtgcacaccgcctggaacgagctgaaggtggtgagccccgtgtgcagacccgccgccgaggccctgctgtgcaaccacatcttccaggagtgcagccccggcgtggtgcccacccccatccccatctgcagagagtactgcctggccgtgaaggagctgttctgcgccaaggagtggctggtgatggaggagaagacccacagaggcctgtacagaagcgagatgcacctgctgagcgtgcccgagtgcagcaagctgcccagcatgcactgggaccccaccgcctgcgccagactgccccacctggccttcccccccatgaccagcagcaagcccagcgtggacatccccaacctgcccagcagcagcagcagcagcttcagcgtgagccccacctacagcatgaccgtgatcatcagcatcatgagcagcttcgccatcttcgtgctgctgaccatcaccaccctgtactgctgcagaagaagaaagcagtggaagaacaagaagagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcgtgtgcgccgtgggcaagcccatgtgcctgctgttcgagtacatggcctacggcgacctgaacgagttcctgagaagcatgagcccccacaccgtgtgcagcctgagccacagcgacctgagcatgagagcccaggtgagcagccccggccccccccccctgagctgcgccgagcagctgtgcatcgccagacaggtggccgccggcatggcctacctgagcgagagaaagttcgtgcacagagacctggccaccagaaactgcctggtgggcgagaacatggtggtgaagatcgccgacttcggcctgagcagaaacatctacagcgccgactactacaaggccaacgagaacgacgccatccccatcagatggatgccccccgagagcatcttctacaacagatacaccaccgagagcgacgtgtgggcctacggcgtggtgctgtgggagatcttcagctacggcctgcagccctactacggcatggcccacgaggaggtgatctactacgtgagagacggcaacatcctgagctgccccgagaactgccccgtggagctgtacaacctgatgagactgtgctggagcaagctgcccgccgacagacccagcttcaccagcatccacagaatcctggagagaatgtgcgagagagccgagggcaccgtgagcgtgtag

SEQ ID NO: 89614 - DNA, 2610 bp, Artificial Sequence
  Description of Artificial Sequence: Synthetic coding sequence
atgagagagctggtgaacatccccctggtgcacatcctgaccctggtggccttcagcggcaccgagaagctgcccaaggcccccgtgatcaccacccccctggagaccgtggacgccctggtggaggaggtggccaccttcatgtgcgccgtggagagctacccccagcccgagatcagctggaccagaaacaagatcctgatcaagctgttcgacaccagatacagcatcagagagaacggccagctgctgaccatcctgagcgtggaggacagcgacgacggcatctactgctgcaccgccaacaacggcgtgggcggcgccgtggagagctgcggcgccctgcaggtgaagatgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggaggtgttcgccagaatcctgagagcccccgagagccacaacgtgaccttcggcagcttcgtgaccctgcactgcaccgccaccggcatccccgtgcccaccatcacctggatcgagaacggcaacgccgtgagcagcggcagcatccaggagagcgtgaaggacagagtgatcgacagcagactgcagctgttcatcaccaagcccggcctgtacacctgcatcgccaccaacaagcacggcgagaagttcagcaccgccaaggccgccgccaccatcagcatcgccgccttcagcaagccccagaaggacaacaagggctactgcgcccagtacagaggcgaggtgtgcaacgccgtgctggccaaggacgccctggtgttcctgaacaccagctacgccgaccccgaggaggcccaggagctgctggtgcacaccgcctggaacgagctgaaggtggtgagccccgtgtgcagacccgccgccgaggccctgctgtgcaaccacatcttccaggagtgcagccccggcgtggtgcccacccccatccccatctgcagagagtactgcctggccgtgaaggagctgttctgcgccaaggagtggctggtgatggaggagaagacccacagaggcctgtacagaagcgagatgcacctgctgagcgtgcccgagtgcagcaagctgcccagcatgcactgggaccccaccgcctgcgccagactgccccacctggactacaacaaggagaacctgaagaccttcccccccatgaccagcagcaagcccagcgtggacatccccaacctgcccagcagcagcagcagcagcttcagcgtgagccccacctacagcatgaccgtgatcatcagcatcatgagcagcttcgccatcttcgtgctgctgaccatcaccaccctgtactgctgcagaagaagaaagcagtggaagaacaagaagagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcgtgtgcgccgtgggcaagcccatgtgcctgctgttcgagtacatggcctacggcgacctgaacgagttcctgagaagcatgagcccccacaccgtgtgcagcctgagccacagcgacctgagcatgagagcccaggtgagcagccccggccccccccccctgagctgcgccgagcagctgtgcatcgccagacaggtggccgccggcatggcctacctgagcgagagaaagttcgtgcacagagacctggccaccagaaactgcctggtgggcgagaacatggtggtgaagatcgccgacttcggcctgagcagaaacatctacagcgccgactactacaaggccaacgagaacgacgccatccccatcagatggatgccccccgagagcatcttctacaacagatacaccaccgagagcgacgtgtgggcctacggcgtggtgctgtgggagatcttcagctacggcctgcagccctactacggcatggcccacgaggaggtgatctactacgtgagagacggcaacatcctgagctgccccgagaactgccccgtggagctgtacaacctgatgagactgtgctggagcaagctgcccgccgacagacccagcttcaccagcatccacagaatcctggagagaatgtgcgagagagccgagggcaccgtgagcgtgtag

SEQ ID NO: 89615 - DNA, 2352 bp, Artificial Sequence
  Description of Artificial Sequence: Synthetic coding sequence
atgagagagctggtgaacatccccctggtgcacatcctgaccctggtggccttcagcggcaccgagaagctgcccaaggcccccgtgatcaccacccccctggagaccgtggacgccctggtggaggaggtggccaccttcatgtgcgccgtggagagctacccccagcccgagatcagctggaccagaaacaagatcctgatcaagctgttcgacaccagatacagcatcagagagaacggccagctgctgaccatcctgagcgtggaggacagcgacgacggcatctactgctgcaccgccaacaacggcgtgggcggcgccgtggagagctgcggcgccctgcaggtgaagatgaagcccaagatcaccagaccccccatcaacgtgaagatcatcgagggcctgaaggccgtgctgccctgcaccaccatgggcaaccccaagcccagcgtgagctggatcaagggcgacagccccctgagagagaacagcagaatcgccgtgctggagagcggcagcctgagaatccacaacgtgcagaaggaggacgccggccagtacagatgcgtggccaagaacagcctgggcaccgcctacagcaaggtggtgaagctggaggtggaggaggagagcgagcccgagcaggacaccaaggtgttcgccagaatcctgagagcccccgagagccacaacgtgaccttcggcagcttcgtgaccctgcactgcaccgccaccggcatccccgtgcccaccatcacctggatcgagaacggcaacgccgtgagcagcggcagcatccaggagagcgtgaaggacagagtgatcgacagcagactgcagctgttcatcaccaagcccggcctgtacacctgcatcgccaccaacaagcacggcgagaagttcagcaccgccaaggccgccgccaccatcagcatcgccgcctggaagaagtactgcctggccgtgaaggagctgttctgcgccaaggagtggctggtgatggaggagaagacccacagaggcctgtacagaagcgagatgcacctgctgagcgtgcccgagtgcagcaagctgcccagcatgcactgggaccccaccgcctgcgccagactgccccacctggccttcccccccatgaccagcagcaagcccagcgtggacatccccaacctgcccagcagcagcagcagcagcttcagcgtgagccccacctacagcatgaccgtgatcatcagcatcatgagcagcttcgccatcttcgtgctgctgaccatcaccaccctgtactgctgcagaagaagaaagcagtggaagaacaagaagagagagagcgccgccgtgaccctgaccaccctgcccagcgagctgctgctggacagactgcaccccaaccccatgtaccagagaatgcccctgctgctgaaccccaagctgctgagcctggagtaccccagaaacaacatcgagtacgtgagagacatcggcgagggcgccttcggcagagtgttccaggccagagcccccggcctgctgccctacgagcccttcaccatggtggccgtgaagatgctgaaggaggaggccagcgccgacatgcaggccgacttccagagagaggccgccctgatggccgagttcgacaaccccaacatcgtgaagctgctgggcgtgtgcgccgtgggcaagcccatgtgcctgctgttcgagtacatggcctacggcgacctgaacgagttcctgagaagcatgagcccccacaccgtgtgcagcctgagccacagcgacctgagcatgagagcccaggtgagcagccccggccccccccccctgagctgcgccgagcagctgtgcatcgccagacaggtggccgccggcatggcctacctgagcgagagaaagttcgtgcacagagacctggccaccagaaactgcctggtgggcgagaacatggtggtgaagatcgccgacttcggcctgagcagaaacatctacagcgccgactactacaaggccaacgagaacgacgccatccccatcagatggatgccccccgagagcatcttctacaacagatacaccaccgagagcgacgtgtgggcctacggcgtggtgctgtgggagatcttcagctacggcctgcagccctactacggcatggcccacgaggaggtgatctactacgtgagagacggcaacatcctgagctgccccgagaactgccccgtggagctgtacaacctgatgagactgtgctggagcaagctgcccgccgacagacccagcttcaccagcatccacagaatcctggagagaatgtgcgagagagccgagggcaccgtgagcgtgtag

SEQ ID NO: 89616 - DNA, 1167 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtgcccatgttcagcgtggcccccagcctggccaccaacgccagcgccgccgccttcaacccctacctgggccccgtgagccccagcctggtgcccgccgagatcctgcccaccgcccccatgctggtgaccggcaaccccggcgtgcccgtgcccgccgccgccgccgccgccgcccagaagctgatgagaaccgacagactggaggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgacccagagcgccgtgaagagcctgaagagacccctggaggccaccttcgacctgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccgtgcccatggtgcacggcgccacccccgccaccgtgagcgccgccaccaccagcgccaccagcgtgcccttcgccgccaccgccaccgccaaccagatccccatcatcagcgccgagcacctgaccagccacaagtacgtgacccagatgtag

SEQ ID NO: 89617 - DNA, 909 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccgtgcccatggtgcacggcgccacccccgccaccgtgagcgccgccaccaccagcgccaccagcgtgcccttcgccgccaccgccaccgccaaccagatccccatcatcagcgccgagcacctgaccagccacaagtacgtgacccagatgtag

SEQ ID NO: 89618 - DNA, 1023 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtgcccatgttcagcgtggcccccagcctggccaccaacgccagcgccgccgccttcaacccctacctgggccccgtgagccccagcctggtgcccgccgagatcctgcccaccgcccccatgctggtgaccggcaaccccggcgtgcccgtgcccgccgccgccgccgccgccgcccagaagctgatgagaaccgacagactggaggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgttcccctggtgcaccgtgctgagacagcccctgtgcccccagcagcagcacctgccccaggtgttccccagcctgcagcagccccagcccaccagccccatcctggacgccagcaccctgctgggcgccaccagctgccccgccgccgccggcaagatgatccccatcatcagcgccgagcacctgaccagccacaagtacgtgacccagatgtag

SEQ ID NO: 89619 - DNA, 1149 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtgcccatgttcagcgtggcccccagcctggccaccaacgccagcgccgccgccttcaacccctacctgggccccgtgagccccagcctggtgcccgccgagatcctgcccaccgcccccatgctggtgaccggcaaccccggcgtgcccgtgcccgccgccgccgccgccgccgcccagaagctgatgagaaccgacagactggaggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccggcagcatcctgtgcatgacccccgccaccagcgtggtgcccatggtgcacggcgccacccccgccaccgtgagcgccgccaccaccagcgccaccagcgtgcccttcgccgccaccgccaccgccaaccagatccccatcatcagcgccgagcacctgaccagccacaagtacgtgacccagatgtag

SEQ ID NO: 89620 - DNA, 1113 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtgcccatgttcagcgtggcccccagcctggccaccaacgccagcgccgccgccttcaacccctacctgggccccgtgagccccagcctggtgcccgccgagatcctgcccaccgcccccatgctggtgaccggcaaccccggcgtgcccgtgcccgccgccgccgccgccgccgcccagaagctgatgagaaccgacagactggaggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccgtgcccatggtgcacggcgccacccccgccaccgtgagcgccgccaccaccagcgccaccagcgtgcccttcgccgccaccgccaccgccaaccagatccccatcatcagcgccgagcacctgaccagccacaagtacgtgacccagatgtag

SEQ ID NO: 89621 - DNA, 1029 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtgcccatgttcagcgtggcccccagcctggccaccaacgccagcgccgccgccttcaacccctacctgggccccgtgagccccagcctggtgcccgccgagatcctgcccaccgcccccatgctggtgaccggcaaccccggcgtgcccgtgcccgccgccgccgccgccgccgcccagaagctgatgagaaccgacagactggaggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccggcagcatcctgtgcatgacccccgccaccagcgtggacacccacaacatctgcagaaccagcgactag

SEQ ID NO: 89622 - DNA, 1167 bp, Artificial Sequence; identical to SEQ ID NO: 89616
  Description of Artificial Sequence: Synthetic coding sequence

SEQ ID NO: 89623 - DNA, 1023 bp, Artificial Sequence; identical to SEQ ID NO: 89618
  Description of Artificial Sequence: Synthetic coding sequence

SEQ ID NO: 89624 - DNA, 909 bp, Artificial Sequence; identical to SEQ ID NO: 89617
  Description of Artificial Sequence: Synthetic coding sequence

SEQ ID NO: 89625 - DNA, 1029 bp, Artificial Sequence; identical to SEQ ID NO: 89621
  Description of Artificial Sequence: Synthetic coding sequence

SEQ ID NO: 89626 - DNA, 1032 bp, Artificial Sequence
  Description of Artificial Sequence: Synthetic coding sequence
atgggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtgcccatgttcagcgtggcccccagcctggccaccaacgccagcgccgccgccttcaacccctacctgggccccgtgagccccagcctggtgcccgccgagatcctgcccaccgcccccatgctggtgaccggcaaccccggcgtgcccgtgcccgccgccgccgccgccgccgcccagaagctgatgagaaccgacagactggaggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgacccagagcgccgtgaagagcctgaagagacccctggaggccaccttcgacctgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccggcagcatcctgtgcatgacccccgccaccagcgtggtgcccatggtgcacggcgccacccccgccaccgtgagcgccgccaccaccagcgccaccagcgtgcccttcgccgccaccgccaccgccaaccagatccccatcatcagcgccgagcacctgaccagccacaagtacgtgacccagatgtag

SEQ ID NO: 89627 - DNA, 945 bp, Artificial Sequence
  Description of Artificial Sequence: Synthetic coding sequence
atggccgtgagcgtgacccccatcagagacaccaagtggctgaccctggaggtgtgcagagagttccagagaggcacctgcagcagacccgacaccgagtgcaagttcgcccaccccagcaagagctgccaggtggagaacggcagagtgatcgcctgcttcgacagcctgaagggcagatgcagcagagagaactgcaagtacctgcacccccccccccacctgaagacccagctggagatcaacggcagaaacaacctgatccagcagaagaacatggccatgctggcccagcagatgcagctggccaacgccatgatgcccggcgcccccctgcagcccgtggtgtgcagagagtaccagagaggcaactgcaacagaggcgagaacgactgcagattcgcccaccccgccgacagcaccatgatcgacaccaacgacaacaccgtgaccgtgtgcatggactacatcaagggcagatgcagcagagagaagtgcaagtacttccacccccccgcccacctgcaggccaagatcaaggccgcccagtaccaggtgaaccaggccgccgccgcccaggccgccgccaccgccgccgccatgggcatcccccaggccgtgctgccccccctgcccaagagacccgccctggagaagaccaacggcgccaccgccgtgttcaacaccggcatcttccagtaccagcaggccctggccaacatgcagctgcagcagcacaccgccttcctgccccccggcagcatcctgtgcatgacccccgccaccagcgtggtgcccatggtgcacggcgccacccccgccaccgtgagcgccgccaccaccagcgccaccagcgtgcccttcgccgccaccgccaccgccaaccagatccccatcatcagcgccgagcacctgaccagccacaagtacgtgacccagatgtag

SEQ ID NO: 89628 - DNA, 1005 bp, Artificial Sequence
  Description of Artificial Sequence: Synthetic coding sequence
atgaccgccgtgaacgtggccctgatcagagacaccaagtggctgaccctggaggtgtgcagagagttccagagaggcacctgcagcagagccgacgccgactgcaagttcgcccacccccccagagtgtgccacgtggagaacggcagagtggtggcctgcttcgacagcctgaagggcagatgcaccagagagaactgcaagtacctgcacccccccccccacctgaagacccagctggagatcaacggcagaaacaacctgatccagcagaagaccgccgccgccatgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgaccaacctgcagctgccccagcccgccttcatccccgccggccccatcctgtgcatggcccccgccagcaacatcgtgcccatgatgcacggcgccacccccaccaccgtgagcgccgccaccacccccgccaccagcgtgcccttcgccgcccccaccaccggcaaccagatcccccagctgagcatcgacgagctgaacagcagcatgttcgtgagccagatgtag

SEQ ID NO: 89629 - DNA, 777 bp, Artificial Sequence
  Description of Artificial Sequence: Synthetic coding sequence
atgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccggccccatcctgtgcatggcccccgccagcaacatcgtgcccatgatgcacggcgccacccccaccaccgtgagcgccgccaccacccccgccaccagcgtgcccttcgccgcccccaccaccggcaaccagctgaagttctag

SEQ ID NO: 89630 - DNA, 915 bp, Artificial Sequence
  Description of Artificial Sequence: Synthetic coding sequence
atggagagagccagcaagaacctgaagggcagatgcaccagagagaactgcaagtacctgcacccccccccccacctgaagacccagctggagatcaacggcagaaacaacctgatccagcagaagaccgccgccgccatgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccggccccatcctgtgcatggcccccgccagcaacatcgtgcccatgatgcacggcgccacccccaccaccgtgagcgccgccaccacccccgccaccagcgtgcccttcgccgcccccaccaccggcaaccagctgaagttctag

SEQ ID NO: 89631 - DNA, 1065 bp, Artificial Sequence
  Description of Artificial Sequence: Synthetic coding sequence
atgaccgccgtgaacgtggccctgatcagagacaccaagtggctgaccctggaggtgtgcagagagttccagagaggcacctgcagcagagccgacgccgactgcaagttcgcccacccccccagagtgtgccacgtggagaacggcagagtggtggcctgcttcgacagcctgaagggcagatgcaccagagagaactgcaagtacctgcacccccccccccacctgaagacccagctggagatcaacggcagaaacaacctgatccagcagaagaccgccgccgccatgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccggccccatcctgtgcatggcccccgccagcaacatcgtgcccatgatgcacggcgccacccccaccaccgtgagcgccgccaccacccccgccaccagcgtgcccttcgccgcccccaccaccggcaaccagctgaagttctag

SEQ ID NO: 89632 - DNA, 1029 bp, Artificial Sequence
  Description of Artificial Sequence: Synthetic coding sequence
atgaccgccgtgaacgtggccctgatcagagacaccaagtggctgaccctggaggtgtgcagagagttccagagaggcacctgcagcagagccgacgccgactgcaagttcgcccacccccccagagtgtgccacgtggagaacggcagagtggtggcctgcttcgacagcctgaagggcagatgcaccagagagaactgcaagtacctgcacccccccccccacctgaagacccagctggagatcaacggcagaaacaacctgatccagcagaagaccgccgccgccatgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccgtgcccatgatgcacggcgccacccccaccaccgtgagcgccgccaccacccccgccaccagcgtgcccttcgccgcccccaccaccggcaaccagctgaagttctag

SEQ ID NO: 89633 - DNA, 777 bp, Artificial Sequence; identical to SEQ ID NO: 89629
  Description of Artificial Sequence: Synthetic coding sequence

SEQ ID NO: 89634 - DNA, 672 bp, Artificial Sequence
  Description of Artificial Sequence: Synthetic coding sequence
atgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccggccccatcctgtgcatggcccccgccagcaacatctag

SEQ ID NO: 89635 - DNA, 729 bp, Artificial Sequence
  Description of Artificial Sequence: Synthetic coding sequence
atgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccggccccatcctgtgcatggcccccgccagcaacatcgtgcccatgatgcacggcgccacccccaccaccgtgagcgccgccaccacccccgcctag

SEQ ID NO: 89636 - DNA, 453 bp, Artificial Sequence
  Description of Artificial Sequence: Synthetic coding sequence
atcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccggccccatcctgtgcatggcccccgccagcaacatcgtgcccatgatgcacggcgccacccccaccaccgtgagcgccgccaccacccccgccaccagcgtgcccttcgccgcccccaccaccggcaaccagatcccccagctgagcatcgacgagctgaacagcagcatgttcgtgagccagatgtag

SEQ ID NO: 89637 - DNA, 879 bp, Artificial Sequence
  Description of Artificial Sequence: Synthetic coding sequence
atggagagagccagcaagaacctgaagggcagatgcaccagagagaactgcaagtacctgcacccccccccccacctgaagacccagctggagatcaacggcagaaacaacctgatccagcagaagaccgccgccgccatgttcgcccagcagatgcagctgatgctgcagaacgcccagatgagcagcctgggcagcttccccatgacccccagcatccccgccaacccccccatggccttcaacccctacatcccccaccccggcatgggcctggtgcccgccgagctggtgcccaacacccccgtgctgatccccggcaacccccccctggccatgcccggcgccgtgggccccaagctgatgagaagcgacaagctggaggtgtgcagagagttccagagaggcaactgcaccagaggcgagaacgactgcagatacgcccaccccaccgacgccagcatgatcgaggccagcgacaacaccgtgaccatctgcatggactacatcaagggcagatgcagcagagagaagtgcaagtacttccacccccccgcccacctgcaggccagactgaaggccgcccaccaccagatgaaccacagcgccgccagcgccatggccctgcagcccggcaccctgcagctgatccccaagagaagcgccctggagaagcccaacggcgccacccccgtgttcaaccccaccgtgttccactgccagcaggccctgaccaacctgcagctgccccagcccgccttcatccccgccgtgcccatgatgcacggcgccacccccaccaccgtgagcgccgccaccacccccgccaccagcgtgcccttcgccgcccccaccaccggcaaccagctgaagttctag

SEQ ID NO: 89638 - DNA, 1377 bp, Artificial Sequence
  Description of Artificial Sequence: Synthetic coding sequence
atggagctggagaagagagagaagagaagcctgctgaacaagaacctggaggagaagctgaccgtgagcgccggcggcagcgaggccaagcccctgatcttcaccttcgtgcccaccgtgagaagactgcccacccacacccagctggccgacaccagcaagttcctggtgaagatccccgaggagagcagcgacaagagccccgagaccgtgaacagaagcaagagcaacgactacctgaccctgaacgccggcagccagcaggagagagaccaggccaagctgacctgccccagcgaggtgagcggcaccatcctgcaggagagagagttcgaggccaacaagctgcagggcatgcagcagagcgacctgttcaaggccgagtacgtgctgatcgtggacagcgagggcgaggacgaggccgccagcagaaaggtggagcagggcccccccggcggcatcggcaccgccgccgtgagacccaagagcctggccatcagcagcagcctggtgagcgacgtggtgagacccaagacccagggcaccgacctgaagaccagcagccaccccgagatgctgcacggcatggccccccagcagaagcacggccagcagtacaagaccaagagcagctacaaggccttcgccgccatccccaccaacaccctgctgctggagcagaaggccctggacgagcccgccaagaccgagagcgtgagcaaggacaacaccctggagccccccgtggagctgtacttccccgcccagctgagacagcagaccgaggagctgtgcgccaccatcgacaaggtgctgcaggacagcctgagcatgcacagcagcgacagccccagcagaagccccaagaccctgctgggcagcgacaccgtgaagacccccaccaccctgcccagagccgccggcagagagaccaagtacgccaacctgagcagccccagcagcaccgtgagcgagagccagctgaccaagcccggcgtgatcagacccgtgcccgtgaagagcagaatcctgctgaagaaggaggaggaggtgtacgagcccaaccccttcagcaagtacctggaggacaacagcgacctgttcagcgagcaggacgtgaccgtgccccccaagcccgtgagcctgcaccccctgtaccagaccaagctgtacccccccgccaagagcctgctgcacccccagaccctgagccacgccgactgcctggcccccggccccttcagccacctgagcttcagcctgagcgacgagcaggagaacagccacaccctgctgagccacaacgcctgcaacaagctgagccaccccatggtggccatccccgagcacgaggccctggacagcaaggagcagtag

SEQ ID NO: 89639 - DNA, 873 bp, Artificial Sequence
  Description of Artificial Sequence: Synthetic coding sequence
atgaccagctgcatcctgagcggcagcatccagaccaccccccaggtgagcgccggcggcagcgaggccaagcccctgatcttcaccttcgtgcccaccgtgagaagactgcccacccacacccagctggccgacaccagcaagttcctggtgaagatccccgaggagagcagcgacaagagccccgagaccgtgaacagaagcaagagcaacgactacctgaccctgaacgccggcagccagcaggagagagaccaggccaagctgacctgccccagcgaggtgagcggcaccatcctgcaggagagagagttcgaggccaacaagctgcagggcatgcagcagagcgacctgttcaaggccgagtacgtgctgatcgtggacagcgagggcgaggacgaggccgccagcagaaaggtggagcagggcccccccggcggcatcggcaccgccgccgtgagacccaagagcctggccatcagcagcagcctggtgagcgacgtggtgagacccaagacccagggcaccgacctgaagaccagcagccaccccgagatgctgcacggcatggccccccagcagaagcacggccagacccccaccaccctgcccagagccgccggcagagagaccaagtacgccaacctgagcagccccagcagcaccgtgagcgagagccagctgaccaagcccggcgtgatcagacccgtgcccgtgaagagcagaatcctgctgaagaaggaggaggaggtgtacgagcccaaccccttcagcaagtacctggaggacaacagcgacctgttcagcgagcagctgagccaccccatggtggccatccccgagcacgaggccctggacagcaaggagcagtag

SEQ ID NO: 89640 - DNA, 705 bp, Artificial Sequence
  Description of Artificial Sequence: Synthetic coding sequence
atgtgcagctggtacctgggcttcgagtgcagcagcaagagcaacgactacctgaccctgaacgccggcagccagcaggagagagaccaggccaagctgacctgccccagcgaggtgagcggcaccatcctgcaggagagagagttcgaggccaacaagctgcagggcatgcagcagagcgacctgttcaaggccgagtacgtgctgatcgtggacagcgagggcgaggacgaggccgccagcagaaaggtggagcagggcccccccggcggcatcggcaccgccgccgtgagacccaagagcctggccatcagcagcagcctggtgagcgacgtggtgagacccaagacccagggcaccgacctgaagaccagcagccaccccgagatgctgcacggcatggccccccagcagaagcacggccagacccccaccaccctgcccagagccgccggcagagagaccaagtacgccaacctgagcagccccagcagcaccgtgagcgagagccagctgaccaagcccggcgtgatcagacccgtgcccgtgaagagcagaatcctgctgaagaaggaggaggaggtgtacgagcccaaccccttcagcaagtacctggaggacaacagcgacctgttcagcgagcagctgagccaccccatggtggccatccccgagcacgaggccctggacagcaaggagcagtag

SEQ ID NO: 89641 - DNA, 489 bp, Artificial Sequence
  Description of Artificial Sequence: Synthetic coding sequence
atgcagcagagcgacctgttcaaggccgagtacgtgctgatcgtggacagcgagggcgaggacgaggccgccagcagaaaggtggagcagggcccccccggcggcatcggcaccgccgccgtgagacccaagagcctggccatcagcagcagcctggtgagcgacgtggtgagacccaagacccagggcaccgacctgaagaccagcagccaccccgagatgctgcacggcatggccccccagcagaagcacggccagcagtacaagaccaagagcagctacaaggccttcgccgccatccccaccaacaccctgctgctggagcagaaggccctggacgagcccgccaagaccgagagcgtgagcaaggacaacaccctggagccccccgtggagacccccaccaccctgcccagagccgccggcagagagaccaagtacgccaacctgagcagccccagcagcaccgtgagcgagagccagctgtag

SEQ ID NO: 89642 - DNA, 2208 bp, Artificial Sequence
  Description of Artificial Sequence: Synthetic coding sequence
atggccgccggcggcgccgtggccgccgcccccgagtgcagactgctgccctacgccctgcacaagtggagcagcttcagcagcacctacctgcccgagaacatcctggtggacaagcccaacgaccagagcagcagatggagcagcgagagcaactaccccccccagtacctgatcctgaagctggagagacccgccatcgtgcagaacatcaccttcggcaagtacgagaagacccacgtgtgcaacctgaagaagttcaaggtgttcggcggcatgaacgaggagaacatgaccgagctgctgagcagcggcctgaagaacgactacaacaaggagaccttcaccctgaagcacaagatcgacgagcagatgttcccctgcagattcatcaagatcgtgcccctgctgagctggggccccagcttcaacttcagcatctggtacgtggagctgagcggcatcgacgaccccgacatcgtgcagccctgcctgaactggtacagcaagtacagagagcaggaggccatcagactgtgcctgaagcacttcagacagcacaactacaccgaggccttcgagagcctgcagaagaagaccaagatcgccctggagcaccccatgctgaccgacatccacgacaagctggtgctgaagggcgacttcgacgcctgcgaggagctgatcgagaaggccgtgaacgacggcctgttcaaccagtacatcagccagcaggagtacaagcccagatggagccagatcatccccaagagcaccaagggcgacggcgaggacaacagacccggcatgagaggcggccaccagatggtgatcgacgtgcagaccgagaccgtgtacctgttcggcggctgggacggcacccaggacctggccgacttctgggcctacagcgtgaaggagaaccagtggacctgcatcagcagagacaccgagaaggagaacggccccagcgccagaagctgccacaagatgtgcatcgacatccagagaagacagatctacaccctgggcagatacctggacagcagcgtgagaaacagcaagagcctgaagagcgacttctacagatacgacatcgacaccaacacctggatgctgctgagcgaggacaccgccgccgacggcggccccaagctggtgttcgaccaccagatgtgcatggacagcgagaagcacatgatctacaccttcggcggcagaatcctgacctgcaacggcagcgtggacgacagcagagccagcgagccccagttcagcggcctgttcgccttcaactgccagtgccagacctggaagctgctgagagaggacagctgcaacgccggccccgaggacatccagagcagaatcggccactgcatgctgttccacagcaagaacagatgcctgtacgtgttcggcggccagagaagcaagacctacctgaacgacttcttcagctacgacgtggacagcgaccacgtggacatcatcagcgacggcaccaagaaggacagcggcatggtgcccatgaccggcttcacccagagagccaccatcgaccccgagctgaacgagatccacgtgctgagcggcctgagcaaggacaaggagaagagagaggagaacgtgagaaacagcttctggatctacgacatcgtgagaaacagctggagctgcgtgtacaagaacgaccaggccgccaaggacaaccccaccaagagcctgcaggaggaggagccctgccccagattcgcccaccagctggtgtacgacgagctgcacaaggtgcactacctgttcggcggcaaccccggcaagagctgcagccccaagatgagactggacgacttctggagcctgaagctgtgcagacccagcaaggactacctgctgagacactgcaagtacctgatcagaaagcacagattcgaggagaaggcccaggtggaccccctgagcgccctgaagtacctgcagaacgacctgtacatcaccgtggaccacagcgaccccgaggagaccaaggagttccagctgctggccagcgccctgttcaagagcggcagcgacttcaccgccctgggcttcagcgacgtggaccacacctacgcccagagaacccagctgttcgacaccctggtgaacttcttccccgacagcatgaccccccccaagggcaacctggtggacctgatcaccctgtag

SEQ ID NO: 89643 - DNA, 558 bp, Artificial Sequence
  Description of Artificial Sequence: Synthetic coding sequence
atgaccggcttcacccagagagccaccatcgaccccgagctgaacgagatccacgtgctgagcggcctgagcaaggacaaggagaagagagaggagaacgtgagaaacagcttctggatctacgacatcgtgagaaacagctggagctgcgtgtacaagaacgaccaggccgccaaggacaaccccaccaagagcctgcaggaggaggagccctgccccagattcgcccaccagctggtgtacgacgagctgcacaaggtgcactacctgttcggcggcaaccccggcaagagctgcagccccaagatgagactggacgacttctggagcctgaagctgtgcagacccagcaaggactacctgctgagacactgcaagtacctgatcagaaagcacagattcgaggagaaggcccaggtggaccccctgagcgccctgaagtacctgcagaacgacctgtacatcaccgtggaccacagcgaccccgaggagaccaaggaggccttcctgatgtggatcacccccatgctgaaggagctgagcagcctgaccccctag

SEQ ID NO: 89644 - DNA, 3060 bp, Artificial Sequence
  Description of Artificial Sequence: Synthetic coding sequence
atgatggccgccgccgccgccgccgccgccggcagcagcagcagcggcggcggcggcggcggcagcggcagcagcagcagcagcagcgacaccagcagcaccggcgaggaggagagaatgagaagactgttccagacctgcgacggcgacggcgacggctacatcagcagaaacgacctgctgatggtgtgcagacagctgaacatggaggagagcgtggccgagatcatgaaccagctgggcgccgacgagaacggcaagatcagcttccaggacttcaccagatgcagaatgcagctggtgagagagatcagaaaggaggaggtggacctgagcgccaagagcgacaacagctgcaccaagaagctgagagacagaatcgccagctggcccaccagcagcgacaacagcctgggcgccctgagcgccgccagagagagctgggagtacgacagcggcgccagagacctgcagagccccgacgtgcagagccagagcgccctgcagaagctgctggagtacggcggcagcagcctgcaccagcaggccgccctgcacaagctgctgacccagagcccccacatcggcaacagcgtgggcggcagctacctggagctggccaacaccctgcacagcgccgccctggccagcctgaagggcgacatcgtggagctgaacaagagactgcagcagaccgagagagagagagacctgctggagaagaagctggccaaggcccagtgcgagcagagccacctgatgagagagcacgaggacgtgcaggagagaaccaccctgagatacgaggagagaatcaccgagctgcacagcgtgatcgccgagctgaacaagaagatcgacagactgcagggcaccaccatcagagaggaggacgagtacagcgagctgagaagcgagctgagccagagccagcacgaggtgaacgaggacagcagaagcatggaccaggaccagaccagcgtgagcatccccgagaaccagagcaccatggtgaccgccgacatggacaactgcagcgacctgaacagcgagctgcagagagtgctgaccggcctggagaacgtggtgtgcggcagaaagaagagcagctgcagcctgagcgtggccgaggtggacaagcacatcgagcagctgaccaccgccagcgagcactgcgacctggccatcaagaccgtggaggagatcgagggcgtgctgggcagagacctgtaccccaacctggccgaggagagaagcagatgggagaaggagctggccggcctgagagaggagaacgagagcctgaccgccatgctgtgcagcaaggaggaggagctgaacagaaccaaggccaccatgaacgccatcagagaggagagagacagactgagaagaagagtgagagagctgcagaccagactgcagagcgtgcaggccaccggccccagcagccccggcagactgaccagcaccaacagacccatcaaccccagcaccggcgagctgagcaccagcagcagcagcaacgacatccccatcgccaagatcgccgagagagtgaagctgagcaagaccagaagcgagagcagcagcagcgacagacccgtgctgggcagcgagatcagcagcatcggcgtgagcagcagcgtggccgagcacctggcccacagcctgcaggactgcagcaacatccaggagatcttccagaccctgtacagccacggcagcgccatcagcgagagcaagatcagagagttcgaggtggagaccgagagactgaacagcagaatcgagcacctgaagagccagaacgacctgctgaccatcaccctggaggagtgcaagagcaacgccgagagaatgagcatgctggtgggcaagtacgagagcaacgccaccgccctgagactggccctgcagtacagcgagcagtgcatcgaggcctacgagctgctgctggccctggccgagagcgagcagagcctgatcctgggccagttcagagccgccggcgtgggcagcagccccggcgaccagagcggcgacgagaacatcacccagatgctgaagagagcccacgactgcagaaagaccgccgagaacgccgccaaggccctgctgatgaagctggacggcagctgcggcggcgccttcgccgtggccggctgcagcgtgcagccctgggagagcctgagcagcaacagccacaccagcaccaccagcagcaccgccagcagctgcgacaccgagttcaccaaggaggacgagcagagactgaaggactacatccagcagctgaagaacgacagagccgccgtgaagctgaccatgctggagctggagagcatccacatcgaccccctgagctacgacgtgaagcccagaggcgacagccagagactggacctggagaacgccgtgctgatgcaggagctgatggccatgaaggaggagatggccgagctgaaggcccagctgtacctgctggagaaggagaagaaggccctggagctgaagctgagcaccagagaggcccaggagcaggcctacctggtgcacatcgagcacctgaagagcgaggtggaggagcagaaggagcagagaatgagaagcctgagcagcaccagcagcggcagcaaggacaagcccggcaaggagtgcgccgacgccgccagccccgccctgagcctggccgagctgagaaccacctgcagcgagaacgagctggccgccgagttcaccaacgccatcagaagagagaagaagctgaaggccagagtgcaggagctggtgagcgccctggagagactgaccaagagcagcgagatcagacaccagcagagcgccgagttcgtgaacgacctgaagagagccaacagcaacctggtggccgcctacgagaaggccaagaagaagcaccagaacaagctgaagaagctggagagccagatgatggccatggtggagagacacgagacccaggtgagaatgctgaagcagagaatcgccctgctggaggaggagaacagcagaccccacaccaacgagaccagcctgtag

SEQ ID NO: 89645 - DNA, 564 bp, Artificial Sequence
  Description of Artificial Sequence: Synthetic coding sequence
atgagcggcggcggcaccgagacccccgtgggctgcgaggccgcccccggcggcggcagcaagaagagagacagcctgggcaccgccggcagcgcccacctgatcatcaaggacctgggcgagatccacagcagactgctggaccacagacccgtgatccagggcgagaccagatacttcgtgaaggagttcgaggagaagagaggcctgagagagatgagagtgctggagaacctgaagaacatgatccacgagaccaacgagcacaccctgcccaagtgcagagacaccatgagagacagcctgagccaggtgctgcagagactgcaggccgccaacgacagcgtgtgcagactgcagcagagagagcaggagagaaagaagatccacagcgaccacctggtggccagcgagaagcagcacatgctgcagtgggacaacttcatgaaggagcagcccaacaagagagccgaggtggacgaggagcacagaaaggccatggagagactgaaggagcagtacgccgagatggagaaggacctggccaagttcagcaccttctag

SEQ ID NO: 89646 - DNA, 372 bp, Artificial Sequence
  Description of Artificial Sequence: Synthetic coding sequence
atggagaagagaggcctgagagagatgagagtgctggagaacctgaagaacatgatccacgagaccaacgagcacaccctgcccaagtgcagagacaccatgagagacagcctgagccaggtgctgcagagactgcaggccgccaacgacagcgtgtgcagactgcagcagagagagcaggagagaaagaagatccacagcgaccacctggtggccagcgagaagcagcacatgctgcagtgggacaacttcatgaaggagcagcccaacaagagagccgaggtggacgaggagcacagaaaggccatggagagactgaaggagcagtacgccgagatggagaaggacctggccaagttcagcaccttctag

SEQ ID NO: 89647 - DNA, 3987 bp, Artificial Sequence
  Description of Artificial Sequence: Synthetic coding sequence
atggagagcagagaccccgcccagcccatgagccccggcgaggccacccagagcggcgccagacccgccgacagatacggcctgctgaagcacagcagagagttcctggacttcttctgggacatcgccaagcccgagcaggagaccagactggccgccaccgagaagctgctggagtacctgagaggcagacccaagggcagcgagatgaagtacgccctgaagagactgatcaccggcctgggcgtgggcagagagaccgccagaccctgctacagcctggccctggcccagctgctgcagagcttcgaggacctgcccctgtgcagcatcctgcagcagatccaggagaagtacgacctgcaccaggtgaagaaggccatgctgagacccgccctgttcgccaacctgttcggcgtgctggccctgttccagagcggcagactggtgaaggaccaggaggccctgatgaagagcgtgaagctgctgcaggccctggcccagtaccagaaccacctgcaggagcagcccagaaaggccctggtggacatcctgagcgaggtgagcaaggccaccctgcaggagatcctgcccgaggtgctgaaggccgacctgaacatcatcctgagcagccccgagcagctggagctgttcctgctggcccagcagaaggtgcccagcaagctgaagaagctggtgggcagcgtgaacctgttcagcgacgagaacgtgcccagactggtgaacgtgctgaagatggccgccagcagcgtgaagaaggacagaaagctgcccgccatcgccctggacctgctgagactggccctgaaggaggacaagttccccagattctggaaggaggtggtggagcagggcctgctgaagatgcagttctggcccgccagctacctgtgcttcagactgctgggcgccgccctgcccctgctgaccaaggagcagctgcacctggtgatgcagggcgacgtgatcagacactacggcgagcacgtgtgcaccgccaagctgcccaagcagttcaagttcgcccccgagatggacgactacgtgggcaccttcctggagggctgccaggacgaccccgagagacagctggccgtgctggtggccttcagcagcgtgaccaaccagggcctgcccgtgacccccaccttctggagagtggtgagattcctgagcccccccgccctgcagggctacgtggcctggctgagagccatgttcctgcagcccgacctggacagcctggtggacttcagcaccaacaaccagaagaaggcccaggacagcagcctgcacatgcccgagagagccgtgttcagactgagaaagtggatcatcttcagactggtgagcatcgtggacagcctgcacctggagatggaggaggccctgaccgagcaggtggccagattctgcctgttccacagcttcttcgtgaccaagaagcccaccagccagatccccgagaccaagcaccccttcagcttccccctggagaaccaggccagagaggccgtgagcagcgccttcttcagcctgctgcagaccctgagcacccagttcaagcaggcccccggccagacccagggcggccagccctggacctaccacctggtgcagttcgccgacctgctgctgaaccacagccacaacgtgaccaccgtgacccccttcaccgcccagcagagacaggcctgggacagaatgctgcagaccctgaaggagctggaggcccacagcgccgaggccagagccgccgccttccagcacctgctgctgctggtgggcatccacctgctgaagagccccgccgagagctgcgacctgctgggcgacatccagacctgcatcagaaagagcctgggcgagaagcccagaagaagcagaaccaagaccatcgacccccaggagcccccctgggtggaggtgctggtggagatcctgctggccctgctggcccagcccagccacctgatgagacaggtggccagaagcgtgttcggccacatctgcagccacctgacccccagagccctgcagctgatcctggacgtgctgaaccccgagaccagcgaggacgagaacgacagagtggtggtgaccgacgacagcgacgagagaagactgaagggcgccgaggacaagagcgaggagggcgaggacaacagaagcagcgagagcgaggaggagagcgagggcgaggagagcgaggaggaggagagagacggcgacgtggaccagggcttcagagagcagctgatgaccgtgctgcaggccggcaaggccctgggcggcgaggacagcgagaacgaggaggagctgggcgacgaggccatgatggccctggaccagagcctggccagcctgttcgccgagcagaagctgagaatccaggccagaagagacgagaagaacaagctgcagaaggagaaggccctgagaagagacttccagatcagagtgctggacctggtggaggtgctggtgaccaagcagcccgagaacgccctggtgctggagctgctggagcccctgctgagcatcatcagaagaagcctgagaagcagcagcagcaagcaggagcaggacctgctgcacaagaccgccagaatcttcacccaccacctgtgcagagccagaagatactgccacgacctgggcgagagagccggcgccctgcacgcccaggtggagagactggtgcagcaggccggcagacagcccgacagccccaccgccctgtaccacttcaacgccagcctgtacctgctgagagtgctgaagggcaacaccgccgagggctgcgtgcacgagacccaggagaagcagaaggccggcaccgaccccagccacatgcccaccggcccccaggccgccagctgcctggacctgaacctggtgaccagagtgtacagcaccgccctgagcagcttcctgaccaagagaaacagccccctgaccgtgcccatgttcctgagcctgttcagcagacaccccgtgctgtgccagagcctgctgcccatcctggtgcagcacatcaccggccccgtgagacccagacaccaggcctgcctgctgctgcagaagaccctgagcatgagagaggtgagaagctgcttcgaggaccccgagtggaagcagctgatgggccaggtgctggccaaggtgaccgagaacctgagagtgctgggcgaggcccagaccaaggcccagcaccagcaggccctgagcagcctggagctgctgaacgtgctgttcagaacctgcaagcacgagaagctgaccctggacctgaccgtgctgctgggcgtgctgcagggccagcagcagagcctgcagcagggcgcccacagcaccggcagcagcagactgcacgacctgtactggcaggccatgaagaccctgggcgtgcagagacccaagctggagaagaaggacgccaaggagatccccagcgccacccagagccccatcagcaagaagagaaagaagaagggcttcctgcccgagaccaagaagagaaagaagagaaagagcgaggacggcacccccgccgaggacggcacccccgccgccaccggcggcagccagccccccagcatgggcagaaagaagagaaacagaaccaaggccaaggtgcccgcccaggccaacggcacccccaccaccaagagccccgcccccggcgcccccaccagaagccccagcacccccgccaagagccccaagctgcagaagaagaaccagaagcccagccaggtgaacggcgcccccggcagccccaccgagcccgccggccagaagcagcaccagaaggccctgcccaagaagggcgtgctgggcaagagccccctgagcgccctggccagaaagaaggccagactgagcctggtgatcagaagccccagcctgctgcagagcggcgccaagaagaaggcccaggtgagaaaggccggcaagccctag

SEQ ID NO: 89648 - DNA, 3999 bp, Artificial Sequence
  Description of Artificial Sequence: Synthetic coding sequence
atggagagcagagaccccgcccagcccatgagccccggcgaggccacccagagcggcgccagacccgccgacagatacggcctgctgaagcacagcagagagttcctggacttcttctgggacatcgccaagcccgagcaggagaccagactggccgccaccgagaagctgctggagtacctgagaggcagacccaagggcagcgagatgaagtacgccctgaagagactgatcaccggcctgggcgtgggcagagagaccgccagaccctgctacagcctggccctggcccagctgctgcagagcttcgaggacctgcccctgtgcagcatcctgcagcagatccaggagaagtacgacctgcaccaggtgaagaaggccatgctgagacccgccctgttcgccaacctgttcggcgtgctggccctgttccagagcggcagactggtgaaggaccaggaggccctgatgaagagcgtgaagctgctgcaggccctggcccagtaccagaaccacctgcaggagcagcccagaaaggccctggtggacatcctgagcgaggtgagcaaggccaccctgcaggagatcctgcccgaggtgctgaaggccgacctgaacatcatcctgagcagccccgagcagctggagctgttcctgctggcccagcagaaggtgcccagcaagctgaagaagctggtgggcagcgtgaacctgttcagcgacgagaacgtgcccagactggtgaacgtgctgaagatggccgccagcagcgtgaagaaggacagaaagctgcccgccatcgccctggacctgctgagactggccctgaaggaggacaagttccccagattctggaaggaggtggtggagcagggcctgctgaagatgcagttctggcccgccagctacctgtgcttcagactgctgggcgccgccctgcccctgctgaccaaggagcagctgcacctggtgatgcagggcgacgtgatcagacactacggcgagcacgtgtgcaccgccaagctgcccaagcagttcaagttcgcccccgagatggacgactacgtgggcaccttcctggagggctgccaggacgaccccgagagacagctggccgtgctggtggccttcagcagcgtgaccaaccagggcctgcccgtgacccccaccttctggagagtggtgagattcctgagcccccccgccctgcagggctacgtggcctggctgagagccatgttcctgcagcccgacctggacagcctggtggacttcagcaccaacaaccagaagaaggcccaggacagcagcctgcacatgcccgagagagccgtgttcagactgagaaagtggatcatcttcagactggtgagcatcgtggacagcctgcacctggagatggaggaggccctgaccgagcaggtggccagattctgcctgttccacagcttcttcgtgaccaagaagcccaccagccagatccccgagaccaagcaccccttcagcttccccctggagaaccaggccagagaggccgtgagcagcgccttcttcagcctgctgcagaccctgagcacccagttcaagcaggcccccggccagacccagggcggccagccctggacctaccacctggtgcagttcgccgacctgctgctgaaccacagccacaacgtgaccaccgtgacccccttcaccgcccagcagagacaggcctgggacagaatgctgcagaccctgaaggagctggaggcccacagcgccgaggccagagccgccgccttccagcacctgctgctgctggtgggcatccacctgctgaagagccccgccgagagctgcgacctgctgggcgacatccagacctgcatcagaaagagcctgggcgagaagcccagaagaagcagaaccaagaccatcgacccccaggagcccccctgggtggaggtgctggtggagatcctgctggccctgctggcccagcccagccacctgatgagacaggtggccagaagcgtgttcggccacatctgcagccacctgacccccagagccctgcagctgatcctggacgtgctgaaccccgagaccagcgaggacgagaacgacagagtggtggtgaccgacgacagcgacgagagaagactgaagggcgccgaggacaagagcgaggagggcgaggacaacagaagcagcgagagcgaggaggagagcgagggcgaggagagcgaggaggaggagagagacggcgacgtggaccagggcttcagagagcagctgatgaccgtgctgcaggccggcaaggccctgggcggcgaggacagcgagaacgaggaggagctgggcgacgaggccatgatggccctggaccagagcctggccagcctgttcgccgagcagaagctgagaatccaggccagaagagacgagaagaacaagctgcagaaggagaaggccctgagaagagacttccagatcagagtgctggacctggtggaggtgctggtgaccaagcagcccgagaacgccctggtgctggagctgctggagcccctgctgagcatcatcagaagaagcctgagaagcagcagcagcaagcaggagcaggacctgctgcacaagaccgccagaatcttcacccaccacctgtgcagagccagaagatactgccacgacctgggcgagagagccggcgccctgcacgcccaggtggagagactggtgcagcaggccggcagacagcccgacagccccaccgccctgtaccacttcaacgccagcctgtacctgctgagagtgctgaagggcaacaccgccgagggctgcgtgcacgagacccaggagaagcagaaggccggcaccgaccccagccacatgcccaccggcccccaggccgccagctgcctggacctgaacctggtgaccagagtgtacagcaccgccctgagcagcttcctgaccaagagaaacagccccctgaccgtgcccatgttcctgagcctgttcagcagacaccccgtgctgtgccagagcctgctgcccatcctggtgcagcacatcaccggccccgtgagacccagacaccaggcctgcctgctgctgcagaagaccctgagcatgagagaggtgagaagctgcttcgaggaccccgagtggaagcagctgatgggccaggtgctggccaaggtgaccgagaacctgagagtgctgggcgaggcccagaccaaggcccagcaccagcaggccctgagcagcctggagctgctgaacgtgctgttcagaacctgcaagcacgagaagctgaccctggacctgaccgtgctgctgggcgtgctgcagggccagcagcagagcctgcagcagggcgcccacagcaccggcagcagcagactgcacgacctgtactggcaggccatgaagaccctgggcgtgcagagacccaagctggagaagaaggacgccaaggagatccccagcgccacccagagccccatcagcaagaagagaaagaagaagggcttcctgcccgagaccaagaagagaaagaagagaaagagcgaggacggcacccccgccgaggacggcacccccgccgccaccggcggcagccagccccccagcatgggcagaaagaagagaaacagaaccaaggccaaggtgcccgcccaggccaacggcacccccaccaccaagagccccgcccccggcgcccccaccagaagccccagcacccccgccaagagccccaagctgcagaagaagaaccagaagcccagccaggtgaacggcgcccccggcagccccaccgagcccgccggccagaagcagcaccagaaggccctgcccaagaagggcgtgctgggcaagagccccctgagcgccctggccagaaagaaggccagactgagcctggtgatcagaagccccagcctgctgcagagcggcgccaagaagaaggcccagaccctgagattcaccatcagcagcagcaagaagtag

SEQ ID NO: 89649 - DNA, 1812 bp, Artificial Sequence
  Description of Artificial Sequence: Synthetic coding sequence
atggagagcagagaccccgcccagcccatgagccccggcgaggccacccagagcggcgccagacccgccgacagatacggcctgctgaagcacagcagagagttcctggacttcttctgggacatcgccaagcccgagcaggagaccagactggccgccaccgagaagctgctggagtacctgagaggcagacccaagggcagcgagatgaagtacgccctgaagagactgatcaccggcctgggcgtgggcagagagaccgccagaccctgctacagcctggccctggcccagctgctgcagagcttcgaggacctgcccctgtgcagcatcctgcagcagatccaggagaagtacgacctgcaccaggtgaagaaggccatgctgagacccgccctgttcgccaacctgttcggcgtgctggccctgttccagagcggcagactggtgaaggaccaggaggccctgatgaagagcgtgaagctgctgcaggccctggcccagtaccagaaccacctgcaggagcagcccagaaaggccctggtggacatcctgagcgaggtgagcaaggccaccctgcaggagatcctgcccgaggtgctgaaggccgacctgaacatcatcctgagcagccccgagcagctggagctgttcctgctggcccagcagaaggtgcccagcaagctgaagaagctggtgggcagcgtgaacctgttcagcgacgagaacgtgcccagactggtgaacgtgctgaagatggccgccagcagcgtgaagaaggacagaaagctgcccgccatcgccctggacctgctgagactggccctgaaggaggacaagttccccagattctggaaggaggtggtggagcagggcctgctgaagatgcagttctggcccgccagctacctgtgcttcagactgctgggcgccgccctgcccctgctgaccaaggagcagctgcacctggtgatgcagggcgacgtgatcagacactacggcgagcacgtgtgcaccgccaagctgcccaagcagttcaagttcgcccccgagatggacgactacgtgggcaccttcctggagggctgccaggacgaccccgagagacagctggccgtgctggtggccttcagcagcgtgaccaaccagggcctgcccgtgacccccaccttctggagagtggtgagattcctgagcccccccgccctgcagggctacgtggcctggctgagagccatgttcctgcagcccgacctggacagcctggtggacttcagcaccaacaaccagaagaaggcccaggacagcagcctgcacatgcccgagagagccgtgttcagactgagaaagtggatcatcttcagactggtgagcatcgtggacagcctgcacctggagatggaggaggccctgaccgagcaggtggccagattctgcctgttccacagcttcttcgtgaccaagaagcccaccagccagatccccgagaccaagccccaggagagaagcgagggccccgcccagcccccccacgcccccggcggccccgagagacccaagctggagaagaaggacgccaaggagatccccagcgccgaggacggcacccccgccgccaccggcggcagccagccccccagcatgggcagaaagaagagaaacagaaccaaggccaaggtgcccgcccaggccaacggcacccccaccaccaagagccccgcccccggcgcccccaccagaagccccagcacccccgccaagagccccaagctgcagaagaaggcccaggtgagaaaggccggcaagccctag

SEQ ID NO: 89650 - DNA, 2487 bp, Artificial Sequence
  Description of Artificial Sequence: Synthetic coding sequence
atggccgccgaggaggccgacgtggacatcgagggcgacgtggtggccgccgccggcgcccagcccggcagcggcgagaacaccgccagcgtgctgcagaaggaccactacctggacagcagctggagaaccgagaacggcctgatcccctggaccctggacaacaccatcagcgaggagaacagagccgtgatcgagaagatgctgctggaggaggagtactacctgagcaagaagagccagcccgagaaggtgtggctggaccagaaggaggacgacaagaagtacatgaagagcctgcagaagaccgccaagatcatggtgcacagccccaccaagcccgccagctacagcgtgaagtggaccatcgaggagaaggagctgttcgagcagggcctggccaagttcggcagaagatggaccaagatcagcaagctgatcggcagcagaaccgtgctgcaggtgaagagctacgccagacagtacttcaagaacaaggtgaagtgcggcctggacaaggagacccccaaccagaagaccggccacaacctgcaggtgaagaacgaggacaagggcaccaaggcctggacccccagctgcctgagaggcagagccgaccccaacctgaacgccgtgaagatcgagaagctgagcgacgacgaggaggtggacatcaccgacgaggtggacgagctgagcagccagaccccccagaagaacagcagcagcgacctgctgctggacttccccaacagcaagatgcacgagaccaaccagggcgagttcatcaccagcgacagccaggaggccctgttcagcaagagcagcagaggctgcctgcagaacgagaagcaggacgagaccctgagcagcagcgagatcaccctgtggaccgagaagcagagcaacggcgacaagaagagcatcgagctgaacgaccagaagttcaacgagctgatcaagaactgcaacaagcacgacggcagaggcatcatcgtggacgccagacagctgcccagccccgagccctgcgagatccagaagaacctgaacgacaacgagatgctgttccacagctgccagatggtggaggagagccacgaggaggaggagctgaagccccccgagcaggagatcgagatcgacagaaacatcatccaggaggaggagaagcaggccatccccgagttcttcgagggcagacaggccaagacccccgagagatacctgaagatcagaaactacatcctggaccagtgggagatctgcaagcccaagtacctgaacaagaccagcgtgagacccggcctgaagaactgcggcgacgtgaactgcatcggcagaatccacacctacctggagctgatcggcgccatcaacttcggctgcgagcaggccgtgtacaacagaccccagaccgtggacaaggtgagaatcagagacagaaaggacgccgtggaggcctaccagctggcccagagactgcagagcatgagaaccagaagaagaagagtgagagacccctggggcaactggtgcgacgccaaggacctggagggccagaccttcgagcacctgagcgccgaggagctggccaagagaagagaggaggagaagggcagacccgtgaagagcctgaaggtgcccagacccaccaagagcagcttcgaccccttccagctgatcccctgcaacttcttcagcgaggagaagcaggagcccttccaggtgaaggtggccagcgaggccctgctgatcatggacctgcacgcccacgtgagcatggccgaggtgatcggcctgctgggcggcagatacagcgaggtggacaaggtggtggaggtgtgcgccgccgagccctgcaacagcctgagcaccggcctgcagtgcgagatggaccccgtgagccagacccaggccagcgagaccctggccgtgagaggcttcagcgtgatcggctggtaccacagccaccccgccttcgaccccaaccccagcctgagagacatcgacacccaggccaagtaccagagctacttcagcagaggcggcgccaagttcatcggcatgatcgtgagcccctacaacagaaacaaccccctgccctacagccagatcacctgcctggtgatcagcgaggagatcagccccgacggcagctacagactgccctacaagttcgaggtgcagcagatgctggaggagccccagtggggcctggtgttcgagaagaccagatggatcatcgagaagtacagactgagccacagcagcgtgcccatggacaagatcttcagaagagacagcgacctgacctgcctgcagaagctgctggagtgcatgagaaagaccctgagcaaggtgaccaactgcttcatggccgaggagttcctgaccgagatcgagaacctgttcctgagcaactacaagagcaaccaggagaacggcgtgaccgaggagaactgcaccaaggagctgctgatgtag

SEQ ID NO: 89651 - DNA, 843 bp, Artificial Sequence
  Description of Artificial Sequence: Synthetic coding sequence
atgcccaagaaggccaagcccaccggcagcggcaaggaggagggccccgccccctgcaagcagatgaagctggaggccgccggcggccccagcgccctgaacttcgacagccccagcagcctgttcgagagcctgatcagccccatcaagaccgagaccttcttcaaggagttctgggagcagaagcccctgctgatccagagagacgaccccgccctggccacctactacggcagcctgttcaagctgaccgacctgaagagcctgtgcagcagaggcatgtactacggcagagacgtgaacgtgtgcagatgcgtgaacggcaagaagaaggtgctgaacaaggacggcaaggcccacttcctgcagctgagaaaggacttcgaccagaagagagccaccatccagttccaccagccccagagattcaaggacgagctgtggagaatccaggagaagctggagtgctacttcggcagcctggtgggcagcaacgtgtacatcacccccgccggcagccagggcctgcccccccactacgacgacgtggaggtgttcatcctgcagctggagggcgagaagcactggagactgtaccaccccaccgtgcccctggccagagagtacagcgtggaggccgaggagagaatcggcagacccgtgcacgagttcatgctgaagcccggcgacctgctgtacttccccagaggcaccatccaccaggccgacacccccgccggcctggcccacagcacccacgtgaccatcagcacctaccagaacaacgacgccggcgccagaatgagaagatgcgacctgagagccatcgccccccagaagtag

SEQ ID NO: 89652 - DNA, 1398 bp, Artificial Sequence
  Description of Artificial Sequence: Synthetic coding sequence
atgcccaagaaggccaagcccaccggcagcggcaaggaggagggccccgccccctgcaagcagatgaagctggaggccgccggcggccccagcgccctgaacttcgacagccccagcagcctgttcgagagcctgatcagccccatcaagaccgagaccttcttcaaggagttctgggagcagaagcccctgctgatccagagagacgaccccgccctggccacctactacggcagcctgttcaagctgaccgacctgaagagcctgtgcagcagaggcatgtactacggcagagacgtgaacgtgtgcagatgcgtgaacggcaagaagaaggtgctgaacaaggacggcaaggcccacttcctgcagctgagaaaggacttcgaccagaagagagccaccatccagttccaccagccccagagattcaaggacgagctgtggagaatccaggagaagctggagtgctacttcggcagcctggtgggcagcaacgtgtacatcacccccgccggcagccagggcctgcccccccactacgacgacgtggaggtgttcatcctgcagctggagggcgagaagcactggagactgtaccaccccaccgtgcccctggccagagagtacagcgtggaggccgaggagagaatcggcagacccgtgcacgagttcatgctgaagcccggcgacctgctgtacttccccagaggcaccatccaccaggccgacacccccgccggcctggcccacagcacccacgtgaccatcagcacctaccagaacaacagctggggcgacttcctgctggacaccatcagcggcctggtgttcgacaccgccaaggaggacgtggagctgagaaccggcatccccagacagctgctgctgcaggtggagagcaccaccgtggccaccagaagactgagcggcttcctgagaaccctggccgacagactggagggcaccaaggagctgctgagcagcgacatgaagaaggacttcatcatgcacagactgcccccctacagcgccggcgacggcgccgagctgagcacccccggcggcaagctgcccagactggacagcgtggtgagactgcagttcaaggaccacatcgtgctgaccgtgctgcccgaccaggaccagagcgacgaggcccaggagaagatggtgtacatctaccacagcctgaagaacagcagagagacccacatgatgggcaacgaggaggagaccgagttccacggcctgagattccccctgagccacctggacgccctgaagcagatctggaacagccccgccatcagcgtgaaggacctgaagctgaccaccgacgaggagaaggagagcctggtgctgagcctgtggaccgagtgcctgatccaggtggtgtag

SEQ ID NO: 89653 - DNA, 1395 bp, Artificial Sequence
  Description of Artificial Sequence: Synthetic coding sequence
atgcccaagaaggccaagcccaccggcagcggcaaggaggagggccccgccccctgcaagcagatgaagctggaggccgccggcggccccagcgccctgaacttcgacagccccagcagcctgttcgagagcctgatcagccccatcaagaccgagaccttcttcaaggagttctgggagcagaagcccctgctgatccagagagacgaccccgccctggccacctactacggcagcctgttcaagctgaccgacctgaagagcctgtgcagcagaggcatgtactacggcagagacgtgaacgtgtgcagatgcgtgaacggcaagaagaaggtgctgaacaaggacggcaaggcccacttcctgcagctgagaaaggacttcgaccagaagagagccaccatccagttccaccagccccagagattcaaggacgagctgtggagaatccaggagaagctggagtgctacttcggcagcctggtgggcagcaacgtgtacatcacccccgccggcagccagggcctgcccccccactacgacgacgtggaggtgttcatcctgcagctggagggcgagaagcactggagactgtaccaccccaccgtgcccctggccagagagtacagcgtggaggccgaggagagaatcggcagacccgtgcacgagttcatgctgaagcccggcgacctgctgtacttccccagaggcaccatccaccaggccgacacccccgccggcctggcccacagcacccacgtgaccatcagcacctaccagaacaacagctggggcgacttcctgctggacaccatcagcggcctggtgttcgacaccgccaaggaggacgtggagctgagaaccggcatccccagacagctgctgctggtggagagcaccaccgtggccaccagaagactgagcggcttcctgagaaccctggccgacagactggagggcaccaaggagctgctgagcagcgacatgaagaaggacttcatcatgcacagactgcccccctacagcgccggcgacggcgccgagctgagcacccccggcggcaagctgcccagactggacagcgtggtgagactgcagttcaaggaccacatcgtgctgaccgtgctgcccgaccaggaccagagcgacgaggcccaggagaagatggtgtacatctaccacagcctgaagaacagcagagagacccacatgatgggcaacgaggaggagaccgagttccacggcctgagattccccctgagccacctggacgccctgaagcagatctggaacagccccgccatcagcgtgaaggacctgaagctgaccaccgacgaggagaaggagagcctggtgctgagcctgtggaccgagtgcctgatccaggtggtgtag

SEQ ID NO: 89654 - DNA, 1398 bp, Artificial Sequence; identical to SEQ ID NO: 89652
  Description of Artificial Sequence: Synthetic coding sequence

SEQ ID NO: 89655 - DNA, 636 bp, Artificial Sequence
  Description of Artificial Sequence: Synthetic coding sequence
atgctgctgcaggtgccctgcaacagctggggcgacttcctgctggacaccatcagcggcctggtgttcgacaccgccaaggaggacgtggagctgagaaccggcatccccagacagctgctgctgcaggtggagagcaccaccgtggccaccagaagactgagcggcttcctgagaaccctggccgacagactggagggcaccaaggagctgctgagcagcgacatgaagaaggacttcatcatgcacagactgcccccctacagcgccggcgacggcgccgagctgagcacccccggcggcaagctgcccagactggacagcgtggtgagactgcagttcaaggaccacatcgtgctgaccgtgctgcccgaccaggaccagagcgacgaggcccaggagaagatggtgtacatctaccacagcctgaagaacagcagagagacccacatgatgggcaacgaggaggagaccgagttccacggcctgagattccccctgagccacctggacgccctgaagcagatctggaacagccccgccatcagcgtgaaggacctgaagctgaccaccgacgaggagaaggagagcctggtgctgagcctgtggaccgagtgcctgatccaggtggtgtag

SEQ ID NO: 89656 - DNA, 339 bp, Artificial Sequence
  Description of Artificial Sequence: Synthetic coding sequence
atgcccaagaaggccaagcccaccggcagcggcaaggaggagggccccgccccctgcaagcagatgaagctggaggccgccggcggccccagcgccctgaacttcgacagccccagcagcctgttcgagagcctgatcagccccatcaagaccgagaccttcttcaaggagttctgggagcagaagcccctgctgatccagagagacgaccccgccctggccacctactacggcagcctgttcaagctgaccgacctgaagagcctgtgcagcagaggcatgtactacggcagagacgtgaacgtgtgcagatgcgtgaacggcaagaagaaggtgtag

SEQ ID NO: 89657 - DNA, 459 bp, Artificial Sequence
  Description of Artificial Sequence: Synthetic coding sequence
atgggcccccccagcctgcacagccccacccccagcctgggccccctgggcgccctggtgctgagcagccagcacaccagccccgacagctgcaagagcccctggaccctgaaggccgtgagagccgccagacaggccgccgacttcaccctgaaggtggaggtggagtgcagcagcctgcaggaggccgtgcaggccgccgaggccggcgccgacctggtgctgctggacaacttcaagcccgaggagctgcaccccaccgccaccgtgctgaaggcccagttccccagcgtggccgtggaggccagcggcggcatcaccctggacaacctgccccagttctgcggcccccacatcgacgtgatcagcatgggcatgctgacccaggccgcccccgccctggacttcagcctgaagctgttcgccaaggaggtggcccccgtgcccaagatccactag

SEQ ID NO: 89658 - DNA, 1434 bp, Artificial Sequence
  Description of Artificial Sequence: Synthetic coding sequence
atgttccccgtgttcccctgcaccctgctggccccccccttccccgtgctgggcctggacagcagaggcgtgggcggcctgatgaacagcttcccccccccccagggccacgcccagaaccccctgcaggtgggcgccgagctgcagagcagattcttcgccagccagggctgcgcccagagccccttccaggccgcccccgcccccccccccaccccccaggcccccgccgccgagcccctgcaggtggacctgctgcccgtgctggccgccgcccaggagagcgccgccgccgccgccgccgccgccgccgccgccgccgccgtggccgccgccccccccgcccccgccgccgccagcaccgtggacaccgccgccctgaagcagccccccgcccccccccccccccccccccccgtgagcgcccccgccgccgaggccgccccccccgccagcgccgccaccatcgccgccgccgccgccaccgccgtggtggcccccaccagcaccgtggccgtggcccccgtggccagcgccctggagaagaagaccaagagcaagggcccctacatctgcgccctgtgcgccaaggagttcaagaacggctacaacctgagaagacacgaggccatccacaccggcgccaaggccggcagagtgcccagcggcgccatgaagatgcccaccatggtgcccctgagcctgctgagcgtgccccagctgagcggcgccggcggcggcggcggcgaggccggcgccggcggcggcgccgccgccgtggccgccggcggcgtggtgaccaccaccgccagcggcaagagaatcagaaagaaccacgcctgcgagatgtgcggcaaggccttcagagacgtgtaccacctgaacagacacaagctgagccacagcgacgagaagccctaccagtgccccgtgtgccagcagagattcaagagaaaggacagaatgagctaccacgtgagaagccacgacggcgccgtgcacaagccctacaactgcagccactgcggcaagagcttcagcagacccgaccacctgaacagccacgtgagacaggtgcacagcaccgagagacccttcaagtgcgagaagtgcgaggccgccttcgccaccaaggacagactgagagcccacaccgtgagacacgaggagaaggtgccctgccacgtgtgcggcaagatgctgagcagcgcctacatcagcgaccacatgaaggtgcacagccagggcccccaccacgtgtgcgagctgtgcaacaagggcaccggcgaggtgtgccccatggccgccgccgccgccgccgccgccgccgccgccgccgccgccgtggccgccccccccaccgccgtgggcagcctgagcggcgccgagggcgtgcccgtgagcagccagcccctgcccagccagccctggtag

SEQ ID NO: 89659 - DNA, 759 bp, Artificial Sequence
  Description of Artificial Sequence: Synthetic coding sequence
atgaagatgcccaccatggtgcccctgagcctgctgagcgtgccccagctgagcggcgccggcggcggcggcggcgaggccggcgccggcggcggcgccgccgccgtggccgccggcggcgtggtgaccaccaccgccagcggcaagagaatcagaaagaaccacgcctgcgagatgtgcggcaaggccttcagagacgtgtaccacctgaacagacacaagctgagccacagcgacgagaagccctaccagtgccccgtgtgccagcagagattcaagagaaaggacagaatgagctaccacgtgagaagccacagaagatgcgccaagccctacaactgcagccactgcggcaagagcttcagcagacccgaccacctgaacagccacgtgagacaggtgcacagcaccgagagacccttcaagtgcgagaagtgcgaggccgccttcgccaccaaggacagactgagagcccacaccgtgagacacgaggagaaggtgccctgccacgtgtgcggcaagatgctgagcagcgcctacatcagcgaccacatgaaggtgcacagccagggcccccaccacgtgtgcgagctgtgcaacaagggcaccggcgaggtgtgccccatggccgccgccgccgccgccgccgccgccgccgccgccgccgccgtggccgccccccccaccgccgtgggcagcctgagcggcgccgagggcgtgcccgtgagcagccagcccctgcccagccagccctggtag

SEQ ID NO: 89660 - DNA, 1365 bp, Artificial Sequence
  Description of Artificial Sequence: Synthetic coding sequence
atggaccccagcaactggagcagcttcatcttccagggccacgcccagaaccccctgcaggtgggcgccgagctgcagagcagattcttcgccagccagggctgcgcccagagccccttccaggccgcccccgcccccccccccaccccccaggcccccgccgccgagcccctgcaggtggacctgctgcccgtgctggccgccgcccaggagagcgccgccgccgccgccgccgccgccgccgccgccgccgccgtggccgccgccccccccgcccccgccgccgccagcaccgtggacaccgccgccctgaagcagccccccgcccccccccccccccccccccccgtgagcgcccccgccgccgaggccgccccccccgccagcgccgccaccatcgccgccgccgccgccaccgccgtggtggcccccaccagcaccgtggccgtggcccccgtggccagcgccctggagaagaagaccaagagcaagggcccctacatctgcgccctgtgcgccaaggagttcaagaacggctacaacctgagaagacacgaggccatccacaccggcgccaaggccggcagagtgcccagcggcgccatgaagatgcccaccatggtgcccctgagcctgctgagcgtgccccagctgagcggcgccggcggcggcggcggcgaggccggcgccggcggcggcgccgccgccgtggccgccggcggcgtggtgaccaccaccgccagcggcaagagaatcagaaagaaccacgcctgcgagatgtgcggcaaggccttcagagacgtgtaccacctgaacagacacaagctgagccacagcgacgagaagccctaccagtgccccgtgtgccagcagagattcaagagaaaggacagaatgagctaccacgtgagaagccacgacggcgccgtgcacaagccctacaactgcagccactgcggcaagagcttcagcagacccgaccacctgaacagccacgtgagacaggtgcacagcaccgagagacccttcaagtgcgagaagtgcgaggccgccttcgccaccaaggacagactgagagcccacaccgtgagacacgaggagaaggtgccctgccacgtgtgcggcaagatgctgagcagcgcctacatcagcgaccacatgaaggtgcacagccagggcccccaccacgtgtgcgagctgtgcaacaagggcaccggcgaggtgtgccccatggccgccgccgccgccgccgccgccgccgccgccgccgccgccgtggccgccccccccaccgccgtgggcagcctgagcggcgccgagggcgtgcccgtgagcagccagcccctgcccagccagccctggtag

SEQ ID NO: 89661 - DNA, 2955 bp, Artificial Sequence
  Description of Artificial Sequence: Synthetic coding sequence
atgagagcccccgccagaggcaccggctgctgcggcagaagcggcggcagatggctggccggcgccgcccagcccagatgcctgtgggccggcggcgccggccagagattcatggtgcccggcggcaccatgaagagcctgaagaaggacagcagactgagaatcacccccaccagactgctggaggccagcgagaacgtgaaggagaagaagagagccaagggccccgagcagcccacccccaccatccaggaggagcccgagcccgtgagcaacgtgctgcagggcgacgacatcctggccctggccatcaagaaggaggacctgaaggagcagcacatccccagactgaccgagaaggaggacaagagagtgatcacccagaagttcatcatcagaaagctgaagcccatggaccccagaagaaaggtgtgccacctggtggccagacccgccaaccccgacgaggccaccaagcccctggactacagcggccccggcgacagcttcgacggcagcgaccagatcctgccccaccacatcctgggcagcctgcaggacttcaagagaatcgccctggccagaggcaacacccagctggccgagagaatccccaccagcccctgcctgatgaccctgatcagcgccgagggcgagagcaagcagaaggcccccaaggaggagaagagacccccctgggccccccccccccagcacaacttcctgaagaactggcagagaaacaccgccctgagaaagaagcagcaggaggccctgagcgagcacctgaagaagcccgtgagcgagctgctgatgcacaccggcgagacctacagaagaatccaggaggagagagagctgatcgactgcaccctgcccaccagaagagacagaaagagctgggagaacagcggcttctggagcagactggagtacctgggcgacgagatgaccggcctggtgatgaccaagaccaagacccagagaggcctgatggagcccatcacccacatcagaaagccccacagcatcagagtggagaccggcctgcccgcccagagagacgccagctacagatacacctgggacagaagcctgttcctgatctacagaagaaaggagctgcagagaatcatggaggagctggacttcagccagcaggacatcgacggcctggaggtggtgggcaagggctggcccttcagcgccgtgaccgtggaggactacaccgtgttcgagagaagccagggcagcagcagcgaggacaccgcctacctgggcaccctggccagcagcagcgacgtgagcatgcccatcctgggccccagcctgctgttctgcggcaagcccgcctgctggatcagaggcagcaacccccaggacaagagacaggtgggcatcgccgcccacctgaccttcgagaccctggagggcgagaagaccagcagcgagctgaccgtggtgaacaacggcaccgtggccatctggtacgactggagaagacagcaccagcccgacaccttccaggacctgaagaagaacagaatgcagagattctacttcgacaacagagagggcgtgatcctgcccggcgagatcaagaccttcaccttcttcttcaagagcctgaccgccggcgtgttcagagagttctgggagttcagaacccaccccaccctgctgggcggcgccatcctgcaggtgaacctgcacgccgtgagcctgacccaggacgtgttcgaggacgagagaaaggtgctggagagcaagctgaccgcccacgaggccgtgaccgtggtgagagaggtgctgcaggagctgctgatgggcgtgctgacccccgagagaacccccagccccgtggacgcctacctgaccgaggaggacctgttcagacacagaaacccccccctgcactacgagcaccaggtggtgcagagcctgcaccagctgtggagacagtacatgaccctgcccgccaaggccgaggaggccagacccggcgacaaggagcacgtgagccccatcgccaccgagaaggccagcgtgaacgccgagctgctgcccagattcagaagccccatcagcgagacccaggtgcccagacccgagaacgaggccctgagagagagcggcagccagaaggccagagtgggcaccaagagcccccagagaaagagcatcatggaggagatcctggtggaggagagccccgacgtggacagcaccaagagcccctgggagcccgacggcctgcccctgctggagtggaacctgtgcctggaggacttcagaaaggccgtgatggtgctgcccgacgagaaccacagagaggacgccctgatgagactgaacaaggccgccctggagctgtgccagaagcccagacccctgcagagcaacctgctgcaccagatgtgcctgcagctgtggagagacgtgatcgacagcctggtgggccacagcatgtggctgagaagcgtgctgggcctgcccgagaaggagaccatctacctgaacgtgcccgaggagcaggaccagaagagcccccccatcatggaggtgaaggtgcccgtgggcaaggccggcaaggaggagagaaagggcgccgcccaggagaagaagcagctgggcatcaaggacaaggaggacaagaagggcgccaagctgctgggcaaggaggacagacccaacagcaagaagcacaaggccaaggacgacaagaaggtgatcaagagcgccagccaggacagattcagcctggaggaccccacccccgacatcatcctgagcagccaggagcccatcgaccccctggtgatgggcaagtacacccagagcctgcacagcgaggtgagaggcctgctggacaccctggtgaccgacctgatggtgctggccgacgagctgagccccatcaagaacgtggaggaggccctgagactgtgcagatag

SEQ ID NO: 89662 - DNA, 2829 bp, Artificial Sequence
  Description of Artificial Sequence: Synthetic coding sequence
atggtgcccggcggcaccatgaagagcctgaagaaggacagcagactgagaatcacccccaccagactgctggaggccagcgagaacgtgaaggagaagaagagagccaagggccccgagcagcccacccccaccatccaggaggagcccgagcccgtgagcaacgtgctgcagggcgacgacatcctggccctggccatcaagaaggaggacctgaaggagcagcacatccccagactgaccgagaaggaggacaagagagtgatcacccagaagttcatcatcagaaagctgaagcccatggaccccagaagaaaggtgtgccacctggtggccagacccgccaaccccgacgaggccaccaagcccctggactacagcggccccggcgacagcttcgacggcagcgaccagatcctgccccaccacatcctgggcagcctgcaggacttcaagagaatcgccctggccagaggcaacacccagctggccgagagaatccccaccagcccctgcctgatgaccctgatcagcgccgagggcgagagcaagcagaaggcccccaaggaggagaagagacccccctgggccccccccccccagcacaacttcctgaagaactggcagagaaacaccgccctgagaaagaagcagcaggaggccctgagcgagcacctgaagaagcccgtgagcgagctgctgatgcacaccggcgagacctacagaagaatccaggaggagagagagctgatcgactgcaccctgcccaccagaagagacagaaagagctgggagaacagcggcttctggagcagactggagtacctgggcgacgagatgaccggcctggtgatgaccaagaccaagacccagagaggcctgatggagcccatcacccacatcagaaagccccacagcatcagagtggagaccggcctgcccgcccagagagacgccagctacagatacacctgggacagaagcctgttcctgatctacagaagaaaggagctgcagagaatcatggaggagctggacttcagccagcaggacatcgacggcctggaggtggtgggcaagggctggcccttcagcgccgtgaccgtggaggactacaccgtgttcgagagaagccagggcagcagcagcgaggacaccgcctacctgggcaccctggccagcagcagcgacgtgagcatgcccatcctgggccccagcctgctgttctgcggcaagcccgcctgctggatcagaggcagcaacccccaggacaagagacaggtgggcatcgccgcccacctgaccttcgagaccctggagggcgagaagaccagcagcgagctgaccgtggtgaacaacggcaccgtggccatctggtacgactggagaagacagcaccagcccgacaccttccaggacctgaagaagaacagaatgcagagattctacttcgacaacagagagggcgtgatcctgcccggcgagatcaagaccttcaccttcttcttcaagagcctgaccgccggcgtgttcagagagttctgggagttcagaacccaccccaccctgctgggcggcgccatcctgcaggtgaacctgcacgccgtgagcctgacccaggacgtgttcgaggacgagagaaaggtgctggagagcaagctgaccgcccacgaggccgtgaccgtggtgagagaggtgctgcaggagctgctgatgggcgtgctgacccccgagagaacccccagccccgtggacgcctacctgaccgaggaggacctgttcagacacagaaacccccccctgcactacgagcaccaggtggtgcagagcctgcaccagctgtggagacagtacatgaccctgcccgccaaggccgaggaggccagacccggcgacaaggagcacgtgagccccatcgccaccgagaaggccagcgtgaacgccgagctgctgcccagattcagaagccccatcagcgagacccaggtgcccagacccgagaacgaggccctgagagagagcggcagccagaaggccagagtgggcaccaagagcccccagagaaagagcatcatggaggagatcctggtggaggagagccccgacgtggacagcaccaagagcccctgggagcccgacggcctgcccctgctggagtggaacctgtgcctggaggacttcagaaaggccgtgatggtgctgcccgacgagaaccacagagaggacgccctgatgagactgaacaaggccgccctggagctgtgccagaagcccagacccctgcagagcaacctgctgcaccagatgtgcctgcagctgtggagagacgtgatcgacagcctggtgggccacagcatgtggctgagaagcgtgctgggcctgcccgagaaggagaccatctacctgaacgtgcccgaggagcaggaccagaagagcccccccatcatggaggtgaaggtgcccgtgggcaaggccggcaaggaggagagaaagggcgccgcccaggagaagaagcagctgggcatcaaggacaaggaggacaagaagggcgccaagctgctgggcaaggaggacagacccaacagcaagaagcacaaggccaaggacgacaagaaggtgatcaagagcgccagccaggacagattcagcctggaggaccccacccccgacatcatcctgagcagccaggagcccatcgaccccctggtgatgggcaagtacacccagagcctgcacagcgaggtgcaccccggcagatgcgtgccctgggagaacaccatgcagggcgccttccccagcaccaccagatgcggcggcagctgcctgtag

SEQ ID NO: 89663 - DNA, 1992 bp, Artificial Sequence
  Description of Artificial Sequence: Synthetic coding sequence
agaagcagaggcgccgaggccaccgagagcaagctgagcggcggcttcagatggacccagaagaccagccccacccagggcgacagcgccatcacccacagcctgtacagaatgatcttcctgaccgccctgcccctgttctggatcatgatcagcgccagcagaggcggccactggggcgcctggatgcccagcagcatcagcgccttcgagggcacctgcgtgagcatcccctgcagattcgacttccccgacgagctgagacccgccgtggtgcacggcgtgtggtacttcaacagcccctaccccaagaactacccccccgtggtgttcaagagcagaacccaggtggtgcacgagagcttccagggcagaagcagactgctgggcgacctgggcctgagaaactgcaccctgctgctgagcaacgtgagccccgagctgggcggcaagtactacttcagaggcgacctgggcggctacaaccagtacaccttcagcgagcacagcgtgctggacatcgtgaacacccccaacatcgtggtgccccccgaggtggtggccggcaccgaggtggaggtgagctgcatggtgcccgacaactgccccgagctgagacccgagctgagctggctgggccacgagggcctgggcgagcccgccgtgctgggcagactgagagaggacgagggcacctgggtgcaggtgagcctgctgcacttcgtgcccaccagagaggccaacggccacagactgggctgccaggccagcttccccaacaccaccctgcagttcgagggctacgccagcatggacgtgaagtacccccccgtgatcgtggagatgaacagcagcgtggaggccatcgagggcagccacgtgagcctgctgtgcggcgccgacagcaaccccccccccctgctgacctggatgagagacggcaccgtgctgagagaggccgtggccgagagcctgctgctggagctggaggaggtgacccccgccgaggacggcgtgtacgcctgcctggccgagaacgcctacggccaggacaacagaaccgtgggcctgagcgtgatgtacgccccctggaagcccaccgtgaacggcaccatggtggccgtggagggcgagaccgtgagcatcctgtgcagcacccagagcaaccccgaccccatcctgaccatcttcaaggagaagcagatcctgagcaccgtgatctacgagagcgagctgcagctggagctgcccgccgtgagccccgaggacgacggcgagtactggtgcgtggccgagaaccagtacggccagagagccaccgccttcaacctgagcgtggagttcgcccccgtgctgctgctggagagccactgcgccgccgccagagacaccgtgcagtgcctgtgcgtggtgaagagcaaccccgagcccagcgtggccttcgagctgcccagcagaaacgtgaccgtgaacgagagcgagagagagttcgtgtacagcgagagaagcggcctggtgctgaccagcatcctgaccctgagaggccaggcccaggccccccccagagtgatctgcaccgccagaaacctgtacggcgccaagagcctggagctgcccttccagggcgcccacagactgatgtgggccaagatcggccccgtgggcgccgtggtggccttcgccatcctgatcgccatcgtgtgctacatcacccagaccagaagaaagaagaacgtgaccgagagccccagcttcagcgccggcgacaacccccccgtgctgttcagcagcgacttcagaatcagcggcgcccccgagaagtacgagagcgagagaagactgggcagcgagagaagactgctgggcctgagaggcgagccccccgagctggacctgagctacagccacagcgacctgggcaagagacccaccaaggacagctacaccctgaccgaggagctggccgagtacgccgagatcagagtgaagtag

SEQ ID NO: 89664 - DNA, 1749 bp, Artificial Sequence
  Description of Artificial Sequence: Synthetic coding sequence
atgatcttcctgaccgccctgcccctgttctggatcatgatcagcgccagcagaggcggccactggggcgcctggatgcccagcagcatcagcgccttcgagggcacctgcgtgagcatcccctgcagattcgacttccccgacgagctgagacccgccgtggtgcacggcgtgtggtacttcaacagcccctaccccaagaactacccccccgtggtgttcaagagcagaacccaggtggtgcacgagagcttccagggcagaagcagactgctgggcgacctgggcctgagaaactgcaccctgctgctgagcaacgtgagccccgagctgggcggcaagtactacttcagaggcgacctgggcggctacaaccagtacaccttcagcgagcacagcgtgctggacatcgtgaacacccccaacatcgtggtgccccccgaggtggtggccggcaccgaggtggaggtgagctgcatggtgcccgacaactgccccgagctgagacccgagctgagctggctgggccacgagggcctgggcgagcccgccgtgctgggcagactgagagaggacgagggcacctgggtgcaggtgagcctgctgcacttcgtgcccaccagagaggccaacggccacagactgggctgccaggccagcttccccaacaccaccctgcagttcgagggctacgccagcatggacgtgaagtacccccccgtgatcgtggagatgaacagcagcgtggaggccatcgagggcagccacgtgagcctgctgtgcggcgccgacagcaaccccccccccctgctgacctggatgagagacggcaccgtgctgagagaggccgtggccgagagcctgctgctggagctggaggaggtgacccccgccgaggacggcgtgtacgcctgcctggccgagaacgcctacggccaggacaacagaaccgtgggcctgagcgtgatgtacgccccctggaagcccaccgtgaacggcaccatggtggccgtggagggcgagaccgtgagcatcctgtgcagcacccagagcaaccccgaccccatcctgaccatcttcaaggagaagcagatcctgagcaccgtgatctacgagagcgagctgcagctggagctgcccgccgtgagccccgaggacgacggcgagtactggtgcgtggccgagaaccagtacggccagagagccaccgccttcaacctgagcgtggagttcgcccccgtgctgctgctggagagccactgcgccgccgccagagacaccgtgcagtgcctgtgcgtggtgaagagcaaccccgagcccagcgtggccttcgagctgcccagcagaaacgtgaccgtgaacgagagcgagagagagttcgtgtacagcgagagaagcggcctggtgctgaccagcatcctgaccctgagaggccaggcccaggccccccccagagtgatctgcaccgccagaaacctgtacggcgccaagagcctggagctgcccttccagggcgcccacagactgatgtgggccaagatcggccccgtgggcgccgtggtggccttcgccatcctgatcgccatcgtgtgctacatcacccagaccagaagaaagaagaacgtgaccgagagccccagcttcagcgccggcgacaacccccccgtgctgttcagcagcgacttcagaatcagcggcgcccccgagaagtacgagagcaaggaggtgagcaccctggagagccactag

SEQ ID NO: 89665 - DNA, 1881 bp, Artificial Sequence
  Description of Artificial Sequence: Synthetic coding sequence
atgatcttcctgaccgccctgcccctgttctggatcatgatcagcgccagcagaggcggccactggggcgcctggatgcccagcagcatcagcgccttcgagggcacctgcgtgagcatcccctgcagattcgacttccccgacgagctgagacccgccgtggtgcacggcgtgtggtacttcaacagcccctaccccaagaactacccccccgtggtgttcaagagcagaacccaggtggtgcacgagagcttccagggcagaagcagactgctgggcgacctgggcctgagaaactgcaccctgctgctgagcaacgtgagccccgagctgggcggcaagtactacttcagaggcgacctgggcggctacaaccagtacaccttcagcgagcacagcgtgctggacatcgtgaacacccccaacatcgtggtgccccccgaggtggtggccggcaccgaggtggaggtgagctgcatggtgcccgacaactgccccgagctgagacccgagctgagctggctgggccacgagggcctgggcgagcccgccgtgctgggcagactgagagaggacgagggcacctgggtgcaggtgagcctgctgcacttcgtgcccaccagagaggccaacggccacagactgggctgccaggccagcttccccaacaccaccctgcagttcgagggctacgccagcatggacgtgaagtacccccccgtgatcgtggagatgaacagcagcgtggaggccatcgagggcagccacgtgagcctgctgtgcggcgccgacagcaaccccccccccctgctgacctggatgagagacggcaccgtgctgagagaggccgtggccgagagcctgctgctggagctggaggaggtgacccccgccgaggacggcgtgtacgcctgcctggccgagaacgcctacggccaggacaacagaaccgtgggcctgagcgtgatgtacgccccctggaagcccaccgtgaacggcaccatggtggccgtggagggcgagaccgtgagcatcctgtgcagcacccagagcaaccccgaccccatcctgaccatcttcaaggagaagcagatcctgagcaccgtgatctacgagagcgagctgcagctggagctgcccgccgtgagccccgaggacgacggcgagtactggtgcgtggccgagaaccagtacggccagagagccaccgccttcaacctgagcgtggagttcgcccccgtgctgctgctggagagccactgcgccgccgccagagacaccgtgcagtgcctgtgcgtggtgaagagcaaccccgagcccagcgtggccttcgagctgcccagcagaaacgtgaccgtgaacgagagcgagagagagttcgtgtacagcgagagaagcggcctggtgctgaccagcatcctgaccctgagaggccaggcccaggccccccccagagtgatctgcaccgccagaaacctgtacggcgccaagagcctggagctgcccttccagggcgcccacagactgatgtgggccaagatcggccccgtgggcgccgtggtggccttcgccatcctgatcgccatcgtgtgctacatcacccagaccagaagaaagaagaacgtgaccgagagccccagcttcagcgccggcgacaacccccccgtgctgttcagcagcgacttcagaatcagcggcgcccccgagaagtacgagagcgagagaagactgggcagcgagagaagactgctgggcctgagaggcgagccccccgagctggacctgagctacagccacagcgacctgggcaagagacccaccaaggacagctacaccctgaccgaggagctggccgagtacgccgagatcagagtgaagtag

SEQ ID NO: 89666 - DNA, 1806 bp, Artificial Sequence
  Description of Artificial Sequence: Synthetic coding sequence
atgcccagcagcatcagcgccttcgagggcacctgcgtgagcatcccctgcagattcgacttccccgacgagctgagacccgccgtggtgcacggcgtgtggtacttcaacagcccctaccccaagaactacccccccgtggtgttcaagagcagaacccaggtggtgcacgagagcttccagggcagaagcagactgctgggcgacctgggcctgagaaactgcaccctgctgctgagcaacgtgagccccgagctgggcggcaagtactacttcagaggcgacctgggcggctacaaccagtacaccttcagcgagcacagcgtgctggacatcgtgaacacccccaacatcgtggtgccccccgaggtggtggccggcaccgaggtggaggtgagctgcatggtgcccgacaactgccccgagctgagacccgagctgagctggctgggccacgagggcctgggcgagcccgccgtgctgggcagactgagagaggacgagggcacctgggtgcaggtgagcctgctgcacttcgtgcccaccagagaggccaacggccacagactgggctgccaggccagcttccccaacaccaccctgcagttcgagggctacgccagcatggacgtgaagtacccccccgtgatcgtggagatgaacagcagcgtggaggccatcgagggcagccacgtgagcctgctgtgcggcgccgacagcaaccccccccccctgctgacctggatgagagacggcaccgtgctgagagaggccgtggccgagagcctgctgctggagctggaggaggtgacccccgccgaggacggcgtgtacgcctgcctggccgagaacgcctacggccaggacaacagaaccgtgggcctgagcgtgatgtacgccccctggaagcccaccgtgaacggcaccatggtggccgtggagggcgagaccgtgagcatcctgtgcagcacccagagcaaccccgaccccatcctgaccatcttcaaggagaagcagatcctgagcaccgtgatctacgagagcgagctgcagctggagctgcccgccgtgagccccgaggacgacggcgagtactggtgcgtggccgagaaccagtacggccagagagccaccgccttcaacctgagcgtggagttcgcccccgtgctgctgctggagagccactgcgccgccgccagagacaccgtgcagtgcctgtgcgtggtgaagagcaaccccgagcccagcgtggccttcgagctgcccagcagaaacgtgaccgtgaacgagagcgagagagagttcgtgtacagcgagagaagcggcctggtgctgaccagcatcctgaccctgagaggccaggcccaggccccccccagagtgatctgcaccgccagaaacctgtacggcgccaagagcctggagctgcccttccagggcgcccacagactgatgtgggccaagatcggccccgtgggcgccgtggtggccttcgccatcctgatcgccatcgtgtgctacatcacccagaccagaagaaagaagaacgtgaccgagagccccagcttcagcgccggcgacaacccccccgtgctgttcagcagcgacttcagaatcagcggcgcccccgagaagtacgagagcgagagaagactgggcagcgagagaagactgctgggcctgagaggcgagccccccgagctggacctgagctacagccacagcgacctgggcaagagacccaccaaggacagctacaccctgaccgaggagctggccgagtacgccgagatcagagtgaagtag

SEQ ID NO: 89667 - DNA, 915 bp, Artificial Sequence
  Description of Artificial Sequence: Synthetic coding sequence
atgggcaaccacgccggcaagagagagctgaacgccgagaaggccagcaccaacagcgagaccaacagaggcgagagcgagaagaagagaaacctgggcgagctgagcagaaccaccagcgaggacaacgaggtgttcggcgaggccgacgccaaccagaacaacggcaccagcagccaggacaccgccgtgaccgacagcaagagaaccgccgaccccaagaacgcctggcaggacgcccaccccgccgaccccggcagcagaccccacctgatcagactgttcagcagagacgcccccggcagagaggacaacaccttcaaggacagacccagcgagagcgacgagctgcagaccatccaggaggacagcgccgccaccagcgagagcctggacgtgatggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggacagccaccaccccgccagaaccgcccactacggcagcctgccccagaagagccacggcagaacccaggacgagaaccccgtggtgcacttcttcaagaacatcgtgacccccagaacccccccccccagccagggcaagggcagaggcctgagcctgagcagattcagctggggcgccgagggccagagacccggcttcggctacggcggcagagccagcgactacaagagcgcccacaagggcttcaagggcgtggacgcccagggcaccctgagcaagatcttcaagctgggcggcagagacagcagaagcggcagccccatggccagaagatag

SEQ ID NO: 89668 - DNA, 561 bp, Artificial Sequence
  Description of Artificial Sequence: Synthetic coding sequence
atggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggtgccctggctgaagcccggcagaagccccctgcccagccacgccagaagccagcccggcctgtgcaacatgtacaaggacagccaccaccccgccagaaccgcccactacggcagcctgccccagaagagccacggcagaacccaggacgagaaccccgtggtgcacttcttcaagaacatcgtgacccccagaacccccccccccagccagggcaagggcgccgagggccagagacccggcttcggctacggcggcagagccagcgactacaagagcgcccacaagggcttcaagggcgtggacgcccagggcaccctgagcaagatcttcaagctgggcggcagagacagcagaagcggcagccccatggccagaagatag

SEQ ID NO: 89669 - DNA, 594 bp, Artificial Sequence
  Description of Artificial Sequence: Synthetic coding sequence
atggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggtgccctggctgaagcccggcagaagccccctgcccagccacgccagaagccagcccggcctgtgcaacatgtacaaggacagccaccaccccgccagaaccgcccactacggcagcctgccccagaagagccacggcagaacccaggacgagaaccccgtggtgcacttcttcaagaacatcgtgacccccagaacccccccccccagccagggcaagggcagaggcctgagcctgagcagattcagctggggcgccgagggccagagacccggcttcggctacggcggcagagccagcgactacaagagcgcccacaagggcttcaagggcgtggacgcccagggcaccctgagcaagatcttcaagctgggcggcagagacagcagaagcggcagccccatggccagaagatag

SEQ ID NO: 89670 - DNA, 594 bp, Artificial Sequence
  Description of Artificial Sequence: Synthetic coding sequence
atgggcaaccacgccggcaagagagagctgaacgccgagaaggccagcaccaacagcgagaccaacagaggcgagagcgagaagaagagaaacctgggcgagctgagcagaaccaccagcgaggacaacgaggtgttcggcgaggccgacgccaaccagaacaacggcaccagcagccaggacaccgccgtgaccgacagcaagagaaccgccgaccccaagaacgcctggcaggacgcccaccccgccgaccccggcagcagaccccacctgatcagactgttcagcagagacgcccccggcagagaggacaacaccttcaaggacagacccagcgagagcgacgagctgcagaccatccaggaggacagcgccgccaccagcgagagcctggacgtgatggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggtgagcagcgaggagtag

SEQ ID NO: 89671 - DNA, 594 bp, Artificial Sequence; identical to SEQ ID NO: 89670
  Description of Artificial Sequence: Synthetic coding sequence

SEQ ID NO: 89672 - DNA, 483 bp, Artificial Sequence
  Description of Artificial Sequence: Synthetic coding sequence
atggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggacagccaccaccccgccagaaccgcccactacggcagcctgccccagaagagccacggcagaacccaggacgagaaccccgtggtgcacttcttcaagaacatcgtgacccccagaacccccccccccagccagggcaagggcgccgagggccagagacccggcttcggctacggcggcagagccagcgactacaagagcgcccacaagggcttcaagggcgtggacgcccagggcaccctgagcaagatcttcaagctgggcggcagagacagcagaagcggcagccccatggccagaagatag

SEQ ID NO: 89673 - DNA, 516 bp, Artificial Sequence
  Description of Artificial Sequence: Synthetic coding sequence
atggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggacagccaccaccccgccagaaccgcccactacggcagcctgccccagaagagccacggcagaacccaggacgagaaccccgtggtgcacttcttcaagaacatcgtgacccccagaacccccccccccagccagggcaagggcagaggcctgagcctgagcagattcagctggggcgccgagggccagagacccggcttcggctacggcggcagagccagcgactacaagagcgcccacaagggcttcaagggcgtggacgcccagggcaccctgagcaagatcttcaagctgggcggcagagacagcagaagcggcagccccatggccagaagatag

SEQ ID NO: 89674 - DNA, 261 bp, Artificial Sequence
  Description of Artificial Sequence: Synthetic coding sequence
atggccagccagaagagacccagccagagacacggcagcaagtacctggccaccgccagcaccatggaccacgccagacacggcttcctgcccagacacagagacaccggcatcctggacagcatcggcagattcttcggcggcgacagaggcgcccccaagagaggcagcggcaaggacagccaccaccccgccagaaccgcccactacggcagcctgccccagaagagccacggcagaacccaggacgagaacccctag

SEQ ID NO: 89675 - DNA, 888 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaagttcagcagcctgtgctacaagcagagaatcaagagccaggagagagagaccgaggccaccagaggcagaggcggcctgctgagagaccacatccccagaggcaaggaggagctggagagcctgggcggcggcaagaccccccccggcagatag

SEQ ID NO: 89676 - DNA, 642 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcggccagttcctggaggagctgctgttccacctggaggccctgagcggctag

SEQ ID NO: 89677 - DNA, 396 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccgaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89678 - DNA, 621 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgtgttccacctggaggccctgagcggctag

SEQ ID NO: 89679 - DNA, 759 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgctgttccacctggaggccctgagcggctag

SEQ ID NO: 89680 - DNA, 516 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggtgagccacagcgtgacccaggactggctgcagtggcacgaccacggcagcctgcagccccccccccccagactgaagtag

SEQ ID NO: 89681 - DNA, 744 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89682 - DNA, 396 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccgaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89683 - DNA, 744 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89684 - DNA, 744 bp, Artificial Sequence; identical to SEQ ID NO: 89683
  Description of Artificial Sequence: Synthetic coding sequence

SEQ ID NO: 89685 - DNA, 690 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgctgttccacctggaggccctgagcggctag

SEQ ID NO: 89686 - DNA, 642 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcggccagttcctggaggagctgctgttccacctggaggccctgagcggctag

SEQ ID NO: 89687 - DNA, 675 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgagaaaccccttctag

SEQ ID NO: 89688 - DNA, 675 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgagaaaccccttctag

SEQ ID NO: 89689 - DNA, 690 bp, Artificial Sequence; identical to SEQ ID NO: 89685
  Description of Artificial Sequence: Synthetic coding sequence

SEQ ID NO: 89690 - DNA, 642 bp, Artificial Sequence; identical to SEQ ID NO: 89676
  Description of Artificial Sequence: Synthetic coding sequence

SEQ ID NO: 89691 - DNA, 540 bp, Artificial Sequence
  Description of Artificial Sequence: Synthetic coding sequence
tgacagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcggccagttcctggaggagctgagaaaccccttctag

SEQ ID NO: 89692 - DNA, 396 bp, Artificial Sequence; identical to SEQ ID NO: 89682
  Description of Artificial Sequence: Synthetic coding sequence

SEQ ID NO: 89693 - DNA, 615 bp, Artificial Sequence
  Description of Artificial Sequence: Synthetic coding sequence
agcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgtgttccacctggaggccctgagcggctag

SEQ ID NO: 89694 - DNA, 396 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccgaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89695 - DNA, 675 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgagaaaccccttctag

SEQ ID NO: 89696 - DNA, 675 bp, Artificial Sequence; identical to SEQ ID NO: 89695
  Description of Artificial Sequence: Synthetic coding sequence

SEQ ID NO: 89697 - DNA, 675 bp, Artificial Sequence; identical to SEQ ID NO: 89695
  Description of Artificial Sequence: Synthetic coding sequence

SEQ ID NO: 89698 - DNA, 759 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgctgttccacctggaggccctgagcggctag

SEQ ID NO: 89699 - DNA, 744 bp, Artificial Sequence; identical to SEQ ID NO: 89683
  Description of Artificial Sequence: Synthetic coding sequence

SEQ ID NO: 89700 - DNA, 540 bp, Artificial Sequence; identical to SEQ ID NO: 89691
  Description of Artificial Sequence: Synthetic coding sequence

SEQ ID NO: 89701 - DNA, 540 bp, Artificial Sequence; identical to SEQ ID NO: 89691
  Description of Artificial Sequence: Synthetic coding sequence

SEQ ID NO: 89702 - DNA, 759 bp, Artificial Sequence; identical to SEQ ID NO: 89698
  Description of Artificial Sequence: Synthetic coding sequence

SEQ ID NO: 89703 - DNA, 690 bp, Artificial Sequence; identical to SEQ ID NO: 89685
  Description of Artificial Sequence: Synthetic coding sequence

SEQ ID NO: 89704 - DNA, 888 bp, Artificial Sequence; identical to SEQ ID NO: 89675
  Description of Artificial Sequence: Synthetic coding sequence

SEQ ID NO: 89705 - DNA, 642 bp, Artificial Sequence; identical to SEQ ID NO: 89676
  Description of Artificial Sequence: Synthetic coding sequence

SEQ ID NO: 89706 - DNA, 759 bp, Artificial Sequence; identical to SEQ ID NO: 89698
  Description of Artificial Sequence: Synthetic coding sequence

SEQ ID NO: 89707 - DNA, 540 bp, Artificial Sequence; identical to SEQ ID NO: 89691
  Description of Artificial Sequence: Synthetic coding sequence

SEQ ID NO: 89708 - DNA, 888 bp, Artificial Sequence; identical to SEQ ID NO: 89675
  Description of Artificial Sequence: Synthetic coding sequence

SEQ ID NO: 89709 - DNA, 888 bp, Artificial Sequence; identical to SEQ ID NO: 89675
  Description of Artificial Sequence: Synthetic coding sequence

SEQ ID NO: 89710 - DNA, 396 bp, Artificial Sequence; identical to SEQ ID NO: 89682
  Description of Artificial Sequence: Synthetic coding sequence

SEQ ID NO: 89711 - DNA, 759 bp, Artificial Sequence; identical to SEQ ID NO: 89698
  Description of Artificial Sequence: Synthetic coding sequence

SEQ ID NO: 89712 - DNA, 744 bp, Artificial Sequence; identical to SEQ ID NO: 89683
  Description of Artificial Sequence: Synthetic coding sequence

SEQ ID NO: 89713 - DNA, 615 bp, Artificial Sequence; identical to SEQ ID NO: 89693
  Description of Artificial Sequence: Synthetic coding sequence

SEQ ID NO: 89714 - DNA, 888 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaagttcagcagcctgtgctacaagcagagaatcaagagccaggagagagagaccgaggccaccagaggcagaggcggcctgctgagagaccacatccccagaggcaaggaggagctggagagcctgggcggcggcaagaccccccccggcagatag

SEQ ID NO: 89715 - DNA, 690 bp, Artificial Sequence; identical to SEQ ID NO: 89685
  Description of Artificial Sequence: Synthetic coding sequence

SEQ ID NO: 89716 - DNA, 396 bp, Artificial Sequence; identical to SEQ ID NO: 89682
  Description of Artificial Sequence: Synthetic coding sequence

SEQ ID NO: 89717 - DNA, 540 bp, Artificial Sequence
  Description of Artificial Sequence: Synthetic coding sequence
tgacagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcggccagttcctggaggagctgagaaaccccttctag

SEQ ID NO: 89718 - DNA, 627 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcggccagttcctggaggagctgagaaaccccttctag

SEQ ID NO: 89719 - DNA, 744 bp, Artificial Sequence; identical to SEQ ID NO: 89683
  Description of Artificial Sequence: Synthetic coding sequence

SEQ ID NO: 89720 - DNA, 396 bp, Artificial Sequence; identical to SEQ ID NO: 89682
  Description of Artificial Sequence: Synthetic coding sequence

SEQ ID NO: 89721 - DNA, 642 bp, Artificial Sequence; identical to SEQ ID NO: 89676
  Description of Artificial Sequence: Synthetic coding sequence

SEQ ID NO: 89722 - DNA, 615 bp, Artificial Sequence
  Description of Artificial Sequence: Synthetic coding sequence
agcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgtgttccacctggaggccctgagcggctag

SEQ ID NO: 89723 - DNA, 675 bp, Artificial Sequence; identical to SEQ ID NO: 89695
  Description of Artificial Sequence: Synthetic coding sequence

SEQ ID NO: 89724 - DNA, 690 bp, Artificial Sequence; identical to SEQ ID NO: 89685
  Description of Artificial Sequence: Synthetic coding sequence

SEQ ID NO: 89725 - DNA, 888 bp, Artificial Sequence; identical to SEQ ID NO: 89675
  Description of Artificial Sequence: Synthetic coding sequence

SEQ ID NO: 89726 - DNA, 540 bp, Artificial Sequence; identical to SEQ ID NO: 89691
  Description of Artificial Sequence: Synthetic coding sequence

SEQ ID NO: 89727 - DNA, 642 bp, Artificial Sequence; identical to SEQ ID NO: 89676
  Description of Artificial Sequence: Synthetic coding sequence

SEQ ID NO: 89728 - DNA, 759 bp, Artificial Sequence; identical to SEQ ID NO: 89698
  Description of Artificial Sequence: Synthetic coding sequence

SEQ ID NO: 89729 - DNA, 642 bp, Artificial Sequence; identical to SEQ ID NO: 89676
  Description of Artificial Sequence: Synthetic coding sequence

SEQ ID NO: 89730 - DNA, 675 bp, Artificial Sequence; identical to SEQ ID NO: 89695
  Description of Artificial Sequence: Synthetic coding sequence

SEQ ID NO: 89731 - DNA, 615 bp, Artificial Sequence; identical to SEQ ID NO: 89693
  Description of Artificial Sequence: Synthetic coding sequence

SEQ ID NO: 89732 - DNA, 675 bp, Artificial Sequence; identical to SEQ ID NO: 89695
  Description of Artificial Sequence: Synthetic coding sequence

SEQ ID NO: 89733 - DNA, 759 bp, Artificial Sequence; identical to SEQ ID NO: 89698
  Description of Artificial Sequence: Synthetic coding sequence

SEQ ID NO: 89734 - DNA, 744 bp, Artificial Sequence; identical to SEQ ID NO: 89683
  Description of Artificial Sequence: Synthetic coding sequence

SEQ ID NO: 89735 - DNA, 615 bp, Artificial Sequence; identical to SEQ ID NO: 89693
  Description of Artificial Sequence: Synthetic coding sequence

SEQ ID NO: 89736 - DNA, 888 bp, Artificial Sequence; identical to SEQ ID NO: 89675
  Description of Artificial Sequence: Synthetic coding sequence

SEQ ID NO: 89737 - DNA, 759 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgctgttccacctggaggccctgagcggctag

SEQ ID NO: 89738 - DNA, 540 bp, Artificial Sequence; identical to SEQ ID NO: 89691
  Description of Artificial Sequence: Synthetic coding sequence

SEQ ID NO: 89739 - DNA, 396 bp, Artificial Sequence; identical to SEQ ID NO: 89682
  Description of Artificial Sequence: Synthetic coding sequence

SEQ ID NO: 89740 - DNA, 744 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89741 - DNA, 642 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcggccagttcctggaggagctgctgttccacctggaggccctgagcggctag

SEQ ID NO: 89742 - DNA, 615 bp, Artificial Sequence; identical to SEQ ID NO: 89693
  Description of Artificial Sequence: Synthetic coding sequence

SEQ ID NO: 89743 - DNA, 690 bp, Artificial Sequence; identical to SEQ ID NO: 89685
  Description of Artificial Sequence: Synthetic coding sequence

SEQ ID NO: 89744 - DNA, 615 bp, Artificial Sequence; identical to SEQ ID NO: 89693
  Description of Artificial Sequence: Synthetic coding sequence

SEQ ID NO: 89745 - DNA, 690 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgctgttccacctggaggccctgagcggctag

SEQ ID NO: 89746 - DNA, 690 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgctgttccacctggaggccctgagcggctag

SEQ ID NO: 89747 - DNA, 516 bp, Artificial Sequence; identical to SEQ ID NO: 89680
  Description of Artificial Sequence: Synthetic coding sequence

SEQ ID NO: 89748 - DNA, 534 bp, Artificial Sequence
  Description of Artificial Sequence: Synthetic coding sequence
atgagccacatcagctgggaggagagatacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89749 - DNA, 174 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggcctggtggccgtggccagaagctggctgatcgccgccagcaccagccaggcccaggtgatcctgctgacccagcccctggagtag

SEQ ID NO: 89750 - DNA, 627 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcggccagttcctggaggagctgagaaaccccttctag

SEQ ID NO: 89751 - DNA, 516 bp, Artificial Sequence; identical to SEQ ID NO: 89680
  Description of Artificial Sequence: Synthetic coding sequence

SEQ ID NO: 89752 - DNA, 516 bp, Artificial Sequence; identical to SEQ ID NO: 89680
  Description of Artificial Sequence: Synthetic coding sequence

SEQ ID NO: 89753 - DNA, 621 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccgtgggcctggtgttcctgtgcctgcagtacagactgagaggcaagctgagagccgagatcgagaacctgcacagaaccttcgtgttccacctggaggccctgagcggctag

SEQ ID NO: 89754 - DNA, 627 bp, Artificial Sequence; identical to SEQ ID NO: 89750
  Description of Artificial Sequence: Synthetic coding sequence

SEQ ID NO: 89755 - DNA, 621 bp, Artificial Sequence; identical to SEQ ID NO: 89753
  Description of Artificial Sequence: Synthetic coding sequence

SEQ ID NO: 89756 - DNA, 534 bp, Artificial Sequence; identical to SEQ ID NO: 89748
  Description of Artificial Sequence: Synthetic coding sequence

SEQ ID NO: 89757 - DNA, 621 bp, Artificial Sequence; identical to SEQ ID NO: 89753
  Description of Artificial Sequence: Synthetic coding sequence

SEQ ID NO: 89758 - DNA, 621 bp, Artificial Sequence; identical to SEQ ID NO: 89753
  Description of Artificial Sequence: Synthetic coding sequence

SEQ ID NO: 89759 - DNA, 534 bp, Artificial Sequence; identical to SEQ ID NO: 89748
  Description of Artificial Sequence: Synthetic coding sequence

SEQ ID NO: 89760 - DNA, 621 bp, Artificial Sequence; identical to SEQ ID NO: 89753
  Description of Artificial Sequence: Synthetic coding sequence

SEQ ID NO: 89761 - DNA, 174 bp, Artificial Sequence; identical to SEQ ID NO: 89749
  Description of Artificial Sequence: Synthetic coding sequence

SEQ ID NO: 89762 - DNA, 621 bp, Artificial Sequence; identical to SEQ ID NO: 89753
  Description of Artificial Sequence: Synthetic coding sequence

SEQ ID NO: 89763 - DNA, 516 bp, Artificial Sequence; identical to SEQ ID NO: 89680
  Description of Artificial Sequence: Synthetic coding sequence

SEQ ID NO: 89764 - DNA, 621 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccggccagttcagagtgatcggccccagacaccccatcagagccctggtgggcgacgaggtggagctgccctgcagaatcagccccggcaagaacgccaccggcatggaggtgggctggtacagaccccccttcagcagagtggtgcacctgtacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgtgttccacctggaggccctgagcggctag

SEQ ID NO: 89765 - DNA, 516 bp, Artificial Sequence; identical to SEQ ID NO: 89680
  Description of Artificial Sequence: Synthetic coding sequence

SEQ ID NO: 89766 - DNA, 516 bp, Artificial Sequence; identical to SEQ ID NO: 89680
  Description of Artificial Sequence: Synthetic coding sequence

SEQ ID NO: 89767 - DNA, 627 bp, Artificial Sequence; identical to SEQ ID NO: 89750
  Description of Artificial Sequence: Synthetic coding sequence

SEQ ID NO: 89768 - DNA, 174 bp, Artificial Sequence; identical to SEQ ID NO: 89749
  Description of Artificial Sequence: Synthetic coding sequence

SEQ ID NO: 89769 - DNA, 627 bp, Artificial Sequence; identical to SEQ ID NO: 89750
  Description of Artificial Sequence: Synthetic coding sequence

SEQ ID NO: 89770 - DNA, 174 bp, Artificial Sequence; identical to SEQ ID NO: 89749
  Description of Artificial Sequence: Synthetic coding sequence

SEQ ID NO: 89771 - DNA, 534 bp, Artificial Sequence; identical to SEQ ID NO: 89748
  Description of Artificial Sequence: Synthetic coding sequence

SEQ ID NO: 89772 - DNA, 516 bp, Artificial Sequence; identical to SEQ ID NO: 89680
  Description of Artificial Sequence: Synthetic coding sequence

SEQ ID NO: 89773 - DNA, 534 bp, Artificial Sequence
  Description of Artificial Sequence: Synthetic coding sequence
atgagccacatcagctgggaggagagatacagaaacggcaaggaccaggacggcgaccaggcccccgagtacagaggcagaaccgagctgctgaaggacgccatcggcgagggcaaggtgaccctgagaatcagaaacgtgagattcagcgacgagggcggcttcacctgcttcttcagagaccacagctaccaggaggaggccgccatggagctgaaggtggaggaccccttctactgggtgagccccggcgtgctggtgctgctggccgtgctgcccgtgctgctgctgcagatcaccctgggcctggtgttcctgtgcctgcagtacagactgagaggcaagctgagagccgagatcgagaacctgcacagaaccttcgacccccacttcctgagagtgccctgctggaagatcaccctgttcgtgatcgtgcccgtgctgggccccctggtggccctgatcatctgctacaactggctgcacagaagactggccggccagttcctggaggagctgagaaaccccttctag

SEQ ID NO: 89774 - DNA, 627 bp, Artificial Sequence; identical to SEQ ID NO: 89750
  Description of Artificial Sequence: Synthetic coding sequence

SEQ ID NO: 89775 - DNA, 174 bp, Artificial Sequence; identical to SEQ ID NO: 89749
  Description of Artificial Sequence: Synthetic coding sequence

SEQ ID NO: 89776 - DNA, 174 bp, Artificial Sequence; identical to SEQ ID NO: 89749
  Description of Artificial Sequence: Synthetic coding sequence

SEQ ID NO: 89777 - DNA, 534 bp, Artificial Sequence; identical to SEQ ID NO: 89748
  Description of Artificial Sequence: Synthetic coding sequence

SEQ ID NO: 89778 - DNA, 516 bp, Artificial Sequence; identical to SEQ ID NO: 89680
  Description of Artificial Sequence: Synthetic coding sequence

SEQ ID NO: 89779 - DNA, 534 bp, Artificial Sequence; identical to SEQ ID NO: 89748
  Description of Artificial Sequence: Synthetic coding sequence

SEQ ID NO: 89780 - DNA, 174 bp, Artificial Sequence; identical to SEQ ID NO: 89749
  Description of Artificial Sequence: Synthetic coding sequence

SEQ ID NO: 89781 - DNA, 627 bp, Artificial Sequence; identical to SEQ ID NO: 89750
  Description of Artificial Sequence: Synthetic coding sequence

SEQ ID NO: 89782 - DNA, 327 bp, Artificial Sequence
  Description of Artificial Sequence: Synthetic coding sequence
atggccagcctgagcagacccagcctgcccagctgcctgtgcagcttcctgctgctgctgctgctgcaggtgagcagcagctacgccgaccccttctactgggtgagccccggcgtgctggtgctgctggccgtgctgcccgtgctgctgctgcagatcaccgtgggcctgatcttcctgtgcctgcagtacagactgagaggcaagctgagagccgagatcgagaacctgcacagaaccttcgagagcttcggcgtgctgggcccccaggtgaaggagcccaagaagaccggccagttcctggaggagctgagaaaccccttctag

SEQ ID NO: 89783 - DNA, 753 bp, Artificial Sequence
  Description of Artificial Sequence: Synthetic coding sequence
atggcccccggcgcccccagcagcagccccagccccatcctggccgtgctgctgttcagcagcctggtgctgagccccgcccaggccatcgtggtgtacaccgacagagaggtgcacggcgccgtgggcagcagagtgaccctgcactgcagcttctggagcagcgagtgggtgagcgacgacatcagcttcacctggagataccagcccgagggcggcagagacgccatcagcatcttccactacgccaagggccagccctacatcgacgaggtgggcaccttcaaggagagaatccagtgggtgggcgaccccagatggaaggacggcagcatcgtgatccacaacctggactacagcgacaacggcaccttcacctgcgacgtgaagaacccccccgacatcgtgggcaagaccagccaggtgaccctgtacgtgttcgagaaggtgcccaccagatacggcgtggtgctgggcgccgtgatcggcggcgtgctgggcgtggtgctgctgctgctgctgctgttctacgtggtgagatactgctggctgagaagacaggccgccctgcagagaagactgagcgccatggagaagggcaagctgcacaagcccggcaaggacgccagcaagagaggcagacagacccccgtgctgtaccagtgctggaccaccgccgaggcccccaagctgagcgtgagaagaagacccagaggctggggcagcctggccagaatcagaaacagcggctag

SEQ ID NO: 89784 - DNA, 777 bp, Artificial Sequence
  Description of Artificial Sequence: Synthetic coding sequence
atgctgagagcccccgcccccgcccccgccatggcccccggcgcccccagcagcagccccagccccatcctggccgtgctgctgttcagcagcctggtgctgagccccgcccaggccatcgtggtgtacaccgacagagaggtgcacggcgccgtgggcagcagagtgaccctgcactgcagcttctggagcagcgagtgggtgagcgacgacatcagcttcacctggagataccagcccgagggcggcagagacgccatcagcatcttccactacgccaagggccagccctacatcgacgaggtgggcaccttcaaggagagaatccagtgggtgggcgaccccagatggaaggacggcagcatcgtgatccacaacctggactacagcgacaacggcaccttcacctgcgacgtgaagaacccccccgacatcgtgggcaagaccagccaggtgaccctgtacgtgttcgagaaggtgcccaccagatacggcgtggtgctgggcgccgtgatcggcggcgtgctgggcgtggtgctgctgctgctgctgctgttctacgtggtgagatactgctggctgagaagacaggccgccctgcagagaagactgagcgccatggagaagggcaagctgcacaagcccggcaaggacgccagcaagagaggcagacagacccccgtgctgtacgccatgctggaccacagcagaagcaccaaggccgtgagcgagaagaaggccaagggcctgggcgagagcagaaaggacaagaagtag

SEQ ID NO: 89785 - DNA, 747 bp, Artificial Sequence
  Description of Artificial Sequence: Synthetic coding sequence
atggcccccggcgcccccagcagcagccccagccccatcctggccgtgctgctgttcagcagcctggtgctgagccccgcccaggccatcgtggtgtacaccgacagagaggtgcacggcgccgtgggcagcagagtgaccctgcactgcagcttctggagcagcgagtgggtgagcgacgacatcagcttcacctggagataccagcccgagggcggcagagacgccatcagcatcttccactacgccaagggccagccctacatcgacgaggtgggcaccttcaaggagagaatccagtgggtgggcgaccccagatggaaggacggcagcatcgtgatccacaacctggactacagcgacaacggcaccttcacctgcgacgtgaagaacccccccgacatcgtgggcaagaccagccaggtgaccctgtacgtgttcgagaaggtgcccaccagatacggcgtggtgctgggcgccgtgatcggcggcgtgctgggcgtggtgctgctgctgctgctgctgttctacgtggtgagatactgctggctgagaagacaggccgccctgcagagaagactgagcgccatggagaagggcaagctgcacaagcccggcaaggacgccagcaagagaggcagacagacccccgtgctgtacgccatgctggaccacagcagaagcaccaaggccgtgagcgagaagaaggccaagggcctgggcgagagcagaaaggacaagaagtag

SEQ ID NO: 89786 - DNA, 747 bp, Artificial Sequence; identical to SEQ ID NO: 89785
  Description of Artificial Sequence: Synthetic coding sequence

SEQ ID NO: 89787 - DNA, 648 bp, Artificial Sequence
  Description of Artificial Sequence: Synthetic coding sequence
atgtacggcaagagcagcaccagagccgtgctgctgctgctgggcatccagctgaccgccctgtggcccatcgccgccgtggagatctacaccagcagagtgctggaggccgtgaacggcaccgacgccagactgaagtgcaccttcagcagcttcgcccccgtgggcgacgccctgaccgtgacctggaacttcagacccctggacggcggccccgagcagttcgtgttctactaccacatcgaccccttccagcccatgagcggcagattcaaggacagagtgagctgggacggcaaccccgagagatacgacgccagcatcctgctgtggaagctgcagttcgacgacaacggcacctacacctgccaggtgaagaacccccccgacgtggacggcgtgatcggcgagatcagactgagcgtggtgcacaccgtgagattcagcgagatccacttcctggccctggccatcggcagcgcctgcgccctgatgatcatcatcgtgatcgtggtggtgctgttccagcactacagaaagaagagatgggccgagagagcccacaaggtggtggagatcaagagcaaggaggaggagagactgaaccaggagaagaaggtgagcgtgtacctggaggacaccgactag

SEQ ID NO: 89788 - DNA, 648 bp, Artificial Sequence; identical to SEQ ID NO: 89787
  Description of Artificial Sequence: Synthetic coding sequence

SEQ ID NO: 89789 - DNA, 708 bp, Artificial Sequence
  Description of Artificial Sequence: Synthetic coding sequence
atgcagcagagaggcgccgccggcagcagaggctgcgccctgttccccctgctgggcgtgctgttcttccagggcgtgtacatcgtgttcagcctggagatcagagccgacgcccacgtgagaggctacgtgggcgagaagatcaagctgaagtgcaccttcaagagcaccagcgacgtgaccgacaagctgaccatcgactggacctacagaccccccagcagcagccacaccgtgagcatcttccactaccagagcttccagtaccccaccaccgccggcaccttcagagacagaatcagctgggtgggcaacgtgtacaagggcgacgccagcatcagcatcagcaaccccaccatcaaggacaacggcaccttcagctgcgccgtgaagaacccccccgacgtgcaccacaacatccccatgaccgagctgaccgtgaccgagagaggcttcggcaccatgctgagcagcgtggccctgctgagcatcctggtgttcgtgcccagcgccgtggtggtggccctgctgctggtgagaatgggcagaaaggccgccggcctgaagaagagaagcagaagcggctacaagaagagcagcatcgaggtgagcgacgacaccgaccaggaggaggaggaggcctgcatggccagactgtgcgtgagatgcgccgagtgcctggacagcgactacgaggagacctactag

SEQ ID NO: 89790 - DNA, 672 bp, Artificial Sequence
  Description of Artificial Sequence: Synthetic coding sequence
atgcagcagagaggcgccgccggcagcagaggctgcgccctgttccccctgctgggcgtgctgttcttccaggacgcccacgtgagaggctacgtgggcgagaagatcaagctgaagtgcaccttcaagagcaccagcgacgtgaccgacaagctgaccatcgactggacctacagaccccccagcagcagccacaccgtgagcatcttccactaccagagcttccagtaccccaccaccgccggcaccttcagagacagaatcagctgggtgggcaacgtgtacaagggcgacgccagcatcagcatcagcaaccccaccatcaaggacaacggcaccttcagctgcgccgtgaagaacccccccgacgtgcaccacaacatccccatgaccgagctgaccgtgaccgagagaggcttcggcaccatgctgagcagcgtggccctgctgagcatcctggtgttcgtgcccagcgccgtggtggtggccctgctgctggtgagaatgggcagaaaggccgccggcctgaagaagagaagcagaagcggctacaagaagagcagcatcgaggtgagcgacgacaccgaccaggaggaggaggaggcctgcatggccagactgtgcgtgagatgcgccgagtgcctggacagcgactacgaggagacctactag

SEQ ID NO: 89791 - DNA, 3366 bp, Artificial Sequence
  Description of Artificial Sequence: Synthetic coding sequence
atgagcctggagaacgaggacaagagagccagaaccagaagcaaggccctgagaggcccccccgagaccaccgccgccgacctgagctgccccacccccggctgcaccggcagcggccacgtgagaggcaagtacagcagacacagaagcctgcagagctgccccctggccaagaagagaaagctggagggcgccgaggccgagcacctggtgagcaagagaaagagccaccccctgaagctggccctggacgagggctacggcgtggacagcgacggcagcgaggacaccgaggtgaaggacgccagcgtgagcgacgagagcgagggcaccctggagggcgccgaggccgagaccagcggccaggacgagatccacagacccgagaccgccgagggcagaagccccgtgaagagccacttcggcagcaaccccatcggcagcgccaccgccagcagcaagggcagctacagcagctaccagggcatcatcgccaccagcctgctgaacctgggccagatcgccgaggagaccctggtggaggaggacctgggccaggccgccaagcccggccccggcatcgtgcacctgctgcaggaggccgccgagggcgccgccagcgaggagggcgagaagggcctgttcatccagcccgaggacgccgaggaggtggtggaggtgaccaccgagagaagccaggacctgtgcccccagagcctggaggacgccgccagcgaggagagcagcaagcagaagggcatcctgagccacgaggaggaggacgaggaggaggaggaggaggaggaggaggaggaggaggacgaggaggaggaggaggaggaggaggaggaggaggaggaggaggaggaggaggaggaggaggaggaggaggaggaggaggaggaggaggaggaggaggccgcccccgacgtgatcttccaggaggacaccagccacaccagcgcccagaaggcccccgagctgagaggccccgagagccccagccccaagcccgagtacagcgtgatcgtggaggtgagaagcgacgacgacaaggacgaggacacccacagcagaaagagcaccgtgaccgacgagagcgagatgcaggacatgatgaccagaggcaacctgggcctgctggagcaggccatcgccctgaaggccgagcaggtgagaaccgtgtgcgagcccggctgcccccccgccgagcagagccagctgggcctgggcgagcccggcaaggccgccaagcccctggacaccgtgagaaagagctactacagcaaggaccccagcagagccgagaagagagagatcaagtgccccacccccggctgcgacggcaccggccacgtgaccggcctgtacccccaccacagaagcctgagcggctgcccccacaaggacagaatcccccccgagatcctggccatgcacgagaacgtgctgaagtgccccacccccggctgcaccggccagggccacgtgaacagcaacagaaacacccacagaagcctgagcggctgccccatcgccgccgccgagaagctggccaagagccacgagaagcagcagccccagaccggcgaccccagcaagagcagcagcaacagcgacagaatcctgagacccatgtgcttcgtgaagcagctggaggtgcccccctacggcagctacagacccaacgtggcccccgccacccccagagccaacctggccaaggagctggagaagttcagcaaggtgaccttcgactacgccagcttcgacgcccaggtgttcggcaagagaatgctggcccccaagatccagaccagcgagaccagccccaaggccttccagtgcttcgactacagccaggacgccgaggccgcccacatggccgccaccgccatcctgaacctgagcaccagatgctgggagatgcccgagaacctgagcaccaagccccaggacctgcccagcaagagcgtggacatcgaggtggacgagaacggcaccctggacctgagcatgcacaagcacagaaagagagagaacgccttccccagcagcagcagctgcagcagcagccccggcgtgaagagccccgacgccagccagagacacagcagcaccagcgcccccagcagcagcatgaccagcccccagagcagccaggccagcagacaggacgagtgggacagacccctggactacaccaagcccagcagactgagagaggaggagcccgaggagagcgagcccgccgcccacagcttcgccagcagcgaggccgacgaccaggaggtgagcgaggagaacttcgaggagagaaagtaccccggcgaggtgaccctgaccaacttcaagctgaagttcctgagcaaggacatcaagaaggagctgctgacctgccccacccccggctgcgacggcagcggccacatcaccggcaactacgccagccacagaagcctgagcggctgccccctggccgacaagagcctgagaaacctgatggccgcccacagcgccgacctgaagtgccccacccccggctgcgacggcagcggccacatcaccggcaactacgccagccacagaagcctgagcggctgccccagagccaagaagagcggcgtgaaggtggcccccaccaaggacgacaaggaggaccccgagctgatgaagtgccccgtgcccggctgcgtgggcctgggccacatcagcggcaagtacgccagccacagaagcgccagcggctgccccctggccgccagaagacagaaggagggcagcctgaacggcagcagcttcagctggaagagcctgaagaacgagggccccacctgccccacccccggctgcgacggcagcggccacgccaacggcagcttcctgacccacagaagcctgagcggctgccccagagccaccttcgccggcaagaagggcaagctgagcggcgacgaggtgctgagccccaagttcaagaccagcgacgtgctggagaacgacgaggagatcaagcagctgaaccaggagatcagagacctgaacgagagcaacagcgagatggaggccgccatggtgcagctgcagagccagatcagcagcatggagaagaacctgaagaacatcgaggaggagaacaagctgatcgaggagcagaacgaggccctgttcctggagctgagcggcctgagccaggccctgatccagagcctggccaacatcagactgccccacatggagcccatctgcgagcagaacttcgacgcctacgtgagcaccctgaccgacatgtacagcaaccaggaccccgagaacaaggacctgctggagagcatcaagcaggccgtgagaggcatccaggtgtag

SEQ ID NO: 89792 - DNA, 1776 bp, Artificial Sequence
  Description of Artificial Sequence: Synthetic coding sequence
atgagcctggagaacgaggacaagagagccagaaccagaagcaaggccctgagaggcccccccgagaccaccgccgccgacctgagctgccccacccccggctgcaccggcagcggccacgtgagaggcaagtacagcagacacagaagcctgcagagctgccccctggccaagaagagaaagctggagggcgccgaggccgagcacctggtgagcaagagaaagagccaccccctgaagctggccctggacgagggctacggcgtggacagcgacggcagcgaggacaccgaggtgaaggacgccagcgtgagcgacgagagcgagggcaccctggagggcgccgaggccgagaccagcggccaggacgagatccacagacccgagaccgccgaggaccccagcagagccgagaagagagagatcaagtgccccacccccggctgcgacggcaccggccacgtgaccggcctgtacccccaccacagaagcctgagcggctgcccccacaaggacagaatcccccccgagatcctggccatgcacgagaacgtgctgaagtgccccacccccggctgcaccggccagggccacgtgaacagcaacagaaacacccacagaagcctgagcggctgccccatcgccgccgccgagaagctggccaagagccacgagaagcagcagccccagaccggcgaccccagcaagagcagcagcaacagcgacagaatcctgagacccatgtgcttcgtgaagcagctggaggtgcccccctacggcagctacagacccaacgtggcccccgccacccccagagccaacctggccaaggagctggagaagttcagcaaggtgaccttcgactacgccagcttcgacgcccaggtgttcggcaagagaatgctggcccccaagatccagaccagcgagaccagccccaaggccttccagtgcttcgactacagccaggacgccgaggccgcccacatggccgccaccgccatcctgaacctgagcaccagatgctgggagatgcccgagaacctgagcaccaagccccaggacctgcccagcaagagcgtggacatcgaggtggacgagaacggcaccctggacctgagcatgcacaagcacagaaagagagagaacgccttccccagcagcagcagctgcagcagcagccccggcgtgaagagccccgacgccagccagagacacagcagcaccagcgcccccagcagcagcatgaccagcccccagagcagccaggccagcagacaggacgagtgggacagacccctggactacaccaagcccagcagactgagagaggaggagcccgaggagagcgagcccgccgcccacagcttcgccagcagcgaggccgacgaccaggaggtgagcgaggagaacttcgaggagagaaagtaccccggcgaggtgaccctgaccaacttcaagctgaagttcctgagcaaggacatcaagaaggagctgctgacctgccccacccccggctgcgacggcagcggccacatcaccggcaactacgccagccacagaagatgccccacccccggctgcgacggcagcggccacatcaccggcaactacgccagccacagaagcctgagcggctgccccagagccaagaagagcggcgtgaaggtggcccccaccaaggacgacaaggaggaccccgagctgatgaagtacgtgggcccctgctggctgttccactgcatcgccgagctgagattcagctgcgtgctgtag

SEQ ID NO: 89793 - DNA, 3447 bp, Artificial Sequence
  Description of Artificial Sequence: Synthetic coding sequence
atgagcctggagaacgaggacaagagagccagaaccagaagcaaggccctgagaggcccccccgagaccaccgccgccgacctgagctgccccacccccggctgcaccggcagcggccacgtgagaggcaagtacagcagacacagaagcctgcagagctgccccctggccaagaagagaaagctggagggcgccgaggccgagcacctggtgagcaagagaaagagccaccccctgaagctggccctggacgagggctacggcgtggacagcgacggcagcgaggacaccgaggtgaaggacgccagcgtgagcgacgagagcgagggcaccctggagggcgccgaggccgagaccagcggccaggacgagatccacagacccgagaccgccgagggcagaagccccgtgaagagccacttcggcagcaaccccatcggcagcgccaccgccagcagcaagggcagctacagcagctaccagggcatcatcgccaccagcctgctgaacctgggccagatcgccgaggagaccctggtggaggaggacctgggccaggccgccaagcccggccccggcatcgtgcacctgctgcaggaggccgccgagggcgccgccagcgaggagggcgagaagggcctgttcatccagcccgaggacgccgaggaggtggtggaggtgaccaccgagagaagccaggacctgtgcccccagagcctggaggacgccgccagcgaggagagcagcaagcagaagggcatcctgagccacgaggaggaggacgaggaggaggaggaggaggaggaggaggaggaggaggacgaggaggaggaggaggaggaggaggaggaggaggaggaggaggaggaggaggaggaggaggaggaggaggaggaggaggaggaggaggaggaggaggccgcccccgacgtgatcttccaggaggacaccagccacaccagcgcccagaaggcccccgagctgagaggccccgagagccccagccccaagcccgagtacagcgtgatcgtggaggtgagaagcgacgacgacaaggacgaggacacccacagcagaaagagcaccgtgaccgacgagagcgagatgcaggacatgatgaccagaggcaacctgggcctgctggagcaggccatcgccctgaaggccgagcaggtgagaaccgtgtgcgagcccggctgcccccccgccgagcagagccagctgggcctgggcgagcccggcaaggccgccaagcccctggacaccgtgagaaagagctactacagcaaggaccccagcagagccgagaagagagagatcaagtgccccacccccggctgcgacggcaccggccacgtgaccggcctgtacccccaccacagaagcctgagcggctgcccccacaaggacagaatcccccccgagatcctggccatgcacgagaacgtgctgaagtgccccacccccggctgcaccggccagggccacgtgaacagcaacagaaacacccacagaagcctgagcggctgccccatcgccgccgccgagaagctggccaagagccacgagaagcagcagccccagaccggcgaccccagcaagagcagcagcaacagcgacagaatcctgagacccatgtgcttcgtgaagcagctggaggtgcccccctacggcagctacagacccaacgtggcccccgccacccccagagccaacctggccaaggagctggagaagttcagcaaggtgaccttcgactacgccagcttcgacgcccaggtgttcggcaagagaatgctggcccccaagatccagaccagcgagaccagccccaaggccttccagagcaagcccttccccaaggccagcagccccagacacagccccagcagcagctacgtgagaagcaccagcagcagcagcgccggcttcgactacagccaggacgccgaggccgcccacatggccgccaccgccatcctgaacctgagcaccagatgctgggagatgcccgagaacctgagcaccaagccccaggacctgcccagcaagagcgtggacatcgaggtggacgagaacggcaccctggacctgagcatgcacaagcacagaaagagagagaacgccttccccagcagcagcagctgcagcagcagccccggcgtgaagagccccgacgccagccagagacacagcagcaccagcgcccccagcagcagcatgaccagcccccagagcagccaggccagcagacaggacgagtgggacagacccctggactacaccaagcccagcagactgagagaggaggagcccgaggagagcgagcccgccgcccacagcttcgccagcagcgaggccgacgaccaggaggtgagcgaggagaacttcgaggagagaaagtaccccggcgaggtgaccctgaccaacttcaagctgaagttcctgagcaaggacatcaagaaggagctgctgacctgccccacccccggctgcgacggcagcggccacatcaccggcaactacgccagccacagaagcctgagcggctgccccctggccgacaagagcctgagaaacctgatggccgcccacagcgccgacctgaagtgccccacccccggctgcgacggcagcggccacatcaccggcaactacgccagccacagaagcctgagcggctgccccagagccaagaagagcggcgtgaaggtggcccccaccaaggacgacaaggaggaccccgagctgatgaagtgccccgtgcccggctgcgtgggcctgggccacatcagcggcaagtacgccagccacagaagcgccagcggctgccccctggccgccagaagacagaaggagggcagcctgaacggcagcagcttcagctggaagagcctgaagaacgagggccccacctgccccacccccggctgcgacggcagcggccacgccaacggcagcttcctgacccacagaagcctgagcggctgccccagagccaccttcgccggcaagaagggcaagctgagcggcgacgaggtgctgagccccaagttcaagaccagcgacgtgctggagaacgacgaggagatcaagcagctgaaccaggagatcagagacctgaacgagagcaacagcgagatggaggccgccatggtgcagctgcagagccagatcagcagcatggagaagaacctgaagaacatcgaggaggagaacaagctgatcgaggagcagaacgaggccctgttcctggagctgagcggcctgagccaggccctgatccagagcctggccaacatcagactgccccacatggagcccatctgcgagcagaacttcgacgcctacgtgagcaccctgaccgacatgtacagcaaccaggaccccgagaacaaggacctgctggagagcatcaagcaggccgtgagaggcatccaggtgtag

SEQ ID NO: 89794 - DNA, 3399 bp, Artificial Sequence
  Description of Artificial Sequence: Synthetic coding sequence
atggaggtggacaccgaggagaagagacacagaaccagaagcaagggcgtgagagtgcccgtggagcccgccatccaggagctgttcagctgccccacccccggctgcgacggcagcggccacgtgagcggcaagtacgccagacacagaagcgtgtacggctgccccctggccaagaagagaaagacccaggacaagcagccccaggagcccgcccccaagagaaagcccttcgccgtgaaggccgacagcagcagcgtggacgagtgcgacgacagcgacggcaccgaggacatggacgagaaggaggaggacgaggaggaggaggaggaggaggaggaggagaacgaggaccaccagatgaactgccacaacaccagaatcatgcaggacaccgagaaggacgacaacaacaacgacgagtacgacaactacgacgagctggtggccaagagcctgctgaacctgggcaagatcgccgaggacgccgcctacagagccagaaccgagagcgagatgaacagcaacaccagcaacagcctggaggacgacagcgacaagaacgagaacctgggcagaaagagcgagctgagcctggacctggacagcgacgtggtgagagagaccgtggacagcctgaagctgctggcccagggccacggcgtggtgctgagcgagaacatgaacgacagaaactacgccgacagcatgagccagcaggacagcagaaacatgaactacgtgatgctgggcaagcccatgaacaacggcctgatggagaagatggtggaggagagcgacgaggaggtgtgcctgagcagcctggagtgcctgagaaaccagtgcttcgacctggccagaaagctgagcgagaccaacccccaggagagaaacccccagcagaacatgaacatcagacagcacgtgagacccgaggaggacttccccggcagaacccccgacagaaactacagcgacatgctgaacctgatgagactggaggagcagctgagccccagaagcagagtgttcgccagctgcgccaaggaggacggctgccacgagagagacgacgacaccaccagcgtgaacagcgacagaagcgaggaggtgttcgacatgaccaagggcaacctgaccctgctggagaaggccatcgccctggagaccgagagagccaaggccatgagagagaagatggccatggaggccggcagaagagacaacatgagaagctacgaggaccagagccccagacagctgcccggcgaggacagaaagcccaagagcagcgacagccacgtgaagaagccctactacgaccccagcagaaccgagaagaaggagagcaagtgccccacccccggctgcgacggcaccggccacgtgaccggcctgtacccccaccacagaagcctgagcggctgcccccacaaggacagagtgccccccgagatcctggccatgcacgagagcgtgctgaagtgccccacccccggctgcaccggcagaggccacgtgaacagcaacagaaacagccacagaagcctgagcggctgccccatcgccgccgccgagaagctggccaaggcccaggagaagcaccagagctgcgacgtgagcaagagcagccaggccagcgacagagtgctgagacccatgtgcttcgtgaagcagctggagatcccccagtacggctacagaaacaacgtgcccaccaccacccccagaagcaacctggccaaggagctggagaagtacagcaagaccagcttcgagtacaacagctacgacaaccacacctacggcaagagagccatcgcccccaaggtgcagaccagagacatcagccccaagggctacgacgacgccaagagatactgcaaggaccccagccccagcagcagcagcaccagcagctacgcccccagcagcagcagcaacctgagctgcggcggcggcagcagcgccagcagcacctgcagcaagagcagcttcgactacacccacgacatggaggccgcccacatggccgccaccgccatcctgaacctgagcaccagatgcagagagatgccccagaacctgagcaccaagccccaggacctgtgcgccaccagaaaccccgacatggaggtggacgagaacggcaccctggacctgagcatgaacaagcagagacccagagacagctgctgccccatcctgacccccctggagcccatgagcccccagcagcaggccgtgatgaacaacagatgcttccagctgggcgagggcgactgctgggacctgcccgtggactacaccaagatgaagcccagaagaatcgacgaggacgagagcaaggacatcacccccgaggacctggaccccttccaggaggccctggaggagagaagataccccggcgaggtgaccatccccagccccaagcccaagtacccccagtgcaaggagagcaagaaggacctgatcaccctgagcggctgccccctggccgacaagagcatcagaagcatgctggccaccagcagccaggagctgaagtgccccacccccggctgcgacggcagcggccacatcaccggcaactacgccagccacagaagcctgagcggctgccccagagccaagaagagcggcatcagaatcgcccagagcaaggaggacaaggaggaccaggagcccatcagatgccccgtgcccggctgcgacggccagggccacatcaccggcaagtacgccagccacagaagcgccagcggctgccccctggccgccaagagacagaaggacggctacctgaacggcagccagttcagctggaagagcgtgaagaccgagggcatgagctgccccacccccggctgcgacggcagcggccacgtgagcggcagcttcctgacccacagaagcctgagcggctgccccagagccaccagcgccatgaagaaggccaagctgagcggcgagcagatgctgaccatcaagcagagagccagcaacggcatcgagaacgacgaggagatcaagcagctggacgaggagatcaaggagctgaacgagagcaacagccagatggaggccgacatgatcaagctgagaacccagatcaccaccatggagagcaacctgaagaccatcgaggaggagaacaaggtgatcgagcagcagaacgagagcctgctgcacgagctggccaacctgagccagagcctgatccacagcctggccaacatccagctgccccacatggaccccatcaacgagcagaacttcgacgcctacgtgaccaccctgaccgagatgtacaccaaccaggacagataccagagccccgagaacaaggccctgctggagaacatcaagcaggccgtgagaggcatccaggtgtag

SEQ ID NO: 89795 - DNA, 3561 bp, Artificial Sequence
  Description of Artificial Sequence: Synthetic coding sequence
atggaggtggacaccgaggagaagagacacagaaccagaagcaagggcgtgagagtgcccgtggagcccgccatccaggagctgttcagctgccccacccccggctgcgacggcagcggccacgtgagcggcaagtacgccagacacagaagcgtgtacggctgccccctggccaagaagagaaagacccaggacaagcagccccaggagcccgcccccaagagaaagcccttcgccgtgaaggccgacagcagcagcgtggacgagtgcgacgacagcgacggcaccgaggacatggacgagaaggaggaggacgagggcgaggagtacagcgaggacaacgacgagcccggcgacgaggacgaggaggacgaggagggcgacagagaggaggaggaggagatcgaggaggaggacgaggacgacgacgaggacggcgaggacgtggaggacgaggaggaggaggaggaggaggaggaggaggaggaggaggaggaggagaacgaggaccaccagatgaactgccacaacaccagaatcatgcaggacaccgagaaggacgacaacaacaacgacgagtacgacaactacgacgagctggtggccaagagcctgctgaacctgggcaagatcgccgaggacgccgcctacagagccagaaccgagagcgagatgaacagcaacaccagcaacagcctggaggacgacagcgacaagaacgagaacctgggcagaaagagcgagctgagcctggacctggacagcgacgtggtgagagagaccgtggacagcctgaagctgctggcccagggccacggcgtggtgctgagcgagaacatgaacgacagaaactacgccgacagcatgagccagcaggacagcagaaacatgaactacgtgatgctgggcaagcccatgaacaacggcctgatggagaagatggtggaggagagcgacgaggaggtgtgcctgagcagcctggagtgcctgagaaaccagtgcttcgacctggccagaaagctgagcgagaccaacccccaggagagaaacccccagcagaacatgaacatcagacagcacgtgagacccgaggaggacttccccggcagaacccccgacagaaactacagcgacatgctgaacctgatgagactggaggagcagctgagccccagaagcagagtgttcgccagctgcgccaaggaggacggctgccacgagagagacgacgacaccaccagcgtgaacagcgacagaagcgaggaggtgttcgacatgaccaagggcaacctgaccctgctggagaaggccatcgccctggagaccgagagagccaaggccatgagagagaagatggccatggaggccggcagaagagacaacatgagaagctacgaggaccagagccccagacagctgcccggcgaggacagaaagcccaagagcagcgacagccacgtgaagaagccctactacggcaaggaccccagcagaaccgagaagaaggagagcaagtgccccacccccggctgcgacggcaccggccacgtgaccggcctgtacccccaccacagaagcctgagcggctgcccccacaaggacagagtgccccccgagatcctggccatgcacgagagcgtgctgaagtgccccacccccggctgcaccggcagaggccacgtgaacagcaacagaaacagccacagaagcctgagcggctgccccatcgccgccgccgagaagctggccaaggcccaggagaagcaccagagctgcgacgtgagcaagagcagccaggccagcgacagagtgctgagacccatgtgcttcgtgaagcagctggagatcccccagtacggctacagaaacaacgtgcccaccaccacccccagaagcaacctggccaaggagctggagaagtacagcaagaccagcttcgagtacaacagctacgacaaccacacctacggcaagagagccatcgcccccaaggtgcagaccagagacatcagccccaagggctacgacgacgccaagagatactgcaaggaccccagccccagcagcagcagcaccagcagctacgcccccagcagcagcagcaacctgagctgcggcggcggcagcagcgccagcagcacctgcagcaagagcagcttcgactacacccacgacatggaggccgcccacatggccgccaccgccatcctgaacctgagcaccagatgcagagagatgccccagaacctgagcaccaagccccaggacctgtgcgccaccagaaaccccgacatggaggtggacgagaacggcaccctggacctgagcatgaacaagcagagacccagagacagctgctgccccatcctgacccccctggagcccatgagcccccagcagcaggccgtgatgaacaacagatgcttccagctgggcgagggcgactgctgggacctgcccgtggactacaccaagatgaagcccagaagaatcgacgaggacgagagcaaggacatcacccccgaggacctggaccccttccaggaggccctggaggagagaagataccccggcgaggtgaccatccccagccccaagcccaagtacccccagtgcaaggagagcaagaaggacctgatcaccctgagcggctgccccctggccgacaagagcatcagaagcatgctggccaccagcagccaggagctgaagtgccccacccccggctgcgacggcagcggccacatcaccggcaactacgccagccacagaagcctgagcggctgccccagagccaagaagagcggcatcagaatcgcccagagcaaggaggacaaggaggaccaggagcccatcagatgccccgtgcccggctgcgacggccagggccacatcaccggcaagtacgccagccacagaagcgccagcggctgccccctggccgccaagagacagaaggacggctacctgaacggcagccagttcagctggaagagcgtgaagaccgagggcatgagctgccccacccccggctgcgacggcagcggccacgtgagcggcagcttcctgacccacagaagcctgagcggctgccccagagccaccagcgccatgaagaaggccaagctgagcggcgagcagatgctgaccatcaagcagagagccagcaacggcatcgagaacgacgaggagatcaagcagctggacgaggagatcaaggagctgaacgagagcaacagccagatggaggccgacatgatcaagctgagaacccagatcaccaccatggagagcaacctgaagaccatcgaggaggagaacaaggtgatcgagcagcagaacgagagcctgctgcacgagctggccaacctgagccagagcctgatccacagcctggccaacatccagctgccccacatggaccccatcaacgagcagaacttcgacgcctacgtgaccaccctgaccgagatgtacaccaaccaggacagataccagagccccgagaacaaggccctgctggagaacatcaagcaggccgtgagaggcatccaggtgtag

SEQ ID NO: 89796 - DNA, 555 bp, Artificial Sequence
  Description of Artificial Sequence: Synthetic coding sequence
atgagctgccccacccccggctgcgacggcagcggccacgtgagcggcagcttcctgacccacagaagcctgagcggctgccccagagccaccagcgccatgaagaaggccaagctgagcggcgagcagatgctgaccatcaagcagagagccagcaacggcatcgagaacgacgaggagatcaagcagctggacgaggagatcaaggagctgaacgagagcaacagccagatggaggccgacatgatcaagctgagaacccaggtgaccatcaccaccatggagagcaacctgaagaccatcgaggaggagaacaaggtgatcgagcagcagaacgagagcctgctgcacgagctggccaacctgagccagagcctgatccacagcctggccaacatccagctgccccacatggaccccatcaacgagcagaacttcgacgcctacgtgaccaccctgaccgagatgtacaccaaccaggacagataccagagccccgagaacaaggccctgctggagaacatcaagcaggccgtgagaggcatccaggtgtag

SEQ ID NO: 89797 - DNA, 3555 bp, Artificial Sequence
  Description of Artificial Sequence: Synthetic coding sequence
atggaggtggacaccgaggagaagagacacagaaccagaagcaagggcgtgagagtgcccgtggagcccgccatccaggagctgttcagctgccccacccccggctgcgacggcagcggccacgtgagcggcaagtacgccagacacagaagcgtgtacggctgccccctggccaagaagagaaagacccaggacaagcagccccaggagcccgcccccaagagaaagcccttcgccgtgaaggccgacagcagcagcgtggacgagtgcgacgacagcgacggcaccgaggacatggacgagaaggaggaggacgagggcgaggagtacagcgaggacaacgacgagcccggcgacgaggacgaggaggacgaggagggcgacagagaggaggaggaggagatcgaggaggaggacgaggacgacgacgaggacggcgaggacgtggaggacgaggaggaggaggaggaggaggaggaggaggaggaggaggaggaggagaacgaggaccaccagatgaactgccacaacaccagaatcatgcaggacaccgagaaggacgacaacaacaacgacgagtacgacaactacgacgagctggtggccaagagcctgctgaacctgggcaagatcgccgaggacgccgcctacagagccagaaccgagagcgagatgaacagcaacaccagcaacagcctggaggacgacagcgacaagaacgagaacctgggcagaaagagcgagctgagcctggacctggacagcgacgtggtgagagagaccgtggacagcctgaagctgctggcccagggccacggcgtggtgctgagcgagaacatgaacgacagaaactacgccgacagcatgagccagcaggacagcagaaacatgaactacgtgatgctgggcaagcccatgaacaacggcctgatggagaagatggtggaggagagcgacgaggaggtgtgcctgagcagcctggagtgcctgagaaaccagtgcttcgacctggccagaaagctgagcgagaccaacccccaggagagaaacccccagcagaacatgaacatcagacagcacgtgagacccgaggaggacttccccggcagaacccccgacagaaactacagcgacatgctgaacctgatgagactggaggagcagctgagccccagaagcagagtgttcgccagctgcgccaaggaggacggctgccacgagagagacgacgacaccaccagcgtgaacagcgacagaagcgaggaggtgttcgacatgaccaagggcaacctgaccctgctggagaaggccatcgccctggagaccgagagagccaaggccatgagagagaagatggccatggaggccggcagaagagacaacatgagaagctacgaggaccagagccccagacagctgcccggcgaggacagaaagcccaagagcagcgacagccacgtgaagaagccctactacgaccccagcagaaccgagaagaaggagagcaagtgccccacccccggctgcgacggcaccggccacgtgaccggcctgtacccccaccacagaagcctgagcggctgcccccacaaggacagagtgccccccgagatcctggccatgcacgagagcgtgctgaagtgccccacccccggctgcaccggcagaggccacgtgaacagcaacagaaacagccacagaagcctgagcggctgccccatcgccgccgccgagaagctggccaaggcccaggagaagcaccagagctgcgacgtgagcaagagcagccaggccagcgacagagtgctgagacccatgtgcttcgtgaagcagctggagatcccccagtacggctacagaaacaacgtgcccaccaccacccccagaagcaacctggccaaggagctggagaagtacagcaagaccagcttcgagtacaacagctacgacaaccacacctacggcaagagagccatcgcccccaaggtgcagaccagagacatcagccccaagggctacgacgacgccaagagatactgcaaggaccccagccccagcagcagcagcaccagcagctacgcccccagcagcagcagcaacctgagctgcggcggcggcagcagcgccagcagcacctgcagcaagagcagcttcgactacacccacgacatggaggccgcccacatggccgccaccgccatcctgaacctgagcaccagatgcagagagatgccccagaacctgagcaccaagccccaggacctgtgcgccaccagaaaccccgacatggaggtggacgagaacggcaccctggacctgagcatgaacaagcagagacccagagacagctgctgccccatcctgacccccctggagcccatgagcccccagcagcaggccgtgatgaacaacagatgcttccagctgggcgagggcgactgctgggacctgcccgtggactacaccaagatgaagcccagaagaatcgacgaggacgagagcaaggacatcacccccgaggacctggaccccttccaggaggccctggaggagagaagataccccggcgaggtgaccatccccagccccaagcccaagtacccccagtgcaaggagagcaagaaggacctgatcaccctgagcggctgccccctggccgacaagagcatcagaagcatgctggccaccagcagccaggagctgaagtgccccacccccggctgcgacggcagcggccacatcaccggcaactacgccagccacagaagcctgagcggctgccccagagccaagaagagcggcatcagaatcgcccagagcaaggaggacaaggaggaccaggagcccatcagatgccccgtgcccggctgcgacggccagggccacatcaccggcaagtacgccagccacagaagcgccagcggctgccccctggccgccaagagacagaaggacggctacctgaacggcagccagttcagctggaagagcgtgaagaccgagggcatgagctgccccacccccggctgcgacggcagcggccacgtgagcggcagcttcctgacccacagaagcctgagcggctgccccagagccaccagcgccatgaagaaggccaagctgagcggcgagcagatgctgaccatcaagcagagagccagcaacggcatcgagaacgacgaggagatcaagcagctggacgaggagatcaaggagctgaacgagagcaacagccagatggaggccgacatgatcaagctgagaacccagatcaccaccatggagagcaacctgaagaccatcgaggaggagaacaaggtgatcgagcagcagaacgagagcctgctgcacgagctggccaacctgagccagagcctgatccacagcctggccaacatccagctgccccacatggaccccatcaacgagcagaacttcgacgcctacgtgaccaccctgaccgagatgtacaccaaccaggacagataccagagccccgagaacaaggccctgctggagaacatcaagcaggccgtgagaggcatccaggtgtag

SEQ ID NO: 89798 - DNA, 552 bp, Artificial Sequence
  Description of Artificial Sequence: Synthetic coding sequence
atgagccagaagcccgccaaggagggccccagactgagcaagaaccagaagtacagcgagcacttcagcatccactgctgcccccccttcaccttcctgaacagcaagaaggagatcgtggacagaaagtacagcatctgcaagagcggctgcttctaccagaagaaggaggaggactggatctgctgcgcctgccagaagaccagaaccagcagaagagccaagagcccccagagacccaagcagcagcccgccgccccccccgccgtggtgagagcccccgccaagcccagaagcccccccagaagcgagagacagcccagaagcccccccagaagcgagagacagcccagaagcccccccagaagcgagagacagcccagaagcccccccagaagcgagagacagcccagacccagacccgaggtgagacccccccccgccaagcagagacccccccagaagagcaagcagcagcccagaagcagccccctgagaggccccggcgccagcagaggcggcagccccgtgaaggccagcagattctggtag

SEQ ID NO: 89799 - DNA, 246 bp, Artificial Sequence
  Description of Artificial Sequence: Synthetic coding sequence
atgagccagaagcccgccaaggagggccccagactgagcaagaaccagaagtacagcgagcacttcagcatccactgctgcccccccttcaccttcctgaacagcaagaaggagatcgtggacagaaagtacagcatctgcaagagcggctgcttctaccagaagaaggaggaggactggatctgctgcgcctgccagaagaccagactgaagagaaagatcagacccacccccaagaagaagtag

SEQ ID NO: 89800 - DNA, 246 bp, Artificial Sequence; identical to SEQ ID NO: 89799
  Description of Artificial Sequence: Synthetic coding sequence

SEQ ID NO: 89801 - DNA, 246 bp, Artificial Sequence; identical to SEQ ID NO: 89799
  Description of Artificial Sequence: Synthetic coding sequence

SEQ ID NO: 89802 - DNA, 552 bp, Artificial Sequence; identical to SEQ ID NO: 89798
  Description of Artificial Sequence: Synthetic coding sequence

SEQ ID NO: 89803 - DNA, 552 bp, Artificial Sequence; identical to SEQ ID NO: 89798
  Description of Artificial Sequence: Synthetic coding sequence

SEQ ID NO: 89804 - DNA, 246 bp, Artificial Sequence; identical to SEQ ID NO: 89799
  Description of Artificial Sequence: Synthetic coding sequence

SEQ ID NO: 89805 - DNA, 552 bp, Artificial Sequence; identical to SEQ ID NO: 89798
  Description of Artificial Sequence: Synthetic coding sequence

SEQ ID NO: 89806 - DNA, 246 bp, Artificial Sequence; identical to SEQ ID NO: 89799
  Description of Artificial Sequence: Synthetic coding sequence

SEQ ID NO: 89807 - DNA, 177 bp, Artificial Sequence
  Description of Artificial Sequence: Synthetic coding sequence
atgagccagaagcccgccaaggagggccccagactgagcaagaaccagaagtacagcgagcacttcagcatccactgctgcccccccttcaccttcctgaacagcaagaaggagatcgtggacagaaagtacagcatctgcaagagcggctgcttctaccagaagaaggaggagtag

SEQ ID NO: 89808 - DNA, 423 bp, Artificial Sequence
  Description of Artificial Sequence: Synthetic coding sequence
atgctgcaggccgccgacttcatcgagagaaccgagaccgccggcgagctgagcagaggcctgatcggcgtgctgagcagccagatcagctggtgcctgctgaacgtgaacctgagcaagctgcccaccagactgcagagactgagctgcagcgtgctgaacagcagccccgccatgagaggcggcgccagaggcagaccccagctgaccctggagagacccctgagacccggctgcagactgcacagctgcagcgaggccgagaagggcggcttcgtgagaagaaaggagatcatcctgttccccccctgcgaggaccccgccagaggctggctgagcgccaaccccggcagagagcccagccccggcatctgctggcacctgaacctgggcctgcccagcctgcacaactgcgaggagtag

SEQ ID NO: 89809 - DNA, 816 bp, Artificial Sequence
  Description of Artificial Sequence: Synthetic coding sequence
atgttcggcctgaagagaaacgccgtgatcggcctgaacctgtactgcggcggcgccggcctgggcgccggcagcggcggcgccaccagacccggcggcagactgctggccaccgagaaggaggccagcgccagaagagagatcggcggcggcgaggccggcgccgtgatcggcggcagcgccggcgccagcccccccagcaccctgacccccgacagcagaagagtggccagacccccccccatcggcgccgaggtgcccgacgtgaccgccacccccgccagactgctgttcttcgcccccaccagaagagccgcccccctggaggagatggaggcccccgccgccgacgccatcatgagccccgaggaggagctggacggctacgagcccgagcccctgggcaagagacccgccgtgctgcccctgctggagctggtgggcgagagcggcaacaacaccagcaccgacggcagcctgcccagcacccccccccccgccgaggaggaggaggacgagctgtacagacagagcctggagatcatcagcagatacctgagagagcaggccaccggcgccaaggacaccaagcccatgggcagaagcggcgccaccagcagaaaggccctggagaccctgagaagagtgggcgacggcgtgcagagaaaccacgagaccgccttccagggctgggtgtgcggcgtgctgccctgcagaggccccagaagatggcaccaggagtgcgccgccggcttctgcagatgctgctggagcagaagctggttcggcatcagcaacaagatcgccctgctgtag

SEQ ID NO: 89810 - DNA, 1053 bp, Artificial Sequence
  Description of Artificial Sequence: Synthetic coding sequence
atgttcggcctgaagagaaacgccgtgatcggcctgaacctgtactgcggcggcgccggcctgggcgccggcagcggcggcgccaccagacccggcggcagactgctggccaccgagaaggaggccagcgccagaagagagatcggcggcggcgaggccggcgccgtgatcggcggcagcgccggcgccagcccccccagcaccctgacccccgacagcagaagagtggccagacccccccccatcggcgccgaggtgcccgacgtgaccgccacccccgccagactgctgttcttcgcccccaccagaagagccgcccccctggaggagatggaggcccccgccgccgacgccatcatgagccccgaggaggagctggacggctacgagcccgagcccctgggcaagagacccgccgtgctgcccctgctggagctggtgggcgagagcggcaacaacaccagcaccgacggcagcctgcccagcacccccccccccgccgaggaggaggaggacgagctgtacagacagagcctggagatcatcagcagatacctgagagagcaggccaccggcgccaaggacaccaagcccatgggcagaagcggcgccaccagcagaaaggccctggagaccctgagaagagtgggcgacggcgtgcagagaaaccacgagaccgccttccagggcatgctgagaaagctggacatcaagaacgaggacgacgtgaagagcctgagcagagtgatgatccacgtgttcagcgacggcgtgaccaactggggcagaatcgtgaccctgatcagcttcggcgccttcgtggccaagcacctgaagaccatcaaccaggagagctgcatcgagcccctggccgagagcatcaccgacgtgctggtgagaaccaagagagactggctggtgaagcagagaggctgggacggcttcgtggagttcttccacgtggaggacctggagggcggcatcagaaacgtgctgctggccttcgccggcgtggccggcgtgggcgccggcctggcctacctgatcagatag

SEQ ID NO: 89811 - DNA, 840 bp, Artificial Sequence
  Description of Artificial Sequence: Synthetic coding sequence
atgttcggcctgaagagaaacgccgtgatcggcctgaacctgtactgcggcggcgccggcctgggcgccggcagcggcggcgccaccagacccggcggcagactgctggccaccgagatggaggcccccgccgccgacgccatcatgagccccgaggaggagctggacggctacgagcccgagcccctgggcaagagacccgccgtgctgcccctgctggagctggtgggcgagagcggcaacaacaccagcaccgacggcagcctgcccagcacccccccccccgccgaggaggaggaggacgagctgtacagacagagcctggagatcatcagcagatacctgagagagcaggccaccggcgccaaggacaccaagcccatgggcagaagcggcgccaccagcagaaaggccctggagaccctgagaagagtgggcgacggcgtgcagagaaaccacgagaccgccttccagggcatgctgagaaagctggacatcaagaacgaggacgacgtgaagagcctgagcagagtgatgatccacgtgttcagcgacggcgtgaccaactggggcagaatcgtgaccctgatcagcttcggcgccttcgtggccaagcacctgaagaccatcaaccaggagagctgcatcgagcccctggccgagagcatcaccgacgtgctggtgagaaccaagagagactggctggtgaagcagagaggctgggacggcttcgtggagttcttccacgtggaggacctggagggcggcatcagaaacgtgctgctggccttcgccggcgtggccggcgtgggcgccggcctggcctacctgatcagatag

SEQ ID NO: 89812 - DNA, 1224 bp, Artificial Sequence
  Description of Artificial Sequence: Synthetic coding sequence
atggtgaacgagtacaagaagatcctgctgctgaagggcttcgagctgatggacgactaccacttcaccagcatcaagagcctgctggcctacgacctgggcctgaccaccaagatgcaggaggagtacaacagaatcaagatcaccgacctgatggagaagaagttccagggcgtggcctgcctggacaagctgatcgagctggccaaggacatgcccagcctgaagaacctggtgaacaacctgagaaaggagaagagcaaggtggccaagaagatcaagacccaggagaaggcccccgtgaagaagatcaaccaggaggaggtgggcctggccgcccccgcccccaccgccagaaacaagctgaccagcgaggccagaggcagaatccccgtggcccagaagagaaagacccccaacaaggagaagaccgaggccaagagaaacaaggtgagccaggagcagagcaagccccccggccccagcggcgccagcaccagcgccgccgtggaccacccccccctgccccagaccagcagcagcacccccagcaacaccagcttcacccccaaccaggagacccaggcccagagacaggtggacgccagaagaaacgtgccccagaacgaccccgtgaccgtggtggtgctgaaggccaccgcccccttcaagtacgagagccccgagaacggcaagagcaccatgttccacgccaccgtggccagcaagacccagtacttccacgtgaaggtgttcgacatcaacctgaaggagaagttcgtgagaaagaaggtgatcaccatcagcgactacagcgagtgcaagggcgtgatggagatcaaggaggccagcagcgtgagcgacttcaaccagaacttcgaggtgcccaacagaatcatcgagatcgccaacaagacccccaagatcagccagctgtacaagcaggccagcggcaccatggtgtacggcctgttcatgctgcagaagaagagcgtgcacaagaagaacaccatctacgagatccaggacaacaccggcagcatggacgtggtgggcagcggcaagtggcacaacatcaagtgcgagaagggcgacaagctgagactgttctgcctgcagctgagaaccgtggacagaaagctgaagctggtgtgcggcagccacagcttcatcaaggtgatcaaggccaagaagaacaaggagggccccatgaacgtgaactag

SEQ ID NO: 89813 - DNA, 315 bp, Artificial Sequence
  Description of Artificial Sequence: Synthetic coding sequence
tgacccaacagaatcatcgagatcgccaacaagacccccaagatcagccagctgtacaagcaggccagcggcaccatggtgtacggcctgttcatgctgcagaagaagagcgtgcacaagaagaacaccatctacgagatccaggacaacaccggcagcatggacgtggtgggcagcggcaagtggcacaacatcaagtgcgagaagggcgacaagctgagactgttctgcctgcagctgagaaccgtggacagaaagctgaagctggtgatcaaggccaagaagaacaaggagggccccatgaacgtgaactag

SEQ ID NO: 89814 - DNA, 795 bp, Artificial Sequence
  Description of Artificial Sequence: Synthetic coding sequence
atgagacccgacagagccgaggcccccggcccccccgccatggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcagactgctggacgcctggcagggcagacccggcgccagcgtgggcagactgctggagctgctgaccaagctgggcagagacgacgtgctgctggagctgggccccagcatcggccacatgcccgagagattcgacgccttcatctgctactgccccagcgacatccagttcgtgcaggagatgatcagacagctggagcagaccaactacagactgaagctgtgcgtgagcgacagagacgtgctgcccggcacctgcgtgtggagcatcgccagcgagctgatcgagaagagatgcagaagaatggtggtggtggtgagcgacgactacctgcagagcaaggagtgcgacttccagaccaagttcgccctgagcctgagccccggcgcccaccagaagagactgatccccatcaagtacaaggccatgaagaaggagttccccagcatcctgagattcatcaccgtgtgcgactacaccaacccctgcaccaagagctggttctggaccagactggccaaggccctgagcctgccctag

SEQ ID NO: 89815 - DNA, 615 bp, Artificial Sequence
  Description of Artificial Sequence: Synthetic coding sequence
atgagacccgacagagccgaggcccccggcccccccgccatggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcagactgctggacgcctggcagggcagacccggcgccagcgtgggcagactgctggagctgctgaccaagctgggcagagacgacgtgctgctggagctgggccccagcatcgaggaggactgccagaagtacatcctgaagcagcagcaggaggaggccgagaagcccctgcaggtggccgccgtggacagcagcgtgcccagaaccgccgagctggccggcatcaccaccctggacgaccccctgggcgccgccggctggtggtggctgagcctgatgatcacctgcagagccagaaacgtgaccagcagacccaacctgcacagcgccagcctgcaggtgcccatcagaagcgactag

SEQ ID NO: 89816 - DNA, 480 bp, Artificial Sequence
  Description of Artificial Sequence: Synthetic coding sequence
atgagacccgacagagccgaggcccccggcccccccgccatggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcagactgctggacgcctggcagggcagacccggcgccagcgtgggcagactgctggagctgctgaccaagctgggcagagacgacgtgctgctggagctgggccccagcatcggcgccgccggctggtggtggctgagcctgatgatcacctgcagagccagaaacgtgaccagcagacccaacctgcacagcgccagcctgcaggtgcccatcagaagcgactag

SEQ ID NO: 89817 - DNA, 807 bp, Artificial Sequence
  Description of Artificial Sequence: Synthetic coding sequence
atgttcagaatgctgaacagcagcttcgaggacgaccccttcttcagcgagagcatcctggcccacagagagaacatgagacagatgatcagaagcttcagcgagcccttcggcagagacctgctgagcatcagcgacggcagaggcagagcccacaacagaagaggccacaacgacggcgaggacagcctgacccacaccgacgtgagcagcttccagaccatggaccagatggtgagcaacatgagaaactacatgcagaagctggagagaaacttcggccagctgagcgtggaccccaacggccacagcttctgcagcagcagcgtgatgacctacagcaagatcggcgacgagccccccaaggtgttccaggccagcacccagaccagaagagcccccggcggcatcaaggagaccagaaaggccatgagagacagcgacagcggcctggagaagatggccatcggccaccacatccacgacagagcccacgtgatcaagaagagcaagaacaagaagaccggcgacgaggaggtgaaccaggagttcatcaacatgaacgagagcgacgcccacgccttcgacgaggagtggcagagcgaggtgctgaagtacaagcccggcagacacaacctgggcaacaccagaatgagaagcgtgggccacgagaaccccggcagcagagagctgaagagaagagagaagccccagcagagccccgccatcgagcacggcagaagaagcaacgtgctgggcgacaagctgcacatcaagggcagcagcgtgaagagcaacaagaagtag

SEQ ID NO: 89818 - DNA, 732 bp, Artificial Sequence
  Description of Artificial Sequence: Synthetic coding sequence
atgagacagatgatcagaagcttcagcgagcccttcggcagagacctgctgagcatcagcgacggcagaggcagagcccacaacagaagaggccacaacgacggcgaggacagcctgacccacaccgacgtgagcagcttccagaccatggaccagatggtgagcaacatgagaaactacatgcagaagctggagagaaacttcggccagctgagcgtggaccccaacggccacagcttctgcagcagcagcgtgatgacctacagcaagatcggcgacgagccccccaaggtgttccaggccagcacccagaccagaagagcccccggcggcatcaaggagaccagaaaggccatgagagacagcgacagcggcctggagaagatggccatcggccaccacatccacgacagagcccacgtgatcaagaagagcaagaacaagaagaccggcgacgaggaggtgaaccaggagttcatcaacatgaacgagagcgacgcccacgccttcgacgaggagtggcagagcgaggtgctgaagtacaagcccggcagacacaacctgggcaacaccagaatgagaagcgtgggccacgagaaccccggcagcagagagctgaagagaagagagaagccccagcagagccccgccatcgagcacggcagaagaagcaacgtgctgggcgacaagctgcacatcaagggcagcagcgtgaagagcaacaagaagtag

SEQ ID NO: 89819 - DNA, 900 bp, Artificial Sequence
  Description of Artificial Sequence: Synthetic coding sequence
atgctgaaggaggtgctgcagagagagggcaagagctacaagagcgagaccctgatgtacatcaagaaggccagagccagcgagaacaagctgagcgagagcatcctggcccacagagagaacatgagacagatgatcagaagcttcagcgagcccttcggcagagacctgctgagcatcagcgacggcagaggcagagcccacaacagaagaggccacaacgacggcgaggacagcctgaccgccaccagctgcagcctggtgcccttcggcgacttcggcggcatgcacaccgacgtgagcagcttccagaccatggaccagatggtgagcaacatgagaaactacatgcagaagctggagagaaacttcggccagctgagcgtggaccccaacggccacagcttctgcagcagcagcgtgatgacctacagcaagatcggcgacgagccccccaaggtgttccaggccagcacccagaccagaagagcccccggcggcatcaaggagaccagaaaggccatgagagacagcgacagcggcctggagaagatggccatcggccaccacatccacgacagagcccacgtgatcaagaagagcaagaacaagaagaccggcgacgaggaggtgaaccaggagttcatcaacatgaacgagagcgacgcccacgccttcgacgaggagtggcagagcgaggtgctgaagtacaagcccggcagacacaacctgggcaacaccagaatgagaagcgtgggccacgagaaccccggcagcagagagctgaagagaagagagaagccccagcagagccccgccatcgagcacggcagaagaagcaacgtgctgggcgacaagctgcacatcaagggcagcagcgtgaagagcaacaagaagtag

SEQ ID NO: 89820 - DNA, 777 bp, Artificial Sequence
  Description of Artificial Sequence: Synthetic coding sequence
atgagacagatgatcagaagcttcagcgagcccttcggcagagacctgctgagcatcagcgacggcagaggcagagcccacaacagaagaggccacaacgacggcgaggacagcctgaccgccaccagctgcagcctggtgcccttcggcgacttcggcggcatgcacaccgacgtgagcagcttccagaccatggaccagatggtgagcaacatgagaaactacatgcagaagctggagagaaacttcggccagctgagcgtggaccccaacggccacagcttctgcagcagcagcgtgatgacctacagcaagatcggcgacgagccccccaaggtgttccaggccagcacccagaccagaagagcccccggcggcatcaaggagaccagaaaggccatgagagacagcgacagcggcctggagaagatggccatcggccaccacatccacgacagagcccacgtgatcaagaagagcaagaacaagaagaccggcgacgaggaggtgaaccaggagttcatcaacatgaacgagagcgacgcccacgccttcgacgaggagtggcagagcgaggtgctgaagtacaagcccggcagacacaacctgggcaacaccagaatgagaagcgtgggccacgagaaccccggcagcagagagctgaagagaagagagaagccccagcagagccccgccatcgagcacggcagaagaagcaacgtgctgggcgacaagctgcacatcaagggcagcagcgtgaagagcaacaagaagtag

SEQ ID NO: 89821 - DNA, 777 bp, Artificial Sequence; identical to SEQ ID NO: 89820
  Description of Artificial Sequence: Synthetic coding sequence

SEQ ID NO: 89822 - DNA, 732 bp, Artificial Sequence; identical to SEQ ID NO: 89818
  Description of Artificial Sequence: Synthetic coding sequence

SEQ ID NO: 89823 - DNA, 732 bp, Artificial Sequence; identical to SEQ ID NO: 89818
  Description of Artificial Sequence: Synthetic coding sequence

SEQ ID NO: 89824 - DNA, 603 bp, Artificial Sequence
  Description of Artificial Sequence: Synthetic coding sequence
atgagacagatgatcagaagcttcagcgagcccttcggcagagacctgctgagcatcagcgacggcagaggcagagcccacaacagaagaggccacaacgacggcgaggacagcctgacccacaccgacgtgagcagcttccagaccatggaccagatggtgagcaacatgagaaactacatgcagaagctggagagaaacttcatcaaggagaccagaaaggccatgagagacagcgacagcggcctggagaagatggccatcggccaccacatccacgacagagcccacgtgatcaagaagagcaagaacaagaagaccggcgacgaggaggtgaaccaggagttcatcaacatgaacgagagcgacgcccacgccttcgacgaggagtggcagagcgaggtgctgaagtacaagcccggcagacacaacctgggcaacaccagaatgagaagcgtgggccacgagaaccccggcagcagagagctgaagagaagagagaagccccagcagagccccgccatcgagcacggcagaagaagcaacgtgctgggcgacaagctgcacatcaagggcagcagcgtgaagagcaacaagaagtag

SEQ ID NO: 89825 - DNA, 747 bp, Artificial Sequence
  Description of Artificial Sequence: Synthetic coding sequence
atgttcagattcatgagagacgtggagcccgaggaccccatgttcctgatggaccccttcgccatccacagacagcacatgagcagaatgctgagcggcggcttcggctacagccccttcctgagcatcaccgacggcaacatgcccggcaccagacccgccagcagaagaatgcagcaggccggcgccgtgagccccttcggcatgctgggcatgagcggcggcttcatggacatgttcggcatgatgaacgacatgatcggcaacatggagcacatgaccgccggcggcaactgccagaccttcagcagcagcaccgtgatcagctacagcaacaccggcgacggcgcccccaaggtgtaccaggagaccagcgagatgagaagcgcccccggcggcatcagagagaccagaagaaccgtgagagacagcgacagcggcctggagcagatgagcatcggccaccacatcagagacagagcccacatcctgcagagaagcagaaaccacagaaccggcgaccaggaggagagacaggactacatcaacctggacgagagcgaggccgccgccttcgacgacgagtggagaagagagaccagcagattcagacagcagagacccctggagttcagaagactggagagcagcggcgccggcggcagaagagccgagggcccccccagactggccatccagggccccgaggacagccccagcagacagagcagaagatacgactggtag

SEQ ID NO: 89826 - DNA, 747 bp, Artificial Sequence; identical to SEQ ID NO: 89825
  Description of Artificial Sequence: Synthetic coding sequence

SEQ ID NO: 89827 - DNA, 747 bp, Artificial Sequence; identical to SEQ ID NO: 89825
  Description of Artificial Sequence: Synthetic coding sequence

SEQ ID NO: 89828 - DNA, 747 bp, Artificial Sequence; identical to SEQ ID NO: 89825
  Description of Artificial Sequence: Synthetic coding sequence

SEQ ID NO: 89829 - DNA, 684 bp, Artificial Sequence
  Description of Artificial Sequence: Synthetic coding sequence
atgatggccgccggcgccgccctggccctggccctgtggctgctgatgccccccgtggaggtgggcggcgccggccccccccccatccaggacggcgagttcaccttcctgctgcccgccggcagaaagcagtgcttctaccagagcgcccccgccaacgccagcctggagaccgagtaccaggtgatcggcggcgccggcctggacgtggacttcaccctggagagcccccagggcgtgctgctggtgagcgagagcagaaaggccgacggcgtgcacaccgtggagcccaccgaggccggcgactacaagctgtgcttcgacaacagcttcagcaccatcagcgagaagctggtgttcttcgagctgatcttcgacagcctgcaggacgacgaggaggtggagggctgggccgaggccgtggagcccgaggagatgctggacgtgaagatggaggacatcaaggagagcatcgagaccatgagaaccagactggagagaagcatccagatgctgaccctgctgagagccttcgaggccagagacagaaacctgcaggagggcaacctggagagagtgaacttctggagcgccgtgaacgtggccgtgctgctgctggtggccgtgctgcaggtgtgcaccctgaagagattcttccaggacaagagacccgtgcccacctag

SEQ ID NO: 89830 - DNA, 873 bp, Artificial Sequence
  Description of Artificial Sequence: Synthetic coding sequence
atgagacccgccgtgctgggcagccccgacagagccccccccgaggacgagggccccgtgatggtgaagctggaggacagcgaggaggagggcgaggccgccctgtgggaccccggccccgaggccgccagactgagattcagatgcttcagatacgaggaggccaccggcccccaggaggccctggcccagctgagagagctgtgcagacagtggctgagacccgaggtgagaagcaaggagcagatgctggagctgctggtgctggagcagttcctgggcgccctgccccccgagatccaggccagagtgcagggccagagacccggcagccccgaggaggccgccgccctggtggacggcctgagaagagagcccggcggccccagaagatgggtgaccgtgcaggtgcagggccaggaggtgctgagcgagaagatggagcccagcagcttccagcccctgcccgagaccgagccccccacccccgagcccggccccaagaccccccccagaaccatgcaggagagccccctgggcctgcaggtgaaggaggagagcgaggtgaccgaggacagcgacttcctggagagcggccccctggccgccacccaggagagcgtgcccaccctgctgcccgaggaggcccagagatgcggcaccgtgctggaccagatcttcccccacagcaagaccggccccgagggccccagctggagagagcaccccagagccctgtggcacgaggaggccggcggcatcttcagccccggcgccggcgccggcgccgcccccgccctgggcgccggctggctgggcgccgccgtggccatgtacgtggccagatgcagcgccaacgccgccacctgctag

SEQ ID NO: 89831 - DNA, 2205 bp, Artificial Sequence
  Description of Artificial Sequence: Synthetic coding sequence
atgagacccgccgtgctgggcagccccgacagagccccccccgaggacgagggccccgtgatggtgaagctggaggacagcgaggaggagggcgaggccgccctgtgggaccccggccccgaggccgccagactgagattcagatgcttcagatacgaggaggccaccggcccccaggaggccctggcccagctgagagagctgtgcagacagtggctgagacccgaggtgagaagcaaggagcagatgctggagctgctggtgctggagcagttcctgggcgccctgccccccgagatccaggccagagtgcagggccagagacccggcagccccgaggaggccgccgccctggtggacggcctgagaagagagcccggcggccccagaagatgggtgaccgtgcaggtgcagggccaggaggtgctgagcgagaagatggagcccagcagcttccagcccctgcccgagaccgagccccccacccccgagcccggccccaagaccccccccagaaccatgcaggagagccccctgggcctgcaggtgaaggaggagagcgaggtgaccgaggacagcgacttcctggagagcggccccctggccgccacccaggagagcgtgcccaccctgctgcccgaggaggcccagagatgcggcaccgtgctggaccagatcttcccccacagcaagaccggccccgagggccccagctggagagagcaccccagagccctgtggcacgaggaggccggcggcatcttcagccccggcttcgccctgcagctgggcagcatcagcgccggccccggcagcgtgagcccccacctgcacgtgccctgggacctgggcatggccggcctgagcggccagatccagagccccagcagagagggcggcttcgcccacgccctgctgctgcccagcgacctgagaagcgagcaggaccccaccgacgaggacccctgcagaggcgtgggccccgccctgatcaccaccagatggagaagccccagaggcagaagcagaggcagacccagcaccggcggcggcgtggtgagaggcggcagatgcgacgtgtgcggcaaggtgttcagccagagaagcaacctgctgagacaccagaagatccacaccggcgagagacccttcgtgtgcagcgagtgcggcagaagcttcagcagaagcagccacctgctgagacaccagctgacccacaccgaggagagacccttcgtgtgcggcgactgcggccagggcttcgtgagaagcgccagactggaggagcacagaagagtgcacaccggcgagcagcccttcagatgcgccgagtgcggccagagcttcagacagagaagcaacctgctgcagcaccagagaatccacggcgacccccccggccccggcgccaagccccccgccccccccggcgcccccgagccccccggccccttcccctgcagcgagtgcagagagagcttcgccagaagagccgtgctgctggagcaccaggccgtgcacaccggcgacaagagcttcggctgcgtggagtgcggcgagagattcggcagaagaagcgtgctgctgcagcacagaagagtgcacagcggcgagagacccttcgcctgcgccgagtgcggccagagcttcagacagagaagcaacctgacccagcacagaagaatccacaccggcgagagacccttcgcctgcgccgagtgcggcaaggccttcagacagagacccaccctgacccagcacctgagagtgcacaccggcgagaagcccttcgcctgccccgagtgcggccagagattcagccagagactgaagctgaccagacaccagagaacccacaccggcgagaagccctaccactgcggcgagtgcggcctgggcttcacccaggtgagcagactgaccgagcaccagagaatccacaccggcgagagacccttcgcctgccccgagtgcggccagagcttcagacagcacgccaacctgacccagcacagaagaatccacaccggcgagagaccctacgcctgccccgagtgcggcaaggccttcagacagagacccaccctgacccagcacctgagaacccacagaagagagaagcccttcgcctgccaggactgcggcagaagattccaccagagcaccaagctgatccagcaccagagagtgcacagcgccgagtag

SEQ ID NO: 89832 - DNA, 1539 bp, Artificial Sequence
  Description of Artificial Sequence: Synthetic coding sequence
atggcccacagctgcagatggagattccccgccagacccggcaccaccggcggcggcggcggcggcggcagaagaggcctgggcggcgcccccagacagagagtgcccgccctgctgctgccccccggcccccccgtgggcggcggcggccccggcgccccccccagcccccccgccgtggccgccgccgccgccgccgccggcagcagcggcgccggcgtgcccggcggcgccgccgccgccagcgccgccagcagcagcagcgccagcagcagcagcagcagcagcagcagcgccagcagcggccccgccctgctgagagtgggccccggcttcgacgccgccctgcaggtgagcgccgccatcggcaccaacctgagaagattcagagccgtgttcggcgagagcggcggcggcggcggcagcggcgagctgaccacccagatcccctgcagctggagaaccaagggccacatccacgacaagaagaccgagcccttcagactgctggcctggagctggtgcctgaacgacgagcagttcctgggcttcggcagcgacgaggaggtgagagtgagaagccccaccagaagccccagcgtgaagaccagccccagaaagcccagaggcagacccagaagcggcagcgacagaaacagcgccatcctgagcgaccccagcgtgttcagccccctgaacaagagcgagaccaagagcggcgacaagatcaagaagaaggacagcaagagcatcgagaagaagagaggcagaccccccaccttccccggcgtgaagatcaagatcacccacggcaaggacatcagcgagctgcccaagggcaacaaggaggacagcctgaagaagatcaagagaacccccagcgccaccttccagcaggccaccaagatcaagaagctgagagccggcaagctgagccccctgaagagcaagttcaagaccggcaagctgcagatcggcagaaagggcgtgcagatcgtgagaagaagaggcagaccccccagcaccgagagaatcaagacccccagcggcctgctgatcaacagcgagctggagaagccccagaaggtgagaaaggacaaggagggcaccccccccctgaccaaggaggacaagaccgtggtgagacagagccccagaagaatcaagcccgtgagaatcatccccagcagcaagagaaccgacgccaccatcgccaagcagctgctgcagagagccaagaagggcgcccagaagaagatcgagaaggaggccgcccagctgcagggcagaaaggtgaagacccaggtgaagaacatcagacagttcatcatgcccgtggtgagcgccatcagcagcagaatcatcaagacccccagaagattcatcgaggacgaggactacgacccccccatcaagatcgccagactggagagcacccccaacagcagattcagcgcccccagctgcggcagcagcgagaagagcagcgccgccagccagcacagcagccagatgagcagcgacagcagcagaagctag

SEQ ID NO: 89833 - DNA, 11796 bp, Artificial Sequence
  Description of Artificial Sequence: Synthetic coding sequence
atggcccacagctgcagatggagattccccgccagacccggcaccaccggcggcggcggcggcggcggcagaagaggcctgggcggcgcccccagacagagagtgcccgccctgctgctgccccccggcccccccgtgggcggcggcggccccggcgccccccccagcccccccgccgtggccgccgccgccgccgccgccggcagcagcggcgccggcgtgcccggcggcgccgccgccgccagcgccgccagcagcagcagcgccagcagcagcagcagcagcagcagcagcgccagcagcggccccgccctgctgagagtgggccccggcttcgacgccgccctgcaggtgagcgccgccatcggcaccaacctgagaagattcagagccgtgttcggcgagagcggcggcggcggcggcagcggcgaggacgagcagttcctgggcttcggcagcgacgaggaggtgagagtgagaagccccaccagaagccccagcgtgaagaccagccccagaaagcccagaggcagacccagaagcggcagcgacagaaacagcgccatcctgagcgaccccagcgtgttcagccccctgaacaagagcgagaccaagagcggcgacaagatcaagaagaaggacagcaagagcatcgagaagaagagaggcagaccccccaccttccccggcgtgaagatcaagatcacccacggcaaggacatcagcgagctgcccaagggcaacaaggaggacagcctgaagaagatcaagagaacccccagcgccaccttccagcaggccaccaagatcaagaagctgagagccggcaagctgagccccctgaagagcaagttcaagaccggcaagctgcagatcggcagaaagggcgtgcagatcgtgagaagaagaggcagaccccccagcaccgagagaatcaagacccccagcggcctgctgatcaacagcgagctggagaagccccagaaggtgagaaaggacaaggagggcaccccccccctgaccaaggaggacaagaccgtggtgagacagagccccagaagaatcaagcccgtgagaatcatccccagcagcaagagaaccgacgccaccatcgccaagcagctgctgcagagagccaagaagggcgcccagaagaagatcgagaaggaggccgcccagctgcagggcagaaaggtgaagacccaggtgaagaacatcagacagttcatcatgcccgtggtgagcgccatcagcagcagaatcatcaagacccccagaagattcatcgaggacgaggactacgacccccccatcaagatcgccagactggagagcacccccaacagcagattcagcgcccccagctgcggcagcagcgagaagagcagcgccgccagccagcacagcagccagatgagcagcgacagcagcagaagcagcagccccagcgtggacaccagcaccgacagccaggccagcgaggagatccaggtgctgcccgaggagagaagcgacacccccgaggtgcacccccccctgcccatcagccagagccccgagaacgagagcaacgacagaagaagcagaagatacagcgtgagcgagagaagcttcggcagcagaaccaccaagaagctgagcaccctgcagagcgccccccagcagcagaccagcagcagcccccccccccccctgctgaccccccccccccccctgcagcccgccagcagcatcagcgaccacaccccctggctgatgccccccaccatccccctggccagccccttcctgcccgccagcaccgcccccatgcagggcaagagaaagagcatcctgagagagcccaccttcagatggaccagcctgaagcacagcagaagcgagccccagtacttcagcagcgccaagtacgccaaggagggcctgatcagaaagcccatcttcgacaacttcagacccccccccctgacccccgaggacgtgggcttcgccagcggcttcagcgccagcggcaccgccgccagcgccagactgttcagccccctgcacagcggcaccagattcgacatgcacaagagaagccccctgctgagagcccccagattcacccccagcgaggcccacagcagaatcttcgagagcgtgaccctgcccagcaacagaaccagcgccggcaccagcagcagcggcgtgagcaacagaaagagaaagagaaaggtgttcagccccatcagaagcgagcccagaagccccagccacagcatgagaaccagaagcggcagactgagcagcagcgagctgagccccctgaccccccccagcagcgtgagcagcagcctgagcatcagcgtgagccccctggccaccagcgccctgaaccccaccttcaccttccccagccacagcctgacccagagcggcgagagcgccgagaagaaccagagacccagaaagcagaccagcgcccccgccgagcccttcagcagcagcagccccacccccctgttcccctggttcacccccggcagccagaccgagagaggcagaaacaaggacaaggcccccgaggagctgagcaaggacagagacgccgacaagagcgtggagaaggacaagagcagagagagagacagagagagagagaaggagaacaagagagagagcagaaaggagaagagaaagaagggcagcgagatccagagcagcagcgccctgtaccccgtgggcagagtgagcaaggagaaggtggtgggcgaggacgtggccaccagcagcagcgccaagaaggccaccggcagaaagaagagcagcagccacgacagcggcaccgacatcaccagcgtgaccctgggcgacaccaccgccgtgaagaccaagatcctgatcaagaagggcagaggcaacctggagaagaccaacctggacctgggccccaccgcccccagcctggagaaggagaagaccctgtgcctgagcacccccagcagcagcaccgtgaagcacagcaccagcagcatcggcagcatgctggcccaggccgacaagctgcccatgaccgacaagagagtggccagcctgctgaagaaggccaaggcccagctgtgcaagatcgagaagagcaagagcctgaagcagaccgaccagcccaaggcccagggccaggagagcgacagcagcgagaccagcgtgagaggccccagaatcaagcacgtgtgcagaagagccgccgtggccctgggcagaaagagagccgtgttccccgacgacatgcccaccctgagcgccctgccctgggaggagagagagaagatcctgagcagcatgggcaacgacgacaagagcagcatcgccggcagcgaggacgccgagcccctggccccccccatcaagcccatcaagcccgtgaccagaaacaaggccccccaggagccccccgtgaagaagggcagaagaagcagaagatgcggccagtgccccggctgccaggtgcccgaggactgcggcgtgtgcaccaactgcctggacaagcccaagttcggcggcagaaacatcaagaagcagtgctgcaagatgagaaagtgccagaacctgcagtggatgcccagcaaggcctacctgcagaagcaggccaaggccgtgaagaagaaggagaagaagagcaagaccagcgagaagaaggacagcaaggagagcagcgtggtgaagaacgtggtggacagcagccagaagcccacccccagcgccagagaggaccccgcccccaagaagagcagcagcgagcccccccccagaaagcccgtggaggagaagagcgaggagggcaacgtgagcgcccccggccccgagagcaagcaggccaccacccccgccagcagaaagagcagcaagcaggtgagccagcccgccctggtgatccccccccagccccccaccaccggcccccccagaaaggaggtgcccaagaccacccccagcgagcccaagaagaagcagccccccccccccgagagcggccccgagcagagcaagcagaagaaggtggcccccagacccagcatccccgtgaagcagaagcccaaggagaaggagaagcccccccccgtgaacaagcaggagaacgccggcaccctgaacatcctgagcaccctgagcaacggcaacagcagcaagcagaagatccccgccgacggcgtgcacagaatcagagtggacttcaagttcgtgtactgccaggtgtgctgcgagcccttccacaagttctgcctggaggagaacgagagacccctggaggaccagctggagaactggtgctgcagaagatgcaagttctgccacgtgtgcggcagacagcaccaggccaccaagcagctgctggagtgcaacaagtgcagaaacagctaccaccccgagtgcctgggccccaactaccccaccaagcccaccaagaagaagaaggtgtggatctgcaccaagtgcgtgagatgcaagagctgcggcagcaccacccccggcaagggctgggacgcccagtggagccacgacttcagcctgtgccacgactgcgccaagctgttcgccaagggcaacttctgccccctgtgcgacaagtgctacgacgacgacgactacgagagcaagatgatgcagtgcggcaagtgcgacagatgggtgcacagcaagtgcgagaacctgagcgacgagatgtacgagatcctgagcaacctgcccgagagcgtggcctacacctgcgtgaactgcaccgagagacaccccgccgagtggagactggccctggagaaggagctgcagatcagcctgaagcaggtgctgaccgccctgctgaacagcagaaccaccagccacctgctgagatacagacaggccgccaagccccccgacctgaaccccgagaccgaggagagcatccccagcagaagcagccccgagggccccgacccccccgtgctgaccgaggtgagcaagcaggacgaccagcagcccctggacctggagggcgtgaagagaaagatggaccagggcaactacaccagcgtgctggagttcagcgacgacatcgtgaagatcatccaggccgccatcaacagcgacggcggccagcccgagatcaagaaggccaacagcatggtgaagagcttcttcatcagacagatggagagagtgttcccctggttcagcgtgaagaagagcagattctgggagcccaacaaggtgagcagcaacagcggcatgctgcccaacgccgtgctgccccccagcctggaccacaactacgcccagtggcaggagagagaggagaacagccacaccgagcagccccccctgatgaagaagatcatccccgcccccaagcccaagggccccggcgagcccgacagccccacccccctgcacccccccaccccccccatcctgagcaccgacagaagcagagaggacagccccgagctgaaccccccccccggcatcgaggacaacagacagtgcgccctgtgcctgacctacggcgacgacagcgccaacgacgccggcagactgctgtacatcggccagaacgagtggacccacgtgaactgcgccctgtggagcgccgaggtgttcgaggacgacgacggcagcctgaagaacgtgcacatggccgtgatcagaggcaagcagctgagatgcgagttctgccagaagcccggcgccaccgtgggctgctgcctgaccagctgcaccagcaactaccacttcatgtgcagcagagccaagaactgcgtgttcctggacgacaagaaggtgtactgccagagacacagagacctgatcaagggcgaggtggtgcccgagaacggcttcgaggtgttcagaagagtgttcgtggacttcgagggcatcagcctgagaagaaagttcctgaacggcctggagcccgagaacatccacatgatgatcggcagcatgaccatcgactgcctgggcatcctgaacgacctgagcgactgcgaggacaagctgttccccatcggctaccagtgcagcagagtgtactggagcaccaccgacgccagaaagagatgcgtgtacacctgcaagatcgtggagtgcagaccccccgtggtggagcccgacatcaacagcaccgtggagcacgacgagaacagaaccatcgcccacagccccaccagcttcaccgagagcagcagcaaggagagccagaacaccgccgagatcatcagcccccccagccccgacagacccccccacagccagaccagcggcagctgctactaccacgtgatcagcaaggtgcccagaatcagaacccccagctacagccccacccagagaagccccggctgcagacccctgcccagcgccggcagccccacccccaccacccacgagatcgtgaccgtgggcgaccccctgctgagcagcggcctgagaagcatcggcagcagaagacacagcaccagcagcctgagcccccagagaagcaagctgagaatcatgagccccatgagaaccggcaacacctacagcagaaacaacgtgagcagcgtgagcaccaccggcaccgccaccgacctggagagcagcgccaaggtggtggaccacgtgctgggccccctgaacagcagcaccagcctgggccagaacaccagcaccagcagcaacctgcagagaaccgtggtgaccgtgggcaacaagaacagccacctggacggcagcagcagcagcgagatgaagcagagcagcgccagcgacctggtgagcaagagcagcagcctgaagggcgagaagaccaaggtgctgagcagcaagagcagcgagggcagcgcccacaacgtggcctaccccggcatccccaagctggccccccaggtgcacaacaccaccagcagagagctgaacgtgagcaagatcggcagcttcgccgagcccagcagcgtgagcttcagcagcaaggaggccctgagcttcccccacctgcacctgagaggccagagaaacgacagagaccagcacaccgacagcacccagagcgccaacagcagccccgacgaggacaccgaggtgaagaccctgaagctgagcggcatgagcaacagaagcagcatcatcaacgagcacatgggcagcagcagcagagacagaagacagaagggcaagaagagctgcaaggagaccttcaaggagaagcacagcagcaagagcttcctggagcccggccaggtgaccaccggcgaggagggcaacctgaagcccgagttcatggacgaggtgctgacccccgagtacatgggccagagaccctgcaacaacgtgagcagcgacaagatcggcgacaagggcctgagcatgcccggcgtgcccaaggccccccccatgcaggtggagggcagcgccaaggagctgcaggcccccagaaagagaaccgtgaaggtgaccctgacccccctgaagatggagaacgagagccagagcaagaacgccctgaaggagagcagccccgccagccccctgcagatcgagagcaccagccccaccgagcccatcagcgccagcgagaaccccggcgacggccccgtggcccagcccagccccaacaacaccagctgccaggacagccagagcaacaactaccagaacctgcccgtgcaggacagaaacctgatgctgcccgacggccccaagccccaggaggacggcagcttcaagagaagataccccagaagaagcgccagagccagaagcaacatgttcttcggcctgacccccctgtacggcgtgagaagctacggcgaggaggacatccccttctacagcagcagcaccggcaagaagagaggcaagagaagcgccgagggccaggtggacggcgccgacgacctgagcaccagcgacgaggacgacctgtactactacaacttcaccagaaccgtgatcagcagcggcggcgaggagagactggccagccacaacctgttcagagaggaggagcagtgcgacctgcccaagatcagccagctggacggcgtggacgacggcaccgagagcgacaccagcgtgaccgccaccaccagaaagagcagccagatccccaagagaaacggcaaggagaacggcaccgagaacctgaagatcgacagacccgaggacgccggcgagaaggagcacgtgaccaagagcagcgtgggccacaagaacgagcccaagatggacaactgccacagcgtgagcagagtgaagacccagggccaggacagcctggaggcccagctgagcagcctggagagcagcagaagagtgcacaccagcacccccagcgacaagaacctgctggacacctacaacaccgagctgctgaagagcgacagcgacaacaacaacagcgacgactgcggcaacatcctgcccagcgacatcatggacttcgtgctgaagaacacccccagcatgcaggccctgggcgagagccccgagagcagcagcagcgagctgctgaacctgggcgagggcctgggcctggacagcaacagagagaaggacatgggcctgttcgaggtgttcagccagcagctgcccaccaccgagcccgtggacagcagcgtgagcagcagcatcagcgccgaggagcagttcgagctgcccctggagctgcccagcgacctgagcgtgctgaccaccagaagccccaccgtgcccagccagaaccccagcagactggccgtgatcagcgacagcggcgagaagagagtgaccatcaccgagaagagcgtggccagcagcgagagcgaccccgccctgctgagccccggcgtggaccccacccccgagggccacatgacccccgaccacttcatccagggccacatggacgccgaccacatcagcagccccccctgcggcagcgtggagcagggccacggcaacaaccaggacctgaccagaaacagcagcacccccggcctgcaggtgcccgtgagccccaccgtgcccatccagaaccagaagtacgtgcccaacagcaccgacagccccggccccagccagatcagcaacgccgccgtgcagaccacccccccccacctgaagcccgccaccgagaagctgatcgtggtgaaccagaacatgcagcccctgtacgtgctgcagaccctgcccaacggcgtgacccagaagatccagctgaccagcagcgtgagcagcacccccagcgtgatggagaccaacaccagcgtgctgggccccatgggcggcggcctgaccctgaccaccggcctgaaccccagcctgcccaccagccagagcctgttccccagcgccagcaagggcctgctgcccatgagccaccaccagcacctgcacagcttccccgccgccacccagagcagcttcccccccaacatcagcaacccccccagcggcctgctgatcggcgtgcagcccccccccgacccccagctgctggtgagcgagagcagccagagaaccgacctgagcaccaccgtggccacccccagcagcggcctgaagaagagacccatcagcagactgcagaccagaaagaacaagaagctggcccccagcagcacccccagcaacatcgcccccagcgacgtggtgagcaacatgaccctgatcaacttcacccccagccagctgcccaaccaccccagcctgctggacctgggcagcctgaacaccagcagccacagaaccgtgcccaacatcatcaagagaagcaagagcagcatcatgtacttcgagcccgcccccctgctgccccagagcgtgggcggcaccgccgccaccgccgccggcaccagcaccatcagccaggacaccagccacctgaccagcggcagcgtgagcggcctggccagcagcagcagcgtgctgaacgtggtgagcatgcagaccaccaccacccccaccagcagcgccagcgtgcccggccacgtgaccctgaccaaccccagactgctgggcacccccgacatcggcagcatcagcaacctgctgatcaaggccagccagcagagcctgggcatccaggaccagcccgtggccctgccccccagcagcggcatgttcccccagctgggcaccagccagacccccagcaccgccgccatcaccgccgccagcagcatctgcgtgctgcccagcacccagaccaccggcatcaccgccgccagccccagcggcgaggccgacgagcactaccagctgcagcacgtgaaccagctgctggccagcaagaccggcatccacagcagccagagagacctggacagcgccagcggcccccaggtgagcaacttcacccagaccgtggacgcccccaacagcatgggcctggagcagaacaaggccctgagcagcgccgtgcaggccagccccaccagccccggcggcagccccagcagccccagcagcggccagagaagcgccagccccagcgtgcccggccccaccaagcccaagcccaagaccaagagattccagctgcccctggacaagggcaacggcaagaagcacaaggtgagccacctgagaaccagcagcagcgaggcccacatccccgaccaggagaccaccagcctgaccagcggcaccggcacccccggcgccgaggccgagcagcaggacaccgccagcgtggagcagagcagccagaaggagtgcggccagcccgccggccaggtggccgtgctgcccgaggtgcaggtgacccagaaccccgccaacgagcaggagagcgccgagcccaagaccgtggaggaggaggagagcaacttcagcagccccctgatgctgtggctgcagcaggagcagaagagaaaggagagcatcaccgagaagaagcccaagaagggcctggtgttcgagatcagcagcgacgacggcttccagatctgcgccgagagcatcgaggacgcctggaagagcctgaccgacaaggtgcaggaggccagaagcaacgccagactgaagcagctgagcttcgccggcgtgaacggcctgagaatgctgggcatcctgcacgacgccgtggtgttcctgatcgagcagctgagcggcgccaagcactgcagaaactacaagttcagattccacaagcccgaggaggccaacgagccccccctgaacccccacggcagcgccagagccgaggtgcacctgagaaagagcgccttcgacatgttcaacttcctggccagcaagcacagacagccccccgagtacaaccccaacgacgaggaggaggaggaggtgcagctgaagagcgccagaagagccaccagcatggacctgcccatgcccatgagattcagacacctgaagaagaccagcaaggaggccgtgggcgtgtacagaagccccatccacggcagaggcctgttctgcaagagaaacatcgacgccggcgagatggtgatcgagtacgccggcaacgtgatcagaagcatccagaccgacaagagagagaagtactacgacagcaagggcatcggctgctacatgttcagaatcgacgacagcgaggtggtggacgccaccatgcacggcaacgccgccagattcatcaaccacagctgcgagcccaactgctacagcagagtgatcaacatcgacggccagaagcacatcgtgatcttcgccatgagaaagatctacagaggcgaggagctgacctacgactacaagttccccatcgaggacgccagcaacaagctgccctgcaactgcggcgccaagaagtgcagaaagttcctgaactag

SEQ ID NO: 89834 - DNA, 8640 bp, Artificial Sequence
  Description of Artificial Sequence: Synthetic coding sequence
cacgcccaccccgagtgcctgaccatggagagagagaagatcctgagcagcatgggcaacgacgacaagagcagcatcgccggcagcgaggacgccgagcccctggccccccccatcaagcccatcaagcccgtgaccagaaacaaggccccccaggagccccccgtgaagaagggcagaagaagcagaagatgcggccagtgccccggctgccaggtgcccgaggactgcggcgtgtgcaccaactgcctggacaagcccaagttcggcggcagaaacatcaagaagcagtgctgcaagatgagaaagtgccagaacctgcagtggatgcccagcaaggcctacctgcagaagcaggccaaggccgtgaagaagaaggagaagaagagcaagaccagcgagaagaaggacagcaaggagagcagcgtggtgaagaacgtggtggacagcagccagaagcccacccccagcgccagagaggaccccgcccccaagaagagcagcagcgagcccccccccagaaagcccgtggaggagaagagcgaggagggcaacgtgagcgcccccggccccgagagcaagcaggccaccacccccgccagcagaaagagcagcaagcaggtgagccagcccgccctggtgatccccccccagccccccaccaccggcccccccagaaaggaggtgcccaagaccacccccagcgagcccaagaagaagcagccccccccccccgagagcggccccgagcagagcaagcagaagaaggtggcccccagacccagcatccccgtgaagcagaagcccaaggagaaggagaagcccccccccgtgaacaagcaggagaacgccggcaccctgaacatcctgagcaccctgagcaacggcaacagcagcaagcagaagatccccgccgacggcgtgcacagaatcagagtggacttcaaggaggactgcgaggccgagaacgtgtgggagatgggcggcctgggcatcctgaccagcgtgcccatcacccccagagtggtgtgcttcctgtgcgccagcagcggccacgtggagttcgtgtactgccaggtgtgctgcgagcccttccacaagttctgcctggaggagaacgagagacccctggaggaccagctggagaactggtgctgcagaagatgcaagttctgccacgtgtgcggcagacagcaccaggccaccaagcagctgctggagtgcaacaagtgcagaaacagctaccaccccgagtgcctgggccccaactaccccaccaagcccaccaagaagaagaaggtgtggatctgcaccaagtgcgtgagatgcaagagctgcggcagcaccacccccggcaagggctgggacgcccagtggagccacgacttcagcctgtgccacgactgcgccaagctgttcgccaagggcaacttctgccccctgtgcgacaagtgctacgacgacgacgactacgagagcaagatgatgcagtgcggcaagtgcgacagatgggtgcacagcaagtgcgagaacctgagcgacgagatgtacgagatcctgagcaacctgcccgagagcgtggcctacacctgcgtgaactgcaccgagagacaccccgccgagtggagactggccctggagaaggagctgcagatcagcctgaagcaggtgctgaccgccctgctgaacagcagaaccaccagccacctgctgagatacagacaggccgccaagccccccgacctgaaccccgagaccgaggagagcatccccagcagaagcagccccgagggccccgacccccccgtgctgaccgaggtgagcaagcaggacgaccagcagcccctggacctggagggcgtgaagagaaagatggaccagggcaactacaccagcgtgctggagttcagcgacgacatcgtgaagatcatccaggccgccatcaacagcgacggcggccagcccgagatcaagaaggccaacagcatggtgaagagcttcttcatcagacagatggagagagtgttcccctggttcagcgtgaagaagagcagattctgggagcccaacaaggtgagcagcaacagcggcatgctgcccaacgccgtgctgccccccagcctggaccacaactacgcccagtggcaggagagagaggagaacagccacaccgagcagccccccctgatgaagaagatcatccccgcccccaagcccaagggccccggcgagcccgacagccccacccccctgcacccccccaccccccccatcctgagcaccgacagaagcagagaggacagccccgagctgaaccccccccccggcatcgaggacaacagacagtgcgccctgtgcctgacctacggcgacgacagcgccaacgacgccggcagactgctgtacatcggccagaacgagtggacccacgtgaactgcgccctgtggagcgccgaggtgttcgaggacgacgacggcagcctgaagaacgtgcacatggccgtgatcagaggcaagcagctgagatgcgagttctgccagaagcccggcgccaccgtgggctgctgcctgaccagctgcaccagcaactaccacttcatgtgcagcagagccaagaactgcgtgttcctggacgacaagaaggtgtactgccagagacacagagacctgatcaagggcgaggtggtgcccgagaacggcttcgaggtgttcagaagagtgttcgtggacttcgagggcatcagcctgagaagaaagttcctgaacggcctggagcccgagaacatccacatgatgatcggcagcatgaccatcgactgcctgggcatcctgaacgacctgagcgactgcgaggacaagctgttccccatcggctaccagtgcagcagagtgtactggagcaccaccgacgccagaaagagatgcgtgtacacctgcaagatcgtggagtgcagaccccccgtggtggagcccgacatcaacagcaccgtggagcacgacgagaacagaaccatcgcccacagccccaccagcttcaccgagagcagcagcaaggagagccagaacaccgccgagatcatcagcccccccagccccgacagacccccccacagccagaccagcggcagctgctactaccacgtgatcagcaaggtgcccagaatcagaacccccagctacagccccacccagagaagccccggctgcagacccctgcccagcgccggcagccccacccccaccacccacgagatcgtgaccgtgggcgaccccctgctgagcagcggcctgagaagcatcggcagcagaagacacagcaccagcagcctgagcccccagagaagcaagctgagaatcatgagccccatgagaaccggcaacacctacagcagaaacaacgtgagcagcgtgagcaccaccggcaccgccaccgacctggagagcagcgccaaggtggtggaccacgtgctgggccccctgaacagcagcaccagcctgggccagaacaccagcaccagcagcaacctgcagagaaccgtggtgaccgtgggcaacaagaacagccacctggacggcagcagcagcagcgagatgaagcagagcagcgccagcgacctggtgagcaagagcagcagcctgaagggcgagaagaccaaggtgctgagcagcaagagcagcgagggcagcgcccacaacgtggcctaccccggcatccccaagctggccccccaggtgcacaacaccaccagcagagagctgaacgtgagcaagatcggcagcttcgccgagcccagcagcgtgagcttcagcagcaaggaggccctgagcttcccccacctgcacctgagaggccagagaaacgacagagaccagcacaccgacagcacccagagcgccaacagcagccccgacgaggacaccgaggtgaagaccctgaagctgagcggcatgagcaacagaagcagcatcatcaacgagcacatgggcagcagcagcagagacagaagacagaagggcaagaagagctgcaaggagaccttcaaggagaagcacagcagcaagagcttcctggagcccggccaggtgaccaccggcgaggagggcaacctgaagcccgagttcatggacgaggtgctgacccccgagtacatgggccagagaccctgcaacaacgtgagcagcgacaagatcggcgacaagggcctgagcatgcccggcgtgcccaaggccccccccatgcaggtggagggcagcgccaaggagctgcaggcccccagaaagagaaccgtgaaggtgaccctgacccccctgaagatggagaacgagagccagagcaagaacgccctgaaggagagcagccccgccagccccctgcagatcgagagcaccagccccaccgagcccatcagcgccagcgagaaccccggcgacggccccgtggcccagcccagccccaacaacaccagctgccaggacagccagagcaacaactaccagaacctgcccgtgcaggacagaaacctgatgctgcccgacggccccaagccccaggaggacggcagcttcaagagaagataccccagaagaagcgccagagccagaagcaacatgttcttcggcctgacccccctgtacggcgtgagaagctacggcgaggaggacatccccttctacagcagcagcaccggcaagaagagaggcaagagaagcgccgagggccaggtggacggcgccgacgacctgagcaccagcgacgaggacgacctgtactactacaacttcaccagaaccgtgatcagcagcggcggcgaggagagactggccagccacaacctgttcagagaggaggagcagtgcgacctgcccaagatcagccagctggacggcgtggacgacggcaccgagagcgacaccagcgtgaccgccaccaccagaaagagcagccagatccccaagagaaacggcaaggagaacggcaccgagaacctgaagatcgacagacccgaggacgccggcgagaaggagcacgtgaccaagagcagcgtgggccacaagaacgagcccaagatggacaactgccacagcgtgagcagagtgaagacccagggccaggacagcctggaggcccagctgagcagcctggagagcagcagaagagtgcacaccagcacccccagcgacaagaacctgctggacacctacaacaccgagctgctgaagagcgacagcgacaacaacaacagcgacgactgcggcaacatcctgcccagcgacatcatggacttcgtgctgaagaacacccccagcatgcaggccctgggcgagagccccgagagcagcagcagcgagctgctgaacctgggcgagggcctgggcctggacagcaacagagagaaggacatgggcctgttcgaggtgttcagccagcagctgcccaccaccgagcccgtggacagcagcgtgagcagcagcatcagcgccgaggagcagttcgagctgcccctggagctgcccagcgacctgagcgtgctgaccaccagaagccccaccgtgcccagccagaaccccagcagactggccgtgatcagcgacagcggcgagaagagagtgaccatcaccgagaagagcgtggccagcagcgagagcgaccccgccctgctgagccccggcgtggaccccacccccgagggccacatgacccccgaccacttcatccagggccacatggacgccgaccacatcagcagccccccctgcggcagcgtggagcagggccacggcaacaaccaggacctgaccagaaacagcagcacccccggcctgcaggtgcccgtgagccccaccgtgcccatccagaaccagaagtacgtgcccaacagcaccgacagccccggccccagccagatcagcaacgccgccgtgcagaccacccccccccacctgaagcccgccaccgagaagctgatcgtggtgaaccagaacatgcagcccctgtacgtgctgcagaccctgcccaacggcgtgacccagaagatccagctgaccagcagcgtgagcagcacccccagcgtgatggagaccaacaccagcgtgctgggccccatgggcggcggcctgaccctgaccaccggcctgaaccccagcctgcccaccagccagagcctgttccccagcgccagcaagggcctgctgcccatgagccaccaccagcacctgcacagcttccccgccgccacccagagcagcttcccccccaacatcagcaacccccccagcggcctgctgatcggcgtgcagcccccccccgacccccagctgctggtgagcgagagcagccagagaaccgacctgagcaccaccgtggccacccccagcagcggcctgaagaagagacccatcagcagactgcagaccagaaagaacaagaagctggcccccagcagcacccccagcaacatcgcccccagcgacgtggtgagcaacatgaccctgatcaacttcacccccagccagctgcccaaccaccccagcctgctggacctgggcagcctgaacaccagcagccacagaaccgtgcccaacatcatcaagagaagcaagagcagcatcatgtacttcgagcccgcccccctgctgccccagagcgtgggcggcaccgccgccaccgccgccggcaccagcaccatcagccaggacaccagccacctgaccagcggcagcgtgagcggcctggccagcagcagcagcgtgctgaacgtggtgagcatgcagaccaccaccacccccaccagcagcgccagcgtgcccggccacgtgaccctgaccaaccccagactgctgggcacccccgacatcggcagcatcagcaacctgctgatcaaggccagccagcagagcctgggcatccaggaccagcccgtggccctgccccccagcagcggcatgttcccccagctgggcaccagccagacccccagcaccgccgccatcaccgccgccagcagcatctgcgtgctgcccagcacccagaccaccggcatcaccgccgccagccccagcggcgaggccgacgagcactaccagctgcagcacgtgaaccagctgctggccagcaagaccggcatccacagcagccagagagacctggacagcgccagcggcccccaggtgagcaacttcacccagaccgtggacgcccccaacagcatgggcctggagcagaacaaggccctgagcagcgccgtgcaggccagccccaccagccccggcggcagccccagcagccccagcagcggccagagaagcgccagccccagcgtgcccggccccaccaagcccaagcccaagaccaagagattccagctgcccctggacaagggcaacggcaagaagcacaaggtgagccacctgagaaccagcagcagcgaggcccacatccccgaccaggagaccaccagcctgaccagcggcaccggcacccccggcgccgaggccgagcagcaggacaccgccagcgtggagcagagcagccagaaggagtgcggccagcccgccggccaggtggccgtgctgcccgaggtgcaggtgacccagaaccccgccaacgagcaggagagcgccgagcccaagaccgtggaggaggaggagagcaacttcagcagccccctgatgctgtggctgcagcaggagcagaagagaaaggagagcatcaccgagaagaagcccaagaagggcctggtgttcgagatcagcagcgacgacggcttccagatctgcgccgagagcatcgaggacgcctggaagagcctgaccgacaaggtgcaggaggccagaagcaacgccagactgaagcagctgagcttcgccggcgtgaacggcctgagaatgctgggcatcctgcacgacgccgtggtgttcctgatcgagcagctgagcggcgccaagcactgcagaaactacaagttcagattccacaagcccgaggaggccaacgagccccccctgaacccccacggcagcgccagagccgaggtgcacctgagaaagagcgccttcgacatgttcaacttcctggccagcaagcacagacagccccccgagtacaaccccaacgacgaggaggaggaggaggtgcagctgaagagcgccagaagagccaccagcatggacctgcccatgcccatgagattcagacacctgaagaagaccagcaaggaggccgtgggcgtgtacagaagccccatccacggcagaggcctgttctgcaagagaaacatcgacgccggcgagatggtgatcgagtacgccggcaacgtgatcagaagcatccagaccgacaagagagagaagtactacgacagcaagggcatcggctgctacatgttcagaatcgacgacagcgaggtggtggacgccaccatgcacggcaacgccgccagattcatcaaccacagctgcgagcccaactgctacagcagagtgatcaacatcgacggccagaagcacatcgtgatcttcgccatgagaaagatctacagaggcgaggagctgacctacgactacaagttccccatcgaggacgccagcaacaagctgccctgcaactgcggcgccaagaagtgcagaaagttcctgaactag

SEQ ID NO: 89835 - DNA, 11910 bp, Artificial Sequence
  Description of Artificial Sequence: Synthetic coding sequence
atggcccacagctgcagatggagattccccgccagacccggcaccaccggcggcggcggcggcggcggcagaagaggcctgggcggcgcccccagacagagagtgcccgccctgctgctgccccccggcccccccgtgggcggcggcggccccggcgccccccccagcccccccgccgtggccgccgccgccgccgccgccggcagcagcggcgccggcgtgcccggcggcgccgccgccgccagcgccgccagcagcagcagcgccagcagcagcagcagcagcagcagcagcgccagcagcggccccgccctgctgagagtgggccccggcttcgacgccgccctgcaggtgagcgccgccatcggcaccaacctgagaagattcagagccgtgttcggcgagagcggcggcggcggcggcagcggcgaggacgagcagttcctgggcttcggcagcgacgaggaggtgagagtgagaagccccaccagaagccccagcgtgaagaccagccccagaaagcccagaggcagacccagaagcggcagcgacagaaacagcgccatcctgagcgaccccagcgtgttcagccccctgaacaagagcgagaccaagagcggcgacaagatcaagaagaaggacagcaagagcatcgagaagaagagaggcagaccccccaccttccccggcgtgaagatcaagatcacccacggcaaggacatcagcgagctgcccaagggcaacaaggaggacagcctgaagaagatcaagagaacccccagcgccaccttccagcaggccaccaagatcaagaagctgagagccggcaagctgagccccctgaagagcaagttcaagaccggcaagctgcagatcggcagaaagggcgtgcagatcgtgagaagaagaggcagaccccccagcaccgagagaatcaagacccccagcggcctgctgatcaacagcgagctggagaagccccagaaggtgagaaaggacaaggagggcaccccccccctgaccaaggaggacaagaccgtggtgagacagagccccagaagaatcaagcccgtgagaatcatccccagcagcaagagaaccgacgccaccatcgccaagcagctgctgcagagagccaagaagggcgcccagaagaagatcgagaaggaggccgcccagctgcagggcagaaaggtgaagacccaggtgaagaacatcagacagttcatcatgcccgtggtgagcgccatcagcagcagaatcatcaagacccccagaagattcatcgaggacgaggactacgacccccccatcaagatcgccagactggagagcacccccaacagcagattcagcgcccccagctgcggcagcagcgagaagagcagcgccgccagccagcacagcagccagatgagcagcgacagcagcagaagcagcagccccagcgtggacaccagcaccgacagccaggccagcgaggagatccaggtgctgcccgaggagagaagcgacacccccgaggtgcacccccccctgcccatcagccagagccccgagaacgagagcaacgacagaagaagcagaagatacagcgtgagcgagagaagcttcggcagcagaaccaccaagaagctgagcaccctgcagagcgccccccagcagcagaccagcagcagcccccccccccccctgctgaccccccccccccccctgcagcccgccagcagcatcagcgaccacaccccctggctgatgccccccaccatccccctggccagccccttcctgcccgccagcaccgcccccatgcagggcaagagaaagagcatcctgagagagcccaccttcagatggaccagcctgaagcacagcagaagcgagccccagtacttcagcagcgccaagtacgccaaggagggcctgatcagaaagcccatcttcgacaacttcagacccccccccctgacccccgaggacgtgggcttcgccagcggcttcagcgccagcggcaccgccgccagcgccagactgttcagccccctgcacagcggcaccagattcgacatgcacaagagaagccccctgctgagagcccccagattcacccccagcgaggcccacagcagaatcttcgagagcgtgaccctgcccagcaacagaaccagcgccggcaccagcagcagcggcgtgagcaacagaaagagaaagagaaaggtgttcagccccatcagaagcgagcccagaagccccagccacagcatgagaaccagaagcggcagactgagcagcagcgagctgagccccctgaccccccccagcagcgtgagcagcagcctgagcatcagcgtgagccccctggccaccagcgccctgaaccccaccttcaccttccccagccacagcctgacccagagcggcgagagcgccgagaagaaccagagacccagaaagcagaccagcgcccccgccgagcccttcagcagcagcagccccacccccctgttcccctggttcacccccggcagccagaccgagagaggcagaaacaaggacaaggcccccgaggagctgagcaaggacagagacgccgacaagagcgtggagaaggacaagagcagagagagagacagagagagagagaaggagaacaagagagagagcagaaaggagaagagaaagaagggcagcgagatccagagcagcagcgccctgtaccccgtgggcagagtgagcaaggagaaggtggtgggcgaggacgtggccaccagcagcagcgccaagaaggccaccggcagaaagaagagcagcagccacgacagcggcaccgacatcaccagcgtgaccctgggcgacaccaccgccgtgaagaccaagatcctgatcaagaagggcagaggcaacctggagaagaccaacctggacctgggccccaccgcccccagcctggagaaggagaagaccctgtgcctgagcacccccagcagcagcaccgtgaagcacagcaccagcagcatcggcagcatgctggcccaggccgacaagctgcccatgaccgacaagagagtggccagcctgctgaagaaggccaaggcccagctgtgcaagatcgagaagagcaagagcctgaagcagaccgaccagcccaaggcccagggccaggagagcgacagcagcgagaccagcgtgagaggccccagaatcaagcacgtgtgcagaagagccgccgtggccctgggcagaaagagagccgtgttccccgacgacatgcccaccctgagcgccctgccctgggaggagagagagaagatcctgagcagcatgggcaacgacgacaagagcagcatcgccggcagcgaggacgccgagcccctggccccccccatcaagcccatcaagcccgtgaccagaaacaaggccccccaggagccccccgtgaagaagggcagaagaagcagaagatgcggccagtgccccggctgccaggtgcccgaggactgcggcgtgtgcaccaactgcctggacaagcccaagttcggcggcagaaacatcaagaagcagtgctgcaagatgagaaagtgccagaacctgcagtggatgcccagcaaggcctacctgcagaagcaggccaaggccgtgaagaagaaggagaagaagagcaagaccagcgagaagaaggacagcaaggagagcagcgtggtgaagaacgtggtggacagcagccagaagcccacccccagcgccagagaggaccccgcccccaagaagagcagcagcgagcccccccccagaaagcccgtggaggagaagagcgaggagggcaacgtgagcgcccccggccccgagagcaagcaggccaccacccccgccagcagaaagagcagcaagcaggtgagccagcccgccctggtgatccccccccagccccccaccaccggcccccccagaaaggaggtgcccaagaccacccccagcgagcccaagaagaagcagccccccccccccgagagcggccccgagcagagcaagcagaagaaggtggcccccagacccagcatccccgtgaagcagaagcccaaggagaaggagaagcccccccccgtgaacaagcaggagaacgccggcaccctgaacatcctgagcaccctgagcaacggcaacagcagcaagcagaagatccccgccgacggcgtgcacagaatcagagtggacttcaaggaggactgcgaggccgagaacgtgtgggagatgggcggcctgggcatcctgaccagcgtgcccatcacccccagagtggtgtgcttcctgtgcgccagcagcggccacgtggagttcgtgtactgccaggtgtgctgcgagcccttccacaagttctgcctggaggagaacgagagacccctggaggaccagctggagaactggtgctgcagaagatgcaagttctgccacgtgtgcggcagacagcaccaggccaccaagcagctgctggagtgcaacaagtgcagaaacagctaccaccccgagtgcctgggccccaactaccccaccaagcccaccaagaagaagaaggtgtggatctgcaccaagtgcgtgagatgcaagagctgcggcagcaccacccccggcaagggctgggacgcccagtggagccacgacttcagcctgtgccacgactgcgccaagctgttcgccaagggcaacttctgccccctgtgcgacaagtgctacgacgacgacgactacgagagcaagatgatgcagtgcggcaagtgcgacagatgggtgcacagcaagtgcgagaacctgagcgacgagatgtacgagatcctgagcaacctgcccgagagcgtggcctacacctgcgtgaactgcaccgagagacaccccgccgagtggagactggccctggagaaggagctgcagatcagcctgaagcaggtgctgaccgccctgctgaacagcagaaccaccagccacctgctgagatacagacaggccgccaagccccccgacctgaaccccgagaccgaggagagcatccccagcagaagcagccccgagggccccgacccccccgtgctgaccgaggtgagcaagcaggacgaccagcagcccctggacctggagggcgtgaagagaaagatggaccagggcaactacaccagcgtgctggagttcagcgacgacatcgtgaagatcatccaggccgccatcaacagcgacggcggccagcccgagatcaagaaggccaacagcatggtgaagagcttcttcatcagacagatggagagagtgttcccctggttcagcgtgaagaagagcagattctgggagcccaacaaggtgagcagcaacagcggcatgctgcccaacgccgtgctgccccccagcctggaccacaactacgcccagtggcaggagagagaggagaacagccacaccgagcagccccccctgatgaagaagatcatccccgcccccaagcccaagggccccggcgagcccgacagccccacccccctgcacccccccaccccccccatcctgagcaccgacagaagcagagaggacagccccgagctgaaccccccccccggcatcgaggacaacagacagtgcgccctgtgcctgacctacggcgacgacagcgccaacgacgccggcagactgctgtacatcggccagaacgagtggacccacgtgaactgcgccctgtggagcgccgaggtgttcgaggacgacgacggcagcctgaagaacgtgcacatggccgtgatcagaggcaagcagctgagatgcgagttctgccagaagcccggcgccaccgtgggctgctgcctgaccagctgcaccagcaactaccacttcatgtgcagcagagccaagaactgcgtgttcctggacgacaagaaggtgtactgccagagacacagagacctgatcaagggcgaggtggtgcccgagaacggcttcgaggtgttcagaagagtgttcgtggacttcgagggcatcagcctgagaagaaagttcctgaacggcctggagcccgagaacatccacatgatgatcggcagcatgaccatcgactgcctgggcatcctgaacgacctgagcgactgcgaggacaagctgttccccatcggctaccagtgcagcagagtgtactggagcaccaccgacgccagaaagagatgcgtgtacacctgcaagatcgtggagtgcagaccccccgtggtggagcccgacatcaacagcaccgtggagcacgacgagaacagaaccatcgcccacagccccaccagcttcaccgagagcagcagcaaggagagccagaacaccgccgagatcatcagcccccccagccccgacagacccccccacagccagaccagcggcagctgctactaccacgtgatcagcaaggtgcccagaatcagaacccccagctacagccccacccagagaagccccggctgcagacccctgcccagcgccggcagccccacccccaccacccacgagatcgtgaccgtgggcgaccccctgctgagcagcggcctgagaagcatcggcagcagaagacacagcaccagcagcctgagcccccagagaagcaagctgagaatcatgagccccatgagaaccggcaacacctacagcagaaacaacgtgagcagcgtgagcaccaccggcaccgccaccgacctggagagcagcgccaaggtggtggaccacgtgctgggccccctgaacagcagcaccagcctgggccagaacaccagcaccagcagcaacctgcagagaaccgtggtgaccgtgggcaacaagaacagccacctggacggcagcagcagcagcgagatgaagcagagcagcgccagcgacctggtgagcaagagcagcagcctgaagggcgagaagaccaaggtgctgagcagcaagagcagcgagggcagcgcccacaacgtggcctaccccggcatccccaagctggccccccaggtgcacaacaccaccagcagagagctgaacgtgagcaagatcggcagcttcgccgagcccagcagcgtgagcttcagcagcaaggaggccctgagcttcccccacctgcacctgagaggccagagaaacgacagagaccagcacaccgacagcacccagagcgccaacagcagccccgacgaggacaccgaggtgaagaccctgaagctgagcggcatgagcaacagaagcagcatcatcaacgagcacatgggcagcagcagcagagacagaagacagaagggcaagaagagctgcaaggagaccttcaaggagaagcacagcagcaagagcttcctggagcccggccaggtgaccaccggcgaggagggcaacctgaagcccgagttcatggacgaggtgctgacccccgagtacatgggccagagaccctgcaacaacgtgagcagcgacaagatcggcgacaagggcctgagcatgcccggcgtgcccaaggccccccccatgcaggtggagggcagcgccaaggagctgcaggcccccagaaagagaaccgtgaaggtgaccctgacccccctgaagatggagaacgagagccagagcaagaacgccctgaaggagagcagccccgccagccccctgcagatcgagagcaccagccccaccgagcccatcagcgccagcgagaaccccggcgacggccccgtggcccagcccagccccaacaacaccagctgccaggacagccagagcaacaactaccagaacctgcccgtgcaggacagaaacctgatgctgcccgacggccccaagccccaggaggacggcagcttcaagagaagataccccagaagaagcgccagagccagaagcaacatgttcttcggcctgacccccctgtacggcgtgagaagctacggcgaggaggacatccccttctacagcagcagcaccggcaagaagagaggcaagagaagcgccgagggccaggtggacggcgccgacgacctgagcaccagcgacgaggacgacctgtactactacaacttcaccagaaccgtgatcagcagcggcggcgaggagagactggccagccacaacctgttcagagaggaggagcagtgcgacctgcccaagatcagccagctggacggcgtggacgacggcaccgagagcgacaccagcgtgaccgccaccaccagaaagagcagccagatccccaagagaaacggcaaggagaacggcaccgagaacctgaagatcgacagacccgaggacgccggcgagaaggagcacgtgaccaagagcagcgtgggccacaagaacgagcccaagatggacaactgccacagcgtgagcagagtgaagacccagggccaggacagcctggaggcccagctgagcagcctggagagcagcagaagagtgcacaccagcacccccagcgacaagaacctgctggacacctacaacaccgagctgctgaagagcgacagcgacaacaacaacagcgacgactgcggcaacatcctgcccagcgacatcatggacttcgtgctgaagaacacccccagcatgcaggccctgggcgagagccccgagagcagcagcagcgagctgctgaacctgggcgagggcctgggcctggacagcaacagagagaaggacatgggcctgttcgaggtgttcagccagcagctgcccaccaccgagcccgtggacagcagcgtgagcagcagcatcagcgccgaggagcagttcgagctgcccctggagctgcccagcgacctgagcgtgctgaccaccagaagccccaccgtgcccagccagaaccccagcagactggccgtgatcagcgacagcggcgagaagagagtgaccatcaccgagaagagcgtggccagcagcgagagcgaccccgccctgctgagccccggcgtggaccccacccccgagggccacatgacccccgaccacttcatccagggccacatggacgccgaccacatcagcagccccccctgcggcagcgtggagcagggccacggcaacaaccaggacctgaccagaaacagcagcacccccggcctgcaggtgcccgtgagccccaccgtgcccatccagaaccagaagtacgtgcccaacagcaccgacagccccggccccagccagatcagcaacgccgccgtgcagaccacccccccccacctgaagcccgccaccgagaagctgatcgtggtgaaccagaacatgcagcccctgtacgtgctgcagaccctgcccaacggcgtgacccagaagatccagctgaccagcagcgtgagcagcacccccagcgtgatggagaccaacaccagcgtgctgggccccatgggcggcggcctgaccctgaccaccggcctgaaccccagcctgcccaccagccagagcctgttccccagcgccagcaagggcctgctgcccatgagccaccaccagcacctgcacagcttccccgccgccacccagagcagcttcccccccaacatcagcaacccccccagcggcctgctgatcggcgtgcagcccccccccgacccccagctgctggtgagcgagagcagccagagaaccgacctgagcaccaccgtggccacccccagcagcggcctgaagaagagacccatcagcagactgcagaccagaaagaacaagaagctggcccccagcagcacccccagcaacatcgcccccagcgacgtggtgagcaacatgaccctgatcaacttcacccccagccagctgcccaaccaccccagcctgctggacctgggcagcctgaacaccagcagccacagaaccgtgcccaacatcatcaagagaagcaagagcagcatcatgtacttcgagcccgcccccctgctgccccagagcgtgggcggcaccgccgccaccgccgccggcaccagcaccatcagccaggacaccagccacctgaccagcggcagcgtgagcggcctggccagcagcagcagcgtgctgaacgtggtgagcatgcagaccaccaccacccccaccagcagcgccagcgtgcccggccacgtgaccctgaccaaccccagactgctgggcacccccgacatcggcagcatcagcaacctgctgatcaaggccagccagcagagcctgggcatccaggaccagcccgtggccctgccccccagcagcggcatgttcccccagctgggcaccagccagacccccagcaccgccgccatcaccgccgccagcagcatctgcgtgctgcccagcacccagaccaccggcatcaccgccgccagccccagcggcgaggccgacgagcactaccagctgcagcacgtgaaccagctgctggccagcaagaccggcatccacagcagccagagagacctggacagcgccagcggcccccaggtgagcaacttcacccagaccgtggacgcccccaacagcatgggcctggagcagaacaaggccctgagcagcgccgtgcaggccagccccaccagccccggcggcagccccagcagccccagcagcggccagagaagcgccagccccagcgtgcccggccccaccaagcccaagcccaagaccaagagattccagctgcccctggacaagggcaacggcaagaagcacaaggtgagccacctgagaaccagcagcagcgaggcccacatccccgaccaggagaccaccagcctgaccagcggcaccggcacccccggcgccgaggccgagcagcaggacaccgccagcgtggagcagagcagccagaaggagtgcggccagcccgccggccaggtggccgtgctgcccgaggtgcaggtgacccagaaccccgccaacgagcaggagagcgccgagcccaagaccgtggaggaggaggagagcaacttcagcagccccctgatgctgtggctgcagcaggagcagaagagaaaggagagcatcaccgagaagaagcccaagaagggcctggtgttcgagatcagcagcgacgacggcttccagatctgcgccgagagcatcgaggacgcctggaagagcctgaccgacaaggtgcaggaggccagaagcaacgccagactgaagcagctgagcttcgccggcgtgaacggcctgagaatgctgggcatcctgcacgacgccgtggtgttcctgatcgagcagctgagcggcgccaagcactgcagaaactacaagttcagattccacaagcccgaggaggccaacgagccccccctgaacccccacggcagcgccagagccgaggtgcacctgagaaagagcgccttcgacatgttcaacttcctggccagcaagcacagacagccccccgagtacaaccccaacgacgaggaggaggaggaggtgcagctgaagagcgccagaagagccaccagcatggacctgcccatgcccatgagattcagacacctgaagaagaccagcaaggaggccgtgggcgtgtacagaagccccatccacggcagaggcctgttctgcaagagaaacatcgacgccggcgagatggtgatcgagtacgccggcaacgtgatcagaagcatccagaccgacaagagagagaagtactacgacagcaagggcatcggctgctacatgttcagaatcgacgacagcgaggtggtggacgccaccatgcacggcaacgccgccagattcatcaaccacagctgcgagcccaactgctacagcagagtgatcaacatcgacggccagaagcacatcgtgatcttcgccatgagaaagatctacagaggcgaggagctgacctacgactacaagttccccatcgaggacgccagcaacaagctgccctgcaactgcggcgccaagaagtgcagaaagttcctgaactag

SEQ ID NO: 89836 - DNA, 336 bp, Artificial Sequence
  Description of Artificial Sequence: Synthetic coding sequence
gacttcaaggacgagcagttcctgggcttcggcagcgacgaggaggtgagagtgagaagccccaccagaagccccagcggcagcatgctggcccaggccgacaagctgcccatgaccgacaagagagtggccagcctgctgaagaaggccaaggcccagctgtgcaagatcgagaagagcaagagcctgaagcagaccgaccagcccaaggcccagggccaggagagcgacagcagcgagaccagcgtgagaggccccagaatcaagcacgtgtgcagaagagccgccgtggccctgggcagaaagagagccgtgttccccgacgacatgccctag

SEQ ID NO: 89837 - DNA, 4320 bp, Artificial Sequence
  Description of Artificial Sequence: Synthetic coding sequence
atggcccacagctgcagatggagattccccgccagacccggcaccaccggcggcggcggcggcggcggcagaagaggcctgggcggcgcccccagacagagagtgcccgccctgctgctgccccccggcccccccgtgggcggcggcggccccggcgccccccccagcccccccgccgtggccgccgccgccgccgccgccggcagcagcggcgccggcgtgcccggcggcgccgccgccgccagcgccgccagcagcagcagcgccagcagcagcagcagcagcagcagcagcgccagcagcggccccgccctgctgagagtgggccccggcttcgacgccgccctgcaggtgagcgccgccatcggcaccaacctgagaagattcagagccgtgttcggcgagagcggcggcggcggcggcagcggcgagctgaccacccagatcccctgcagctggagaaccaagggccacatccacgacaagaagaccgagcccttcagactgctggcctggagctggtgcctgaacgacgagcagttcctgggcttcggcagcgacgaggaggtgagagtgagaagccccaccagaagccccagcgtgaagaccagccccagaaagcccagaggcagacccagaagcggcagcgacagaaacagcgccatcctgagcgaccccagcgtgttcagccccctgaacaagagcgagaccaagagcggcgacaagatcaagaagaaggacagcaagagcatcgagaagaagagaggcagaccccccaccttccccggcgtgaagatcaagatcacccacggcaaggacatcagcgagctgcccaagggcaacaaggaggacagcctgaagaagatcaagagaacccccagcgccaccttccagcaggccaccaagatcaagaagctgagagccggcaagctgagccccctgaagagcaagttcaagaccggcaagctgcagatcggcagaaagggcgtgcagatcgtgagaagaagaggcagaccccccagcaccgagagaatcaagacccccagcggcctgctgatcaacagcgagctggagaagccccagaaggtgagaaaggacaaggagggcaccccccccctgaccaaggaggacaagaccgtggtgagacagagccccagaagaatcaagcccgtgagaatcatccccagcagcaagagaaccgacgccaccatcgccaagcagctgctgcagagagccaagaagggcgcccagaagaagatcgagaaggaggccgcccagctgcagggcagaaaggtgaagacccaggtgaagaacatcagacagttcatcatgcccgtggtgagcgccatcagcagcagaatcatcaagacccccagaagattcatcgaggacgaggactacgacccccccatcaagatcgccagactggagagcacccccaacagcagattcagcgcccccagctgcggcagcagcgagaagagcagcgccgccagccagcacagcagccagatgagcagcgacagcagcagaagcagcagccccagcgtggacaccagcaccgacagccaggccagcgaggagatccaggtgctgcccgaggagagaagcgacacccccgaggtgcacccccccctgcccatcagccagagccccgagaacgagagcaacgacagaagaagcagaagatacagcgtgagcgagagaagcttcggcagcagaaccaccaagaagctgagcaccctgcagagcgccccccagcagcagaccagcagcagcccccccccccccctgctgaccccccccccccccctgcagcccgccagcagcatcagcgaccacaccccctggctgatgccccccaccatccccctggccagccccttcctgcccgccagcaccgcccccatgcagggcaagagaaagagcatcctgagagagcccaccttcagatggaccagcctgaagcacagcagaagcgagccccagtacttcagcagcgccaagtacgccaaggagggcctgatcagaaagcccatcttcgacaacttcagacccccccccctgacccccgaggacgtgggcttcgccagcggcttcagcgccagcggcaccgccgccagcgccagactgttcagccccctgcacagcggcaccagattcgacatgcacaagagaagccccctgctgagagcccccagattcacccccagcgaggcccacagcagaatcttcgagagcgtgaccctgcccagcaacagaaccagcgccggcaccagcagcagcggcgtgagcaacagaaagagaaagagaaaggtgttcagccccatcagaagcgagcccagaagccccagccacagcatgagaaccagaagcggcagactgagcagcagcgagctgagccccctgaccccccccagcagcgtgagcagcagcctgagcatcagcgtgagccccctggccaccagcgccctgaaccccaccttcaccttccccagccacagcctgacccagagcggcgagagcgccgagaagaaccagagacccagaaagcagaccagcgcccccgccgagcccttcagcagcagcagccccacccccctgttcccctggttcacccccggcagccagaccgagagaggcagaaacaaggacaaggcccccgaggagctgagcaaggacagagacgccgacaagagcgtggagaaggacaagagcagagagagagacagagagagagagaaggagaacaagagagagagcagaaaggagaagagaaagaagggcagcgagatccagagcagcagcgccctgtaccccgtgggcagagtgagcaaggagaaggtggtgggcgaggacgtggccaccagcagcagcgccaagaaggccaccggcagaaagaagagcagcagccacgacagcggcaccgacatcaccagcgtgaccctgggcgacaccaccgccgtgaagaccaagatcctgatcaagaagggcagaggcaacctggagaagaccaacctggacctgggccccaccgcccccagcctggagaaggagaagaccctgtgcctgagcacccccagcagcagcaccgtgaagcacagcaccagcagcatcggcagcatgctggcccaggccgacaagctgcccatgaccgacaagagagtggccagcctgctgaagaaggccaaggcccagctgtgcaagatcgagaagagcaagagcctgaagcagaccgaccagcccaaggcccagggccaggagagcgacagcagcgagaccagcgtgagaggccccagaatcaagcacgtgtgcagaagagccgccgtggccctgggcagaaagagagccgtgttccccgacgacatgcccaccctgagcgccctgccctgggaggagagagagaagatcctgagcagcatgggcaacgacgacaagagcagcatcgccggcagcgaggacgccgagcccctggccccccccatcaagcccatcaagcccgtgaccagaaacaaggccccccaggagccccccgtgaagaagggcagaagaagcagaagatgcggccagtgccccggctgccaggtgcccgaggactgcggcgtgtgcaccaactgcctggacaagcccaagttcggcggcagaaacatcaagaagcagtgctgcaagatgagaaagtgccagaacctgcagtggatgcccagcaaggcctacctgcagaagcaggccaaggccgtgaagaagaaggagaagaagagcaagaccagcgagaagaaggacagcaaggagagcagcgtggtgaagaacgtggtggacagcagccagaagcccacccccagcgccagagaggaccccgcccccaagaagagcagcagcgagcccccccccagaaagcccgtggaggagaagagcgaggagggcaacgtgagcgcccccggccccgagagcaagcaggccaccacccccgccagcagaaagagcagcaagcaggtgagccagcccgccctggtgatccccccccagccccccaccaccggcccccccagaaaggaggtgcccaagaccacccccagcgagcccaagaagaagcagccccccccccccgagagcggccccgagcagagcaagcagaagaaggtggcccccagacccagcatccccgtgaagcagaagcccaaggagaaggagaagcccccccccgtgaacaagcaggagaacgccggcaccctgaacatcctgagcaccctgagcaacggcaacagcagcaagcagaagatccccgccgacggcgtgcacagaatcagagtggacttcaagtag

SEQ ID NO: 89838 - DNA, 11919 bp, Artificial Sequence
  Description of Artificial Sequence: Synthetic coding sequence
atggcccacagctgcagatggagattccccgccagacccggcaccaccggcggcggcggcggcggcggcagaagaggcctgggcggcgcccccagacagagagtgcccgccctgctgctgccccccggcccccccgtgggcggcggcggccccggcgccccccccagcccccccgccgtggccgccgccgccgccgccgccggcagcagcggcgccggcgtgcccggcggcgccgccgccgccagcgccgccagcagcagcagcgccagcagcagcagcagcagcagcagcagcgccagcagcggccccgccctgctgagagtgggccccggcttcgacgccgccctgcaggtgagcgccgccatcggcaccaacctgagaagattcagagccgtgttcggcgagagcggcggcggcggcggcagcggcgaggacgagcagttcctgggcttcggcagcgacgaggaggtgagagtgagaagccccaccagaagccccagcgtgaagaccagccccagaaagcccagaggcagacccagaagcggcagcgacagaaacagcgccatcctgagcgaccccagcgtgttcagccccctgaacaagagcgagaccaagagcggcgacaagatcaagaagaaggacagcaagagcatcgagaagaagagaggcagaccccccaccttccccggcgtgaagatcaagatcacccacggcaaggacatcagcgagctgcccaagggcaacaaggaggacagcctgaagaagatcaagagaacccccagcgccaccttccagcaggccaccaagatcaagaagctgagagccggcaagctgagccccctgaagagcaagttcaagaccggcaagctgcagatcggcagaaagggcgtgcagatcgtgagaagaagaggcagaccccccagcaccgagagaatcaagacccccagcggcctgctgatcaacagcgagctggagaagccccagaaggtgagaaaggacaaggagggcaccccccccctgaccaaggaggacaagaccgtggtgagacagagccccagaagaatcaagcccgtgagaatcatccccagcagcaagagaaccgacgccaccatcgccaagcagctgctgcagagagccaagaagggcgcccagaagaagatcgagaaggaggccgcccagctgcagggcagaaaggtgaagacccaggtgaagaacatcagacagttcatcatgcccgtggtgagcgccatcagcagcagaatcatcaagacccccagaagattcatcgaggacgaggactacgacccccccatcaagatcgccagactggagagcacccccaacagcagattcagcgcccccagctgcggcagcagcgagaagagcagcgccgccagccagcacagcagccagatgagcagcgacagcagcagaagcagcagccccagcgtggacaccagcaccgacagccaggccagcgaggagatccaggtgctgcccgaggagagaagcgacacccccgaggtgcacccccccctgcccatcagccagagccccgagaacgagagcaacgacagaagaagcagaagatacagcgtgagcgagagaagcttcggcagcagaaccaccaagaagctgagcaccctgcagagcgccccccagcagcagaccagcagcagcccccccccccccctgctgaccccccccccccccctgcagcccgccagcagcatcagcgaccacaccccctggctgatgccccccaccatccccctggccagccccttcctgcccgccagcaccgcccccatgcagggcaagagaaagagcatcctgagagagcccaccttcagatggaccagcctgaagcacagcagaagcgagccccagtacttcagcagcgccaagtacgccaaggagggcctgatcagaaagcccatcttcgacaacttcagacccccccccctgacccccgaggacgtgggcttcgccagcggcttcagcgccagcggcaccgccgccagcgccagactgttcagccccctgcacagcggcaccagattcgacatgcacaagagaagccccctgctgagagcccccagattcacccccagcgaggcccacagcagaatcttcgagagcgtgaccctgcccagcaacagaaccagcgccggcaccagcagcagcggcgtgagcaacagaaagagaaagagaaaggtgttcagccccatcagaagcgagcccagaagccccagccacagcatgagaaccagaagcggcagactgagcagcagcgagctgagccccctgaccccccccagcagcgtgagcagcagcctgagcatcagcgtgagccccctggccaccagcgccctgaaccccaccttcaccttccccagccacagcctgacccagagcggcgagagcgccgagaagaaccagagacccagaaagcagaccagcgcccccgccgagcccttcagcagcagcagccccacccccctgttcccctggttcacccccggcagccagaccgagagaggcagaaacaaggacaaggcccccgaggagctgagcaaggacagagacgccgacaagagcgtggagaaggacaagagcagagagagagacagagagagagagaaggagaacaagagagagagcagaaaggagaagagaaagaagggcagcgagatccagagcagcagcgccctgtaccccgtgggcagagtgagcaaggagaaggtggtgggcgaggacgtggccaccagcagcagcgccaagaaggccaccggcagaaagaagagcagcagccacgacagcggcaccgacatcaccagcgtgaccctgggcgacaccaccgccgtgaagaccaagatcctgatcaagaagggcagaggcaacctggagaagaccaacctggacctgggccccaccgcccccagcctggagaaggagaagaccctgtgcctgagcacccccagcagcagcaccgtgaagcacagcaccagcagcatcggcagcatgctggcccaggccgacaagctgcccatgaccgacaagagagtggccagcctgctgaagaaggccaaggcccagctgtgcaagatcgagaagagcaagagcctgaagcagaccgaccagcccaaggcccagggccaggagagcgacagcagcgagaccagcgtgagaggccccagaatcaagcacgtgtgcagaagagccgccgtggccctgggcagaaagagagccgtgttccccgacgacatgcccaccctgagcgccctgccctgggaggagagagagaagatcctgagcagcatgggcaacgacgacaagagcagcatcgccggcagcgaggacgccgagcccctggccccccccatcaagcccatcaagcccgtgaccagaaacaaggccccccaggagccccccgtgaagaagggcagaagaagcagaagatgcggccagtgccccggctgccaggtgcccgaggactgcggcgtgtgcaccaactgcctggacaagcccaagttcggcggcagaaacatcaagaagcagtgctgcaagatgagaaagtgccagaacctgcagtggatgcccagcaaggcctacctgcagaagcaggccaaggccgtgaagaagaaggagaagaagagcaagaccagcgagaagaaggacagcaaggagagcagcgtggtgaagaacgtggtggacagcagccagaagcccacccccagcgccagagaggaccccgcccccaagaagagcagcagcgagcccccccccagaaagcccgtggaggagaagagcgaggagggcaacgtgagcgcccccggccccgagagcaagcaggccaccacccccgccagcagaaagagcagcaagcaggtgagccagcccgccctggtgatccccccccagccccccaccaccggcccccccagaaaggaggtgcccaagaccacccccagcgagcccaagaagaagcagccccccccccccgagagcggccccgagcagagcaagcagaagaaggtggcccccagacccagcatccccgtgaagcagaagcccaaggagaaggagaagcccccccccgtgaacaagcaggagaacgccggcaccctgaacatcctgagcaccctgagcaacggcaacagcagcaagcagaagatccccgccgacggcgtgcacagaatcagagtggacttcaaggaggactgcgaggccgagaacgtgtgggagatgggcggcctgggcatcctgaccagcgtgcccatcacccccagagtggtgtgcttcctgtgcgccagcagcggccacgtggagttcgtgtactgccaggtgtgctgcgagcccttccacaagttctgcctggaggagaacgagagacccctggaggaccagctggagaactggtgctgcagaagatgcaagttctgccacgtgtgcggcagacagcaccaggccaccaagcagctgctggagtgcaacaagtgcagaaacagctaccaccccgagtgcctgggccccaactaccccaccaagcccaccaagaagaagaaggtgtggatctgcaccaagtgcgtgagatgcaagagctgcggcagcaccacccccggcaagggctgggacgcccagtggagccacgacttcagcctgtgccacgactgcgccaagctgttcgccaagggcaacttctgccccctgtgcgacaagtgctacgacgacgacgactacgagagcaagatgatgcagtgcggcaagtgcgacagatgggtgcacagcaagtgcgagaacctgagcggcaccgaggacgagatgtacgagatcctgagcaacctgcccgagagcgtggcctacacctgcgtgaactgcaccgagagacaccccgccgagtggagactggccctggagaaggagctgcagatcagcctgaagcaggtgctgaccgccctgctgaacagcagaaccaccagccacctgctgagatacagacaggccgccaagccccccgacctgaaccccgagaccgaggagagcatccccagcagaagcagccccgagggccccgacccccccgtgctgaccgaggtgagcaagcaggacgaccagcagcccctggacctggagggcgtgaagagaaagatggaccagggcaactacaccagcgtgctggagttcagcgacgacatcgtgaagatcatccaggccgccatcaacagcgacggcggccagcccgagatcaagaaggccaacagcatggtgaagagcttcttcatcagacagatggagagagtgttcccctggttcagcgtgaagaagagcagattctgggagcccaacaaggtgagcagcaacagcggcatgctgcccaacgccgtgctgccccccagcctggaccacaactacgcccagtggcaggagagagaggagaacagccacaccgagcagccccccctgatgaagaagatcatccccgcccccaagcccaagggccccggcgagcccgacagccccacccccctgcacccccccaccccccccatcctgagcaccgacagaagcagagaggacagccccgagctgaaccccccccccggcatcgaggacaacagacagtgcgccctgtgcctgacctacggcgacgacagcgccaacgacgccggcagactgctgtacatcggccagaacgagtggacccacgtgaactgcgccctgtggagcgccgaggtgttcgaggacgacgacggcagcctgaagaacgtgcacatggccgtgatcagaggcaagcagctgagatgcgagttctgccagaagcccggcgccaccgtgggctgctgcctgaccagctgcaccagcaactaccacttcatgtgcagcagagccaagaactgcgtgttcctggacgacaagaaggtgtactgccagagacacagagacctgatcaagggcgaggtggtgcccgagaacggcttcgaggtgttcagaagagtgttcgtggacttcgagggcatcagcctgagaagaaagttcctgaacggcctggagcccgagaacatccacatgatgatcggcagcatgaccatcgactgcctgggcatcctgaacgacctgagcgactgcgaggacaagctgttccccatcggctaccagtgcagcagagtgtactggagcaccaccgacgccagaaagagatgcgtgtacacctgcaagatcgtggagtgcagaccccccgtggtggagcccgacatcaacagcaccgtggagcacgacgagaacagaaccatcgcccacagccccaccagcttcaccgagagcagcagcaaggagagccagaacaccgccgagatcatcagcccccccagccccgacagacccccccacagccagaccagcggcagctgctactaccacgtgatcagcaaggtgcccagaatcagaacccccagctacagccccacccagagaagccccggctgcagacccctgcccagcgccggcagccccacccccaccacccacgagatcgtgaccgtgggcgaccccctgctgagcagcggcctgagaagcatcggcagcagaagacacagcaccagcagcctgagcccccagagaagcaagctgagaatcatgagccccatgagaaccggcaacacctacagcagaaacaacgtgagcagcgtgagcaccaccggcaccgccaccgacctggagagcagcgccaaggtggtggaccacgtgctgggccccctgaacagcagcaccagcctgggccagaacaccagcaccagcagcaacctgcagagaaccgtggtgaccgtgggcaacaagaacagccacctggacggcagcagcagcagcgagatgaagcagagcagcgccagcgacctggtgagcaagagcagcagcctgaagggcgagaagaccaaggtgctgagcagcaagagcagcgagggcagcgcccacaacgtggcctaccccggcatccccaagctggccccccaggtgcacaacaccaccagcagagagctgaacgtgagcaagatcggcagcttcgccgagcccagcagcgtgagcttcagcagcaaggaggccctgagcttcccccacctgcacctgagaggccagagaaacgacagagaccagcacaccgacagcacccagagcgccaacagcagccccgacgaggacaccgaggtgaagaccctgaagctgagcggcatgagcaacagaagcagcatcatcaacgagcacatgggcagcagcagcagagacagaagacagaagggcaagaagagctgcaaggagaccttcaaggagaagcacagcagcaagagcttcctggagcccggccaggtgaccaccggcgaggagggcaacctgaagcccgagttcatggacgaggtgctgacccccgagtacatgggccagagaccctgcaacaacgtgagcagcgacaagatcggcgacaagggcctgagcatgcccggcgtgcccaaggccccccccatgcaggtggagggcagcgccaaggagctgcaggcccccagaaagagaaccgtgaaggtgaccctgacccccctgaagatggagaacgagagccagagcaagaacgccctgaaggagagcagccccgccagccccctgcagatcgagagcaccagccccaccgagcccatcagcgccagcgagaaccccggcgacggccccgtggcccagcccagccccaacaacaccagctgccaggacagccagagcaacaactaccagaacctgcccgtgcaggacagaaacctgatgctgcccgacggccccaagccccaggaggacggcagcttcaagagaagataccccagaagaagcgccagagccagaagcaacatgttcttcggcctgacccccctgtacggcgtgagaagctacggcgaggaggacatccccttctacagcagcagcaccggcaagaagagaggcaagagaagcgccgagggccaggtggacggcgccgacgacctgagcaccagcgacgaggacgacctgtactactacaacttcaccagaaccgtgatcagcagcggcggcgaggagagactggccagccacaacctgttcagagaggaggagcagtgcgacctgcccaagatcagccagctggacggcgtggacgacggcaccgagagcgacaccagcgtgaccgccaccaccagaaagagcagccagatccccaagagaaacggcaaggagaacggcaccgagaacctgaagatcgacagacccgaggacgccggcgagaaggagcacgtgaccaagagcagcgtgggccacaagaacgagcccaagatggacaactgccacagcgtgagcagagtgaagacccagggccaggacagcctggaggcccagctgagcagcctggagagcagcagaagagtgcacaccagcacccccagcgacaagaacctgctggacacctacaacaccgagctgctgaagagcgacagcgacaacaacaacagcgacgactgcggcaacatcctgcccagcgacatcatggacttcgtgctgaagaacacccccagcatgcaggccctgggcgagagccccgagagcagcagcagcgagctgctgaacctgggcgagggcctgggcctggacagcaacagagagaaggacatgggcctgttcgaggtgttcagccagcagctgcccaccaccgagcccgtggacagcagcgtgagcagcagcatcagcgccgaggagcagttcgagctgcccctggagctgcccagcgacctgagcgtgctgaccaccagaagccccaccgtgcccagccagaaccccagcagactggccgtgatcagcgacagcggcgagaagagagtgaccatcaccgagaagagcgtggccagcagcgagagcgaccccgccctgctgagccccggcgtggaccccacccccgagggccacatgacccccgaccacttcatccagggccacatggacgccgaccacatcagcagccccccctgcggcagcgtggagcagggccacggcaacaaccaggacctgaccagaaacagcagcacccccggcctgcaggtgcccgtgagccccaccgtgcccatccagaaccagaagtacgtgcccaacagcaccgacagccccggccccagccagatcagcaacgccgccgtgcagaccacccccccccacctgaagcccgccaccgagaagctgatcgtggtgaaccagaacatgcagcccctgtacgtgctgcagaccctgcccaacggcgtgacccagaagatccagctgaccagcagcgtgagcagcacccccagcgtgatggagaccaacaccagcgtgctgggccccatgggcggcggcctgaccctgaccaccggcctgaaccccagcctgcccaccagccagagcctgttccccagcgccagcaagggcctgctgcccatgagccaccaccagcacctgcacagcttccccgccgccacccagagcagcttcccccccaacatcagcaacccccccagcggcctgctgatcggcgtgcagcccccccccgacccccagctgctggtgagcgagagcagccagagaaccgacctgagcaccaccgtggccacccccagcagcggcctgaagaagagacccatcagcagactgcagaccagaaagaacaagaagctggcccccagcagcacccccagcaacatcgcccccagcgacgtggtgagcaacatgaccctgatcaacttcacccccagccagctgcccaaccaccccagcctgctggacctgggcagcctgaacaccagcagccacagaaccgtgcccaacatcatcaagagaagcaagagcagcatcatgtacttcgagcccgcccccctgctgccccagagcgtgggcggcaccgccgccaccgccgccggcaccagcaccatcagccaggacaccagccacctgaccagcggcagcgtgagcggcctggccagcagcagcagcgtgctgaacgtggtgagcatgcagaccaccaccacccccaccagcagcgccagcgtgcccggccacgtgaccctgaccaaccccagactgctgggcacccccgacatcggcagcatcagcaacctgctgatcaaggccagccagcagagcctgggcatccaggaccagcccgtggccctgccccccagcagcggcatgttcccccagctgggcaccagccagacccccagcaccgccgccatcaccgccgccagcagcatctgcgtgctgcccagcacccagaccaccggcatcaccgccgccagccccagcggcgaggccgacgagcactaccagctgcagcacgtgaaccagctgctggccagcaagaccggcatccacagcagccagagagacctggacagcgccagcggcccccaggtgagcaacttcacccagaccgtggacgcccccaacagcatgggcctggagcagaacaaggccctgagcagcgccgtgcaggccagccccaccagccccggcggcagccccagcagccccagcagcggccagagaagcgccagccccagcgtgcccggccccaccaagcccaagcccaagaccaagagattccagctgcccctggacaagggcaacggcaagaagcacaaggtgagccacctgagaaccagcagcagcgaggcccacatccccgaccaggagaccaccagcctgaccagcggcaccggcacccccggcgccgaggccgagcagcaggacaccgccagcgtggagcagagcagccagaaggagtgcggccagcccgccggccaggtggccgtgctgcccgaggtgcaggtgacccagaaccccgccaacgagcaggagagcgccgagcccaagaccgtggaggaggaggagagcaacttcagcagccccctgatgctgtggctgcagcaggagcagaagagaaaggagagcatcaccgagaagaagcccaagaagggcctggtgttcgagatcagcagcgacgacggcttccagatctgcgccgagagcatcgaggacgcctggaagagcctgaccgacaaggtgcaggaggccagaagcaacgccagactgaagcagctgagcttcgccggcgtgaacggcctgagaatgctgggcatcctgcacgacgccgtggtgttcctgatcgagcagctgagcggcgccaagcactgcagaaactacaagttcagattccacaagcccgaggaggccaacgagccccccctgaacccccacggcagcgccagagccgaggtgcacctgagaaagagcgccttcgacatgttcaacttcctggccagcaagcacagacagccccccgagtacaaccccaacgacgaggaggaggaggaggtgcagctgaagagcgccagaagagccaccagcatggacctgcccatgcccatgagattcagacacctgaagaagaccagcaaggaggccgtgggcgtgtacagaagccccatccacggcagaggcctgttctgcaagagaaacatcgacgccggcgagatggtgatcgagtacgccggcaacgtgatcagaagcatccagaccgacaagagagagaagtactacgacagcaagggcatcggctgctacatgttcagaatcgacgacagcgaggtggtggacgccaccatgcacggcaacgccgccagattcatcaaccacagctgcgagcccaactgctacagcagagtgatcaacatcgacggccagaagcacatcgtgatcttcgccatgagaaagatctacagaggcgaggagctgacctacgactacaagttccccatcgaggacgccagcaacaagctgccctgcaactgcggcgccaagaagtgcagaaagttcctgaactag

SEQ ID NO: 89839 - DNA, 1680 bp, Artificial Sequence
  Description of Artificial Sequence: Synthetic coding sequence
atggacaaccagtgcaccgtgcaggtgagactggagctgggccacagagcccagctgagaaagaagcccaccaccgagggcttcacccacgactggatggtgttcgtgagaggccccgagcagtgcgacatccagcacttcgtggagaaggtggtgttctggctgcacgacagcttccccaagcccagaagagtgtgcaaggagcccccctacaaggtggaggagagcggctacgccggcttcatcatgcccatcgaggtgcacttcaagaacaaggaggagcccagaaaggtgtgcttcacctacgacctgttcctgaacctggagggcaacccccccgtgaaccacctgagatgcgagaagctgaccttcaacaaccccaccaccgagttcagatacaagctgctgagagccggcggcgtgatggtgatgcccgagggcgccgacaccgtgagcagacccagccccgactaccccatgctgcccaccatccccctgagcgccttcagcgaccccaagaagaccaagcccagccacggcagcaaggacgccaacaaggagagcagcaagaccagcaagccccacaaggtgaccaaggagcacagagagagacccagaaaggacagcgagagcaagagcagcagcaaggagctggagagagagcaggccaagagcagcaaggacaccagcagaaagctgggcgagggcagactgcccaaggaggagaaggcccccccccccaaggccgccttcaaggagcccaagatggccctgaaggagaccaagctggagagcaccagccccaagggcggccccccccccccccccccccccccccccagagccagcagcaagagacccgccaccgccgacagccccaagcccagcgccaagaagcagaagaagagcagcagcaagggcagcagaagcgcccccggcaccagccccagaaccagcagcagcagcagcttcagcgacaagaagcccgccaaggacaagagcagcaccagaggcgagaaggtgaaggccgagagcgagcccagagaggccaagaaggccctggaggtggaggagagcaacagcgaggacgaggccagcttcaagagcgagagcgcccagagcagccccagcaacagcagcagcagcagcgacagcagcagcgacagcgacttcgagcccagccagaaccacagccagggccccctgagaagcatggtggaggacctgcagagcgaggagagcgacgaggacgacagcagcagcggcgaggaggccgccggcaagaccaaccccggcagagacagcagactgagcttcagcgacagcgagagcgacaacagcgccgacagcagcctgcccagcagagagcccccccccccccagaagccccccccccccaacagcaaggtgagcggcagaagaagccccgagagctgcagcaagcccgagaagatcctgaagaagggcacctacgacaaggcctacaccgacgagctggtggagctgcacagaagactgatggccctgagagagagaaacgtgctgcagcagatcgtgaacctgatcgaggagaccggccacttcaacgtgaccaacaccaccttcgacttcgacctgttcagcctggacgagaccaccgtgagaaagctgcagagctgcctggaggccgtggccacctag

SEQ ID NO: 89840 - DNA, 273 bp, Artificial Sequence
  Description of Artificial Sequence: Synthetic coding sequence
atgagagaccccgtgagcagccagtacagcagcttcctgttctggagaatgcccatccccgagctggacctgagcgagctggagggcctgggcctgagcgacaccgccacctacaaggtgaaggacagcagcgtgggcaagatgatcggccaggccaccgccgccgaccaggagaagaaccccgagggcgacggcctgctggagtacagcaccttcaacttctggagagcccccatcgccagcatccacagcttcgagctggacctgctgtag

SEQ ID NO: 89841 - DNA, 417 bp, Artificial Sequence
  Description of Artificial Sequence: Synthetic coding sequence
atgaaggacctgcacagcgacgacaacgaggaggagagcgacgaggtggaggacaacgacaacgacagcgagatggagagacccgtgaacagaggcggcagcagaagcagaagagtgagcctgagcgacggcagcgacagcgagagcagcagcgccagcagccccctgcaccacgagccccccccccccctgctgaagaccaacaacaaccagatcctggaggtgaagagccccatcaagcagagcaagagcgacaagcagatcaagaacggcgagtgcgacaagatcgtgaacctgatcgaggagaccggccacttccacatcaccaacaccaccttcgacttcgacctgtgcagcctggacaagaccaccgtgagaaagctgcagagctacctggagaccagcggcaccagctag

SEQ ID NO: 89842 - DNA, 489 bp, Artificial Sequence
  Description of Artificial Sequence: Synthetic coding sequence
atgaaggacctgcacagcgacgacaacgaggaggagagcgacgaggtggaggacaacgacaacgacagcgagatggagagacccgtgaacagaggcggcagcagaagcagaagagtgagcctgagcgacggcagcgacagcgagagcagcagcgccagcagccccctgcaccacgagccccccccccccctgctgaagaccaacaacaaccagatcctggaggtgaagagccccatcaagcagagcaagagcgacaagcagatcaagaacggcgagtgcgacaaggcctacctggacgagctggtggagctgcacagaagactgatgaccctgagagagagacacatcctgcagcagatcgtgaacctgatcgaggagaccggccacttccacatcaccaacaccaccttcgacttcgacctgtgcagcctggacaagaccaccgtgagaaagctgcagagctacctggagaccagcggcaccagctag

SEQ ID NO: 89843 - DNA, 417 bp, Artificial Sequence; identical to SEQ ID NO: 89841
  Description of Artificial Sequence: Synthetic coding sequence

SEQ ID NO: 89844 - DNA, 1707 bp, Artificial Sequence
  Description of Artificial Sequence: Synthetic coding sequence
atggccagcagctgcgccgtgcaggtgaagctggagctgggccacagagcccaggtgagaaagaagcccaccgtggagggcttcacccacgactggatggtgttcgtgagaggccccgagcacagcaacatccagcacttcgtggagaaggtggtgttccacctgcacgagagcttccccagacccaagagagtgtgcaaggaccccccctacaaggtggaggagagcggctacgccggcttcatcctgcccatcgaggtgtacttcaagaacaaggaggagcccagaaaggtgagattcgactacgacctgttcctgcacctggagggccacccccccgtgaaccacctgagatgcgagaagctgaccttcaacaaccccaccgaggacttcagaagaaagctgctgaaggccggcggcgaccccaacagaagcatccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcttcagcaagccccacaagctgatgaaggagcacaaggagaagcccagcaaggacagcagagagcacaagagcgccttcaaggagcccagcagagaccacaacaagagcagcaaggagagcagcaagaagcccaaggagaacaagcccctgaaggaggagaagatcgtgcccaagatggccttcaaggagcccaagcccatgagcaaggagcccaagcccgacagcaacctgctgaccatcaccagcggccaggacaagaaggcccccagcaagagaccccccatcagcgacagcgaggagctgagcgccaagaagagaaagaagagcagcagcgaggccctgttcaagagcttcagcagcgccccccccctgatcctgacctgcagcgccgacaagaagcagatcaaggacaagagccacgtgaagatgggcaaggtgaagatcgagagcgagaccagcgagaagaagaagagcaccctgccccccttcgacgacatcgtggaccccaacgacagcgacgtggaggagaacatcagcagcaagagcgacagcgagcagcccagccccgccagcagcagcagcagcagcagcagcagcttcacccccagccagaccagacagcagggccccctgagaagcatcatgaaggacctgcacagcgacgacaacgaggaggagagcgacgaggtggaggacaacgacaacgacagcgagatggagagacccgtgaacagaggcggcagcagaagcagaagagtgagcctgagcgacggcagcgacagcgagagcagcagcgccagcagccccctgcaccacgagccccccccccccctgctgaagaccaacaacaaccagatcctggaggtgaagagccccatcaagcagagcaagagcgacaagcagatcaagaacggcgagtgcgacaaggcctacctggacgagctggtggagctgcacagaagactgatgaccctgagagagagacacatcctgcagcagatcgtgaacctgatcgaggagaccggccacttccacatcaccaacaccaccttcgacttcgacctgtgcagcctggacaagaccaccgtgagaaagctgcagagctacctggagaccagcggcaccagctag

SEQ ID NO: 89845 - DNA, 1698 bp, Artificial Sequence
  Description of Artificial Sequence: Synthetic coding sequence
atgtgcgccgtgcaggtgaagctggagctgggccacagagcccaggtgagaaagaagcccaccgtggagggcttcacccacgactggatggtgttcgtgagaggccccgagcacagcaacatccagcacttcgtggagaaggtggtgttccacctgcacgagagcttccccagacccaagagagtgtgcaaggaccccccctacaaggtggaggagagcggctacgccggcttcatcctgcccatcgaggtgtacttcaagaacaaggaggagcccagaaaggtgagattcgactacgacctgttcctgcacctggagggccacccccccgtgaaccacctgagatgcgagaagctgaccttcaacaaccccaccgaggacttcagaagaaagctgctgaaggccggcggcgaccccaacagaagcatccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcttcagcaagccccacaagctgatgaaggagcacaaggagaagcccagcaaggacagcagagagcacaagagcgccttcaaggagcccagcagagaccacaacaagagcagcaaggagagcagcaagaagcccaaggagaacaagcccctgaaggaggagaagatcgtgcccaagatggccttcaaggagcccaagcccatgagcaaggagcccaagcccgacagcaacctgctgaccatcaccagcggccaggacaagaaggcccccagcaagagaccccccatcagcgacagcgaggagctgagcgccaagaagagaaagaagagcagcagcgaggccctgttcaagagcttcagcagcgccccccccctgatcctgacctgcagcgccgacaagaagcagatcaaggacaagagccacgtgaagatgggcaaggtgaagatcgagagcgagaccagcgagaagaagaagagcaccctgccccccttcgacgacatcgtggaccccaacgacagcgacgtggaggagaacatcagcagcaagagcgacagcgagcagcccagccccgccagcagcagcagcagcagcagcagcagcttcacccccagccagaccagacagcagggccccctgagaagcatcatgaaggacctgcacagcgacgacaacgaggaggagagcgacgaggtggaggacaacgacaacgacagcgagatggagagacccgtgaacagaggcggcagcagaagcagaagagtgagcctgagcgacggcagcgacagcgagagcagcagcgccagcagccccctgcaccacgagccccccccccccctgctgaagaccaacaacaaccagatcctggaggtgaagagccccatcaagcagagcaagagcgacaagcagatcaagaacggcgagtgcgacaaggcctacctggacgagctggtggagctgcacagaagactgatgaccctgagagagagacacatcctgcagcagatcgtgaacctgatcgaggagaccggccacttccacatcaccaacaccaccttcgacttcgacctgtgcagcctggacaagaccaccgtgagaaagctgcagagctacctggagaccagcggcaccagctag

SEQ ID NO: 89846 - DNA, 1824 bp, Artificial Sequence
  Description of Artificial Sequence: Synthetic coding sequence
atgcagagagccccccccttccccttcatgtgcgtgagcagaagaagaaagaagtgccaggcccagagaagcctgcccaagcccagactgcccgtgatccacggctgcctgagcagcccctgcccccagtgcgccgtgcaggtgaagctggagctgggccacagagcccaggtgagaaagaagcccaccgtggagggcttcacccacgactggatggtgttcgtgagaggccccgagcacagcaacatccagcacttcgtggagaaggtggtgttccacctgcacgagagcttccccagacccaagagagtgtgcaaggaccccccctacaaggtggaggagagcggctacgccggcttcatcctgcccatcgaggtgtacttcaagaacaaggaggagcccagaaaggtgagattcgactacgacctgttcctgcacctggagggccacccccccgtgaaccacctgagatgcgagaagctgaccttcaacaaccccaccgaggacttcagaagaaagctgctgaaggccggcggcgaccccaacagaagcatccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcttcagcaagccccacaagctgatgaaggagcacaaggagaagcccagcaaggacagcagagagcacaagagcgccttcaaggagcccagcagagaccacaacaagagcagcaaggagagcagcaagaagcccaaggagaacaagcccctgaaggaggagaagatcgtgcccaagatggccttcaaggagcccaagcccatgagcaaggagcccaagcccgacagcaacctgctgaccatcaccagcggccaggacaagaaggcccccagcaagagaccccccatcagcgacagcgaggagctgagcgccaagaagagaaagaagagcagcagcgaggccctgttcaagagcttcagcagcgccccccccctgatcctgacctgcagcgccgacaagaagcagatcaaggacaagagccacgtgaagatgggcaaggtgaagatcgagagcgagaccagcgagaagaagaagagcaccctgccccccttcgacgacatcgtggaccccaacgacagcgacgtggaggagaacatcagcagcaagagcgacagcgagcagcccagccccgccagcagcagcagcagcagcagcagcagcttcacccccagccagaccagacagcagggccccctgagaagcatcatgaaggacctgcacagcgacgacaacgaggaggagagcgacgaggtggaggacaacgacaacgacagcgagatggagagacccgtgaacagaggcggcagcagaagcagaagagtgagcctgagcgacggcagcgacagcgagagcagcagcgccagcagccccctgcaccacgagccccccccccccctgctgaagaccaacaacaaccagatcctggaggtgaagagccccatcaagcagagcaagagcgacaagcagatcaagaacggcgagtgcgacaaggcctacctggacgagctggtggagctgcacagaagactgatgaccctgagagagagacacatcctgcagcagatcgtgaacctgatcgaggagaccggccacttccacatcaccaacaccaccttcgacttcgacctgtgcagcctggacaagaccaccgtgagaaagctgcagagctacctggagaccagcggcaccagctag

SEQ ID NO: 89847 - DNA, 4986 bp, Artificial Sequence
  Description of Artificial Sequence: Synthetic coding sequence
atgagcgccggcggcagagacgaggagagaagaaagctggccgacatcatccaccactggaacgccaacagactggacctgttcgagatcagccagcccaccgaggacctggagttccacggcgtgatgagattctacttccaggacaaggccgccggcaacttcgccaccaagtgcatcagagtgagcagcaccgccaccacccaggacgtgatcgagaccctggccgagaagttcagacccgacatgagaatgctgagcagccccaagtacagcctgtacgaggtgcacgtgagcggcgagagaagactggacatcgacgagaagcccctggtggtgcagctgaactggaacaaggacgacagagagggcagattcgtgctgaagaacgagaacgacgccatcccccccaagaaggcccagagcaacggccccgagaagcaggagaaggagggcgtgatccagaacttcaagagaaccctgagcaagaaggagaagaaggagaagaagaagagagagaaggaggccctgagacaggccagcgacaaggacgacagacccttccagggcgaggacgtggagaacagcagactggccgccgaggtgtacaaggacatgcccgagaccagcttcaccagaaccatcagcaaccccgaggtggtgatgaagagaagaagacagcagaagctggagaagagaatgcaggagttcagaagcagcgacggcagacccgacagcggcggcaccctgagaatctacgccgacagcctgaagcccaacatcccctacaagaccatcctgctgagcaccaccgaccccgccgacttcgccgtggccgaggccctggagaagtacggcctggagaaggagaaccccaaggactactgcatcgccagagtgatgctgccccccggcgcccagcacagcgacgagaagggcgccaaggagatcatcctggacgacgacgagtgccccctgcagatcttcagagagtggcccagcgacaagggcatcctggtgttccagctgaagagaagaccccccgaccacatccccaagaagaccaagaagcacctggagggcaagacccccaagggcaaggagagagccgacggcagcggctacggcagcaccctgccccccgagaagctgccctacctggtggagctgagccccggcagaagaaaccacttcgcctactacaactaccacacctacgaggacggcagcgacagcagagacaagcccaagctgtacagactgcagctgagcgtgaccgaggtgggcaccgagaagctggacgacaacagcatccagctgttcggccccggcatccagccccaccactgcgacctgaccaacatggacggcgtggtgaccgtgacccccagaagcatggacgccgagacctacgtggagggccagagaatcagcgagaccaccatgctgcagagcggcatgaaggtgcagttcggcgccagccacgtgttcaagttcgtggaccccagccaggaccacgccctggccaagagaagcgtggacggcggcctgatggtgaagggccccagacacaagcccggcatcgtgcaggagaccaccttcgacctgggcggcgacatccacagcggcaccgccctgcccaccagcaagagcaccaccagactggacagcgacagagtgagcagcgccagcagcaccgccgagagaggcatggtgaagcccatgatcagagtggagcagcagcccgactacagaagacaggagagcagaacccaggacgccagcggccccgagctgatcctgcccgccagcatcgagttcagagagagcagcgaggacagcttcctgagcgccatcatcaactacaccaacagcagcaccgtgcacttcaagctgagccccacctacgtgctgtacatggcctgcagatacgtgctgagcaaccagtacagacccgacatcagccccaccgagagaacccacaaggtgatcgccgtggtgaacaagatggtgagcatgatggagggcgtgatccagaagcagaagaacatcgccggcgccctggccttctggatggccaacgccagcgagctgctgaacttcatcaagcaggacagagacctgagcagaatcaccctggacgcccaggacgtgctggcccacctggtgcagatggccttcaagtacctggtgcactgcctgcagagcgagctgaacaactacatgcccgccttcctggacgaccccgaggagaacagcctgcagagacccaagatcgacgacgtgctgcacaccctgaccggcgccatgagcctgctgagaagatgcagagtgaacgccgccctgaccatccagctgttcagccagctgttccacttcatcaacatgtggctgttcaacagactggtgaccgaccccgacagcggcctgtgcagccactactggggcgccatcatcagacagcagctgggccacatcgaggcctgggccgagaagcagggcctggagctggccgccgactgccacctgagcagaatcgtgcaggccaccaccctgctgaccatggacaagtacgcccccgacgacatccccaacatcaacagcacctgcttcaagctgaacagcctgcagctgcaggccctgctgcagaactaccactgcgcccccgacgagcccttcatccccaccgacctgatcgagaacgtggtgaccgtggccgagaacaccgccgacgagctggccagaagcgacggcagagaggtgcagctggaggaggaccccgacctgcagctgcccttcctgctgcccgaggacggctacagctgcgacgtggtgagaaacatccccaacggcctgcaggagttcctggaccccctgtgccagagaggcttctgcagactgatcccccacaccagaagccccggcacctggaccatctacttcgagggcgccgactacgagagccacctgctgagagagaacaccgagctggccatccccctgagaaaggagcccgagatcatcaccgtgaccctgaagaagcagaacggcatgggcctgagcatcgtggccgccaagggcgccggccaggacaagctgggcatctacgtgaagagcgtggtgaagggcggcgccgccgacgtggacggcagactggccgccggcgaccagctgctgagcgtggacggcagaagcctggtgggcctgagccaggagagagccgccgagctgatgaccagaaccagcagcgtggtgaccctggaggtggccaagcagggcgccatctaccacggcctggccaccctgctgaaccagcccagccccatgatgcagagaatcagcgacagaagaggcagcggcaagcccagacccaagagcgagggcttcgagctgtacaacaacagcacccagaacggcagccccgagagcccccagctgccctgggccgagtacagcgagcccaagaagctgcccggcgacgacagactgatgaagaacagagccgaccacagaagcagccccaacgtggccaaccagccccccagccccggcggcaagagcgcctacgccagcggcaccaccgccaagatcaccagcgtgagcaccggcaacctgtgcaccgaggagcagacccccccccccagacccgaggcctaccccatccccacccagacctacaccagagagtacttcaccttccccgccagcaagagccaggacagaatggcccccccccagaaccagtggcccaactacgaggagaagccccacatgcacaccgacagcaaccacagcagcatcgccatccagagagtgaccagaagccaggaggagctgagagaggacaaggcctaccagctggagagacacagaatcgaggccgccatggacagaaagagcgacagcgacatgtggatcaaccagagcagcagcctggacagcagcaccagcagccaggagcacctgaaccacagcagcaagagcgtgacccccgccagcaccctgaccaagagcggccccggcagatggaagacccccgccgccatccccgccacccccgtggccgtgagccagcccatcagaaccgacctgccccccccccccccccccccccccgtgcactacgccggcgacttcgacggcatgagcatggacctgcccctgccccccccccccagcgccaaccagatcggcctgcccagcgcccaggtggccgccgccgagagaagaaagagagaggagcaccagagatggtacgagaaggagaaggccagactggaggaggagagagagagaaagagaagagagcaggagagaaagctgggccagatgagaacccagagcctgaaccccgcccccttcagccccctgaccgcccagcagatgaagcccgagaagcccagcaccctgcagagaccccaggagaccgtgatcagagagctgcagccccagcagcagcccagaaccatcgagagaagagacctgcagtacatcaccgtgagcaaggaggagctgagcagcggcgacagcctgagccccgacccctggaagagagacgccaaggagaagctggagaagcagcagcagatgcacatcgtggacatgctgagcaaggagatccaggagctgcagagcaagcccgacagaagcgccgaggagagcgacagactgagaaagctgatgctggagtggcagttccagaagagactgcaggagagcaagcagaaggacgaggacgacgaggaggaggaggacgacgacgtggacaccatgctgatcatgcagagactggaggccgagagaagagccagacagaccgccatgcccgccatcagcgtgctggacctgctgcaggacgaggagagaagaagacagcagcagctggaggagatgagaaagagagaggccgaggacagagccagacaggaggaggagagaagaagacaggaggaggagagaaccaagagagacgccgaggagaagtag

SEQ ID NO: 89848 - DNA, 4998 bp, Artificial Sequence
  Description of Artificial Sequence: Synthetic coding sequence
atgagcgccggcggcagagacgaggagagaagaaagctggccgacatcatccaccactggaacgccaacagactggacctgttcgagatcagccagcccaccgaggacctggagttccacggcgtgatgagattctacttccaggacaaggccgccggcaacttcgccaccaagtgcatcagagtgagcagcaccgccaccacccaggacgtgatcgagaccctggccgagaagttcagacccgacatgagaatgctgagcagccccaagtacagcctgtacgaggtgcacgtgagcggcgagagaagactggacatcgacgagaagcccctggtggtgcagctgaactggaacaaggacgacagagagggcagattcgtgctgaagaacgagaacgacgccatcccccccaagaaggcccagagcaacggccccgagaagcaggagaaggagggcgtgatccagaacttcaagagaaccctgagcaagaaggagaagaaggagaagaagaagagagagaaggaggccctgagacaggccagcgacaaggacgacagacccttccagggcgaggacgtggagaacagcagactggccgccgaggtgtacaaggacatgcccgagaccagcttcaccagaaccatcagcaaccccgaggtggtgatgaagagaagaagacagcagaagctggagaagagaatgcaggagttcagaagcagcgacggcagacccgacagcggcggcaccctgagaatctacgccgacagcctgaagcccaacatcccctacaagaccatcctgctgagcaccaccgaccccgccgacttcgccgtggccgaggccctggagaagtacggcctggagaaggagaaccccaaggactactgcatcgccagagtgatgctgccccccggcgcccagcacagcgacgagaagggcgccaaggagatcatcctggacgacgacgagtgccccctgcagatcttcagagagtggcccagcgacaagggcatcctggtgttccagctgaagagaagaccccccgaccacatccccaagaagaccaagaagcacctggagggcaagacccccaagggcaaggagagagccgacggcagcggctacggcagcaccctgccccccgagaagctgccctacctggtggagctgagccccggcagaagaaaccacttcgcctactacaactaccacacctacgaggacggcagcgacagcagagacaagcccaagctgtacagactgcagctgagcgtgaccgaggtgggcaccgagaagctggacgacaacagcatccagctgttcggccccggcatccagccccaccactgcgacctgaccaacatggacggcgtggtgaccgtgacccccagaagcatggacgccgagacctacgtggagggccagagaatcagcgagaccaccatgctgcagagcggcatgaaggtgcagttcggcgccagccacgtgttcaagttcgtggaccccagccaggaccacgccctggccaagagaagcgtggacggcggcctgatggtgaagggccccagacacaagcccggcatcgtgcaggagaccaccttcgacctgggcggcgacatccacagcggcaccgccctgcccaccagcaagagcaccaccagactggacagcgacagagtgagcagcgccagcagcaccgccgagagaggcatggtgaagcccatgatcagagtggagcagcagcccgactacagaagacaggagagcagaacccaggacgccagcggccccgagctgatcctgcccgccagcatcgagttcagagagagcagcgaggacagcttcctgagcgccatcatcaactacaccaacagcagcaccgtgcacttcaagctgagccccacctacgtgctgtacatggcctgcagatacgtgctgagcaaccagtacagacccgacatcagccccaccgagagaacccacaaggtgatcgccgtggtgaacaagatggtgagcatgatggagggcgtgatccagaagcagaagaacatcgccggcgccctggccttctggatggccaacgccagcgagctgctgaacttcatcaagcaggacagagacctgagcagaatcaccctggacgcccaggacgtgctggcccacctggtgcagatggccttcaagtacctggtgcactgcctgcagagcgagctgaacaactacatgcccgccttcctggacgaccccgaggagaacagcctgcagagacccaagatcgacgacgtgctgcacaccctgaccggcgccatgagcctgctgagaagatgcagagtgaacgccgccctgaccatccagctgttcagccagctgttccacttcatcaacatgtggctgttcaacagactggtgaccgaccccgacagcggcctgtgcagccactactggggcgccatcatcagacagcagctgggccacatcgaggcctgggccgagaagcagggcctggagctggccgccgactgccacctgagcagaatcgtgcaggccaccaccctgctgaccatggacaagtacgcccccgacgacatccccaacatcaacagcacctgcttcaagctgaacagcctgcagctgcaggccctgctgcagaactaccactgcgcccccgacgagcccttcatccccaccgacctgatcgagaacgtggtgaccgtggccgagaacaccgccgacgagctggccagaagcgacggcagagaggtgcagctggaggaggaccccgacctgcagctgcccttcctgctgcccgaggacggctacagctgcgacgtggtgagaaacatccccaacggcctgcaggagttcctggaccccctgtgccagagaggcttctgcagactgatcccccacaccagaagccccggcacctggaccatctacttcgagggcgccgactacgagagccacctgctgagagagaacaccgagctggcccagcccctgagaaaggagcccgagatcatcaccgtgaccctgaagaagcagaacggcatgggcctgagcatcgtggccgccaagggcgccggccaggacaagctgggcatctacgtgaagagcgtggtgaagggcggcgccgccgacgtggacggcagactggccgccggcgaccagctgctgagcgtggacggcagaagcctggtgggcctgagccaggagagagccgccgagctgatgaccagaaccagcagcgtggtgaccctggaggtggccaagcagggcgccatctaccacggcctggccaccctgctgaaccagcccagccccatgatgcagagaatcagcgacagaagaggcagcggcaagcccagacccaagagcgagggcttcgagctgtacaacaacagcacccagaacggcagccccgagagcccccagctgccctgggccgagtacagcgagcccaagaagctgcccggcgacgacagactgatgaagaacagagccgaccacagaagcagccccaacgtggccaaccagccccccagccccggcggcaagagcgcctacgccagcggcaccaccgccaagatcaccagcgtgagcaccggcaacctgtgcaccgaggagcagacccccccccccagacccgaggcctaccccatccccacccagacctacaccagagagtacttcaccttccccgccagcaagagccaggacagaatggcccccccccagaaccagtggcccaactacgaggagaagccccacatgcacaccgacagcaaccacagcagcatcgccatccagagagtgaccagaagccaggaggagctgagagaggacaaggcctaccagctggagagacacagaatcgaggccgccatggacagaaagagcgacagcgacatgtggatcaaccagagcagcagcctggacagcagcaccagcagccaggagcacctgaaccacagcagcaagagcgtgacccccgccagcaccctgaccaagagcggccccggcagatggaagacccccgccgccatccccgccacccccgtggccgtgagccagcccatcagaaccgacctgccccccccccccccccccccccccgtgcactacgccggcgacttcgacggcatgagcatggacctgcccctgccccccccccccagcgccaaccagatcggcctgcccagcgcccaggtggccgccgccgagagaagaaagagagaggagcaccagagatggtacgagaaggagaaggccagactggaggaggagagagagagaaagagaagagagcaggagagaaagctgggccagatgagaacccagagcctgaaccccgcccccttcagccccctgaccgcccagcagatgaagcccgagaagcccagcaccctgcagagaccccaggagaccgtgatcagagagctgcagccccagcagcagcccagaaccatcgagagaagagacctgcagtacatcaccgtgagcaaggaggagctgagcagcggcgacagcctgagccccgacccctggaagagagacgccaaggagaagctggagaagcagcagcagatgcacatcgtggacatgctgagcaaggagatccaggagctgcagagcaagcccgacagaagcgccgaggagagcgacagactgagaaagctgatgctggagtggcagttccagaagagactgcaggagagcaagcagaaggacgaggacgacgaggaggaggaggacgacgacgtggacaccatgctgatcatgcagagactggaggccgagagaagagccagacagaccgccatgcccgccatcagcgtgctggacctgctgcaggacgaggagagaagaagacagcagcagctggaggagatgagaaagagagaggccgaggacagagccagacaggaggaggagagaagaagacaggaggaggagagaaccaagagagacgccgaggagaaggtgatggtgctgtag

SEQ ID NO: 89849 - DNA, 5475 bp, Artificial Sequence
  Description of Artificial Sequence: Synthetic coding sequence
atgagcgccggcggcagagacgaggagagaagaaagctggccgacatcatccaccactggaacgccaacagactggacctgttcgagatcagccagcccaccgaggacctggagttccacggcgtgatgagattctacttccaggacaaggccgccggcaacttcgccaccaagtgcatcagagtgagcagcaccgccaccacccaggacgtgatcgagaccctggccgagaagttcagacccgacatgagaatgctgagcagccccaagtacagcctgtacgaggtgcacgtgagcggcgagagaagactggacatcgacgagaagcccctggtggtgcagctgaactggaacaaggacgacagagagggcagattcgtgctgaagaacgagaacgacgccatcccccccaagaaggcccagagcaacggccccgagaagcaggagaaggagggcgtgatccagaacttcaagagaaccctgagcaagaaggagaagaaggagaagaagaagagagagaaggaggccctgagacaggccagcgacaaggacgacagacccttccagggcgaggacgtggagaacagcagactggccgccgaggtgtacaaggacatgcccgagaccagcttcaccagaaccatcagcaaccccgaggtggtgatgaagagaagaagacagcagaagctggagaagagaatgcaggagttcagaagcagcgacggcagacccgacagcggcggcaccctgagaatctacgccgacagcctgaagcccaacatcccctacaagaccatcctgctgagcaccaccgaccccgccgacttcgccgtggccgaggccctggagaagtacggcctggagaaggagaaccccaaggactactgcatcgccagagtgatgctgccccccggcgcccagcacagcgacgagaagggcgccaaggagatcatcctggacgacgacgagtgccccctgcagatcttcagagagtggcccagcgacaagggcatcctggtgttccagctgaagagaagaccccccgaccacatccccaagaagaccaagaagcacctggagggcaagacccccaagggcaaggagagagccgacggcagcggctacggcagcaccctgccccccgagaagctgccctacctggtggagctgagccccggcagaagaaaccacttcgcctactacaactaccacacctacgaggacggcagcgacagcagagacaagcccaagctgtacagactgcagctgagcgtgaccgaggtgggcaccgagaagctggacgacaacagcatccagctgttcggccccggcatccagccccaccactgcgacctgaccaacatggacggcgtggtgaccgtgacccccagaagcatggacgccgagacctacgtggagggccagagaatcagcgagaccaccatgctgcagagcggcatgaaggtgcagttcggcgccagccacgtgttcaagttcgtggaccccagccaggaccacgccctggccaagagaagcgtggacggcggcctgatggtgaagggccccagacacaagcccggcatcgtgcaggagaccaccttcgacctgggcggcgacatccacagcggcaccgccctgcccaccagcaagagcaccaccagactggacagcgacagagtgagcagcgccagcagcaccgccgagagaggcatggtgaagcccatgatcagagtggagcagcagcccgactacagaagacaggagagcagaacccaggacgccagcggccccgagctgatcctgcccgccagcatcgagttcagagagagcagcgaggacagcttcctgagcgccatcatcaactacaccaacagcagcaccgtgcacttcaagctgagccccacctacgtgctgtacatggcctgcagatacgtgctgagcaaccagtacagacccgacatcagccccaccgagagaacccacaaggtgatcgccgtggtgaacaagatggtgagcatgatggagggcgtgatccagaagcagaagaacatcgccggcgccctggccttctggatggccaacgccagcgagctgctgaacttcatcaagcaggacagagacctgagcagaatcaccctggacgcccaggacgtgctggcccacctggtgcagatggccttcaagtacctggtgcactgcctgcagagcgagctgaacaactacatgcccgccttcctggacgaccccgaggagaacagcctgcagagacccaagatcgacgacgtgctgcacaccctgaccggcgccatgagcctgctgagaagatgcagagtgaacgccgccctgaccatccagctgttcagccagctgttccacttcatcaacatgtggctgttcaacagactggtgaccgaccccgacagcggcctgtgcagccactactggggcgccatcatcagacagcagctgggccacatcgaggcctgggccgagaagcagggcctggagctggccgccgactgccacctgagcagaatcgtgcaggccaccaccctgctgaccatggacaagtacgcccccgacgacatccccaacatcaacagcacctgcttcaagctgaacagcctgcagctgcaggccctgctgcagaactaccactgcgcccccgacgagcccttcatccccaccgacctgatcgagaacgtggtgaccgtggccgagaacaccgccgacgagctggccagaagcgacggcagagaggtgcagctggaggaggaccccgacctgcagctgcccttcctgctgcccgaggacggctacagctgcgacgtggtgagaaacatccccaacggcctgcaggagttcctggaccccctgtgccagagaggcttctgcagactgatcccccacaccagaagccccggcacctggaccatctacttcgagggcgccgactacgagagccacctgctgagagagaacaccgagctggccatccccctgagaaaggagcccgagatcatcaccgtgaccctgaagaagcagaacggcatgggcctgagcatcgtggccgccaagggcgccggccaggacaagctgggcatctacgtgaagagcgtggtgaagggcggcgccgccgacgtggacggcagactggccgccggcgaccagctgctgagcgtggacggcagaagcctggtgggcctgagccaggagagagccgccgagctgatgaccagaaccagcagcgtggtgaccctggaggtggccaagcagggcgccatctaccacggcctggccaccctgctgaaccagcccagccccatgatgcagagaatcagcgacagaagaggcagcggcaagcccagacccaagagcgagggcttcgagctgtacaacaacagcacccagaacggcagccccgagagcccccagctgccctgggccgagtacagcgagcccaagaagctgcccggcgacgacagactgatgaagaacagagccgaccacagaagcagccccaacgtggccaaccagccccccagccccggcggcaagagcgcctacgccagcggcaccaccgccaagatcaccagcgtgagcaccggcaacctgtgcaccgaggagcagacccccccccccagacccgaggcctaccccatccccacccagacctacaccagagagtacttcaccttccccgccagcaagagccaggacagaatggcccccccccagaaccagtggcccaactacgaggagaagccccacatgcacaccgacagcaaccacagcagcatcgccatccagagagtgaccagaagccaggaggagctgagagaggacaaggcctaccagctggagagacacagaatcgaggccgccatggacagaaagagcgacagcgacatgtggatcaaccagagcagcagcctggacagcagcaccagcagccaggagcacctgaaccacagcagcaagagcgtgacccccgccagcaccctgaccaagagcggccccggcagatggaagacccccgccgccatccccgccacccccgtggccgtgagccagcccatcagaaccgacctgccccccccccccccccccccccccgtgcactacgccggcgacttcgacggcatgagcatggacctgcccctgccccccccccccagcgccaaccagatcggcctgcccagcgcccaggtggccgccgccgagagaagaaagagagaggagcaccagagatggtacgagaaggagaaggccagactggaggaggagagagagagaaagagaagagagcaggagagaaagctgggccagatgagaacccagagcctgaaccccgcccccttcagccccctgaccgcccagcagatgaagcccgagaagcccagcaccctgcagagaccccaggagaccgtgatcagagagctgcagccccagcagcagcccagaaccatcgagagaagagacctgcagtacatcaccgtgagcaaggaggagctgagcagcggcgacagcctgagccccgacccctggaagagagacgccaaggagaagctggagaagcagcagcagatgcacatcgtggacatgctgagcaaggagatccaggagctgcagagcaagcccgacagaagcgccgaggagagcgacagactgagaaagctgatgctggagtggcagttccagaagagactgcaggagagcaagcagaaggacgaggacgacgaggaggaggaggacgacgacgtggacaccatgctgatcatgcagagactggaggccgagagaagagccagactgcaggacgaggagagaagaagacagcagcagctggaggagatgagaaagagagaggccgaggacagagccagacaggaggaggagagaagaagacaggaggaggagagaaccaagagagacgccgaggagaagagaagacaggaggagggctactacagcagactggaggccgagagaagaagacagcacgacgaggccgccagaagactgctggagcccgaggcccccggcctgtgcagaccccccctgcccagagactacgagccccccagccccagccccgcccccggcgccccccccccccccccccagagaaacgccagctacctgaagacccaggtgctgagccccgacagcctgttcaccgccaagttcgtggcctacaacgaggaggaggaggaggaggactgcagcctggccggccccaacagctaccccggcagcaccggcgccgccgtgggcgcccacgacgcctgcagagacgccaaggagaagagaagcaagagccaggacgccgacagccccggcagcagcggcgcccccgagaacctgaccttcaaggagagacagagactgttcagccagggccaggacgtgagcaacaaggtgaaggccagcagaaagctgaccgagctggagaacgagctgaacaccaagtag

SEQ ID NO: 89850 - DNA, 4956 bp, Artificial Sequence
  Description of Artificial Sequence: Synthetic coding sequence
atgagcgccggcggcagagacgaggagagaagaaagctggccgacatcatccaccactggaacgccaacagactggacctgttcgagatcagccagcccaccgaggacctggagttccacggcgtgatgagattctacttccaggacaaggccgccggcaacttcgccaccaagtgcatcagagtgagcagcaccgccaccacccaggacgtgatcgagaccctggccgagaagttcagacccgacatgagaatgctgagcagccccaagtacagcctgtacgaggtgcacgtgagcggcgagagaagactggacatcgacgagaagcccctggtggtgcagctgaactggaacaaggacgacagagagggcagattcgtgctgaagaacgagaacgacgccatcccccccaagaaggcccagagcaacggccccgagaagcaggagaaggagggcgtgatccagaacttcaagagaaccctgagcaagaaggagaagaaggagaagaagaagagagagaaggaggccctgagacaggccagcgacaaggacgacagacccttccagggcgaggacgtggagaacagcagactggccgccgaggtgtacaaggacatgcccgagaccagcttcaccagaaccatcagcaaccccgaggtggtgatgaagagaagaagacagcagaagctggagaagagaatgcaggagttcagaagcagcgacggcagacccgacagcggcggcaccctgagaatctacgccgacagcctgaagcccaacatcccctacaagaccatcctgctgagcaccaccgaccccgccgacttcgccgtggccgaggccctggagaagtacggcctggagaaggagaaccccaaggactactgcatcgccagagtgatgctgccccccggcgcccagcacagcgacgagaagggcgccaaggagatcatcctggacgacgacgagtgccccctgcagatcttcagagagtggcccagcgacaagggcatcctggtgttccagctgaagagaagaccccccgaccacatccccaagaagaccaagaagcacctggagggcaagacccccaagggcaaggagagagccgacggcagcggctacggcagcaccctgccccccgagaagctgccctacctggtggagctgagccccggcagaagaaaccacttcgcctactacaactaccacacctacgaggacggcagcgacagcagagacaagcccaagctgtacagactgcagctgagcgtgaccgaggtgggcaccgagaagctggacgacaacagcatccagctgttcggccccggcatccagccccaccactgcgacctgaccaacatggacggcgtggtgaccgtgacccccagaagcatggacgccgagacctacgtggagggccagagaatcagcgagaccaccatgctgcagagcggcatgaaggtgcagttcggcgccagccacgtgttcaagttcgtggaccccagccaggaccacgccctggccaagagaagcgtggacggcggcctgatggtgaagggccccagacacaagcccggcatcgtgcaggagaccaccttcgacctgggcggcgacatccacagcggcaccgccctgcccaccagcaagagcaccaccagactggacagcgacagagtgagcagcgccagcagcaccgccgagagaggcatggtgaagcccatgatcagagtggagcagcagcccgactacagaagacaggagagcagaacccaggacgccagcggccccgagctgatcctgcccgccagcatcgagttcagagagagcagcgaggacagcttcctgagcgccatcatcaactacaccaacagcagcaccgtgcacttcaagctgagccccacctacgtgctgtacatggcctgcagatacgtgctgagcaaccagtacagacccgacatcagccccaccgagagaacccacaaggtgatcgccgtggtgaacaagatggtgagcatgatggagggcgtgatccagaagcagaagaacatcgccggcgccctggccttctggatggccaacgccagcgagctgctgaacttcatcaagcaggacagagacctgagcagaatcaccctggacgcccaggacgtgctggcccacctggtgcagatggccttcaagtacctggtgcactgcctgcagagcgagctgaacaactacatgcccgccttcctggacgaccccgaggagaacagcctgcagagacccaagatcgacgacgtgctgcacaccctgaccggcgccatgagcctgctgagaagatgcagagtgaacgccgccctgaccatccagctgttcagccagctgttccacttcatcaacatgtggctgttcaacagactggtgaccgaccccgacagcggcctgtgcagccactactggggcgccatcatcagacagcagctgggccacatcgaggcctgggccgagaagcagggcctggagctggccgccgactgccacctgagcagaatcgtgcaggccaccaccctgctgaccatggacaagtacgcccccgacgacatccccaacatcaacagcacctgcttcaagctgaacagcctgcagctgcaggccctgctgcagaactaccactgcgcccccgacgagcccttcatccccaccgacctgatcgagaacgtggtgaccgtggccgagaacaccgccgacgagctggccagaagcgacggcagagaggtgcagctggaggaggaccccgacctgcagctgcccttcctgctgcccgaggacggctacagctgcgacgtggtgagaaacatccccaacggcctgcaggagttcctggaccccctgtgccagagaggcttctgcagactgatcccccacaccagaagccccggcacctggaccatctacttcgagggcgccgactacgagagccacctgctgagagagaacaccgagctggcccagcccctgagaaaggagcccgagatcatcaccgtgaccctgaagaagcagaacggcatgggcctgagcatcgtggccgccaagggcgccggccaggacaagctgggcatctacgtgaagagcgtggtgaagggcggcgccgccgacgtggacggcagactggccgccggcgaccagctgctgagcgtggacggcagaagcctggtgggcctgagccaggagagagccgccgagctgatgaccagaaccagcagcgtggtgaccctggaggtggccaagcagggcgccatctaccacggcctggccaccctgctgaaccagcccagccccatgatgcagagaatcagcgacagaagaggcagcggcaagcccagacccaagagcgagggcttcgagctgtacaacaacagcacccagaacggcagccccgagagcccccagctgccctgggccgagtacagcgagcccaagaagctgcccggcgacgacagactgatgaagaacagagccgaccacagaagcagccccaacgtggccaaccagccccccagccccggcggcaagagcgcctacgccagcggcaccaccgccaagatcaccagcgtgagcaccggcaacctgtgcaccgaggagcagacccccccccccagacccgaggcctaccccatccccacccagacctacaccagagagtacttcaccttccccgccagcaagagccaggacagaatggcccccccccagaaccagtggcccaactacgaggagaagccccacatgcacaccgacagcaaccacagcagcatcgccatccagagagtgaccagaagccaggaggagctgagagaggacaaggcctaccagctggagagacacagaatcgaggccgccatggacagaaagagcgacagcgacatgtggatcaaccagagcagcagcctggacagcagcaccagcagccaggagcacctgaaccacagcagcaagagcgtgacccccgccagcaccctgaccaagagcggccccggcagatggaagacccccgccgccatccccgccacccccgtggccgtgagccagcccatcagaaccgacctgccccccccccccccccccccccccgtgcactacgccggcgacttcgacggcatgagcatggacctgcccctgccccccccccccagcgccaaccagatcggcctgcccagcgcccaggtggccgccgccgagagaagaaagagagaggagcaccagagatggtacgagaaggagaaggccagactggaggaggagagagagagaaagagaagagagcaggagagaaagctgggccagatgagaacccagagcctgaaccccgcccccttcagccccctgaccgcccagcagatgaagcccgagaagcccagcaccctgcagagaccccaggagaccgtgatcagagagctgcagccccagcagcagcccagaaccatcgagagaagagacctgcagtacatcaccgtgagcaaggaggagctgagcagcggcgacagcctgagccccgacccctggaagagagacgccaaggagaagctggagaagcagcagcagatgcacatcgtggacatgctgagcaaggagatccaggagctgcagagcaagcccgacagaagcgccgaggagagcgacagactgagaaagctgatgctggagtggcagttccagaagagactgcaggagagcaagcagaaggacgaggacgacgaggaggaggaggacgacgacgtggacaccatgctgatcatgcagagactggaggccgagagaagagccagagacgaggagagaagaagacagcagcagctggaggagatgagaaagagagaggccgaggacagagccagacaggaggaggagagaagaagacaggaggaggagagaaccaagagagacgccgaggagaaggtgatggtgctgtag

SEQ ID NO: 89851 - DNA, 5232 bp, Artificial Sequence
  Description of Artificial Sequence: Synthetic coding sequence
atgagcgccggcggcagagacgaggagagaagaaagctggccgacatcatccaccactggaacgccaacagactggacctgttcgagatcagccagcccaccgaggacctggagttccacggcgtgatgagattctacttccaggacaaggccgccggcaacttcgccaccaagtgcatcagagtgagcagcaccgccaccacccaggacgtgatcgagaccctggccgagaagttcagacccgacatgagaatgctgagcagccccaagtacagcctgtacgaggtgcacgtgagcggcgagagaagactggacatcgacgagaagcccctggtggtgcagctgaactggaacaaggacgacagagagggcagattcgtgctgaagaacgagaacgacgccatcccccccaaggcccagagcaacggccccgagaagcaggagaaggagggcgtgatccagaacttcaagagaaccctgagcaagaaggagaagaaggagaagaagaagagagagaaggaggccctgagacaggccagcgacaaggacgacagacccttccagggcgaggacgtggagaacagcagactggccgccgaggtgtacaaggacatgcccgagaccagcttcaccagaaccatcagcaaccccgaggtggtgatgaagagaagaagacagcagaagctggagaagagaatgcaggagttcagaagcagcgacggcagacccgacagcggcggcaccctgagaatctacgccgacagcctgaagcccaacatcccctacaagaccatcctgctgagcaccaccgaccccgccgacttcgccgtggccgaggccctggagaagtacggcctggagaaggagaaccccaaggactactgcatcgccagagtgatgctgccccccggcgcccagcacagcgacgagaagggcgccaaggagatcatcctggacgacgacgagtgccccctgcagatcttcagagagtggcccagcgacaagggcatcctggtgttccagctgaagagaagaccccccgaccacatccccaagaagaccaagaagcacctggagggcaagacccccaagggcaaggagagagccgacggcagcggctacggcagcaccctgccccccgagaagctgccctacctggtggagctgagccccgacggcagcgacagcagagacaagcccaagctgtacagactgcagctgagcgtgaccgaggtgggcaccgagaagctggacgacaacagcatccagctgttcggccccggcatccagccccaccactgcgacctgaccaacatggacggcgtggtgaccgtgacccccagaagcatggacgccgagacctacgtggagggccagagaatcagcgagaccaccatgctgcagagcggcatgaaggtgcagttcggcgccagccacgtgttcaagttcgtggaccccagccaggaccacgccctggccaagagaagcgtggacggcggcctgatggtgaagggccccagacacaagcccggcatcgtgcaggagaccaccttcgacctgggcggcgacatccacagcggcaccgccctgcccaccagcaagagcaccaccagactggacagcgacagagtgagcagcgccagcagcaccgccgagagaggcatggtgaagcccatgatcagagtggagcagcagcccgactacagaagacaggagagcagaacccaggacgccagcggccccgagctgatcctgcccgccagcatcgagttcagagagagcagcgaggacagcttcctgagcgccatcatcaactacaccaacagcagcaccgtgcacttcaagctgagccccacctacgtgctgtacatggcctgcagatacgtgctgagcaaccagtacagacccgacatcagccccaccgagagaacccacaaggtgatcgccgtggtgaacaagatggtgagcatgatggagggcgtgatccagaagcagaagaacatcgccggcgccctggccttctggatggccaacgccagcgagctgctgaacttcatcaagcaggacagagacctgagcagaatcaccctggacgcccaggacgtgctggcccacctggtgcagatggccttcaagtacctggtgcactgcctgcagagcgagctgaacaactacatgcccgccttcctggacgaccccgaggagaacagcctgcagagacccaagatcgacgacgtgctgcacaccctgaccggcgccatgagcctgctgagaagatgcagagtgaacgccgccctgaccatccagctgttcagccagctgttccacttcatcaacatgtggctgttcaacagactggtgaccgaccccgacagcggcctgtgcagccactactggggcgccatcatcagacagcagctgggccacatcgaggcctgggccgagaagcagggcctggagctggccgccgactgccacctgagcagaatcgtgcaggccaccaccctgctgaccatggacaagtacgcccccgacgacatccccaacatcaacagcacctgcttcaagctgaacagcctgcagctgcaggccctgctgcagaactaccactgcgcccccgacgagcccttcatccccaccgacctgatcgagaacgtggtgaccgtggccgagaacaccgccgacgagctggccagaagcgacggcagagaggtgcagctggaggaggaccccgacctgcagctgcccttcctgctgcccgaggacggctacagctgcgacgtggtgagaaacatccccaacggcctgcaggagttcctggaccccctgtgccagagaggcttctgcagactgatcccccacaccagaagccccggcacctggaccatctacttcgagggcgccgactacgagagccacctgctgagagagaacaccgagctggccatccccctgagaaaggagcccgagatcatcaccgtgaccctgaagaagcagaacggcatgggcctgagcatcgtggccgccaagggcgccggccaggacaagctgggcatctacgtgaagagcgtggtgaagggcggcgccgccgacgacggcagactggccgccggcgaccagctgctgagcgtggacggcagaagcctggtgggcctgagccaggagagagccgccgagctgatgaccagaaccagcagcgtggtgaccctggaggtggccaagcagggcgccatctaccacggcctggccaccctgctgaaccagcccagccccatgatgcagagaatcagcgacagaagaggcagcggcaagcccagacccaagagcgagggcttcgagctgtacaacaacagcacccagaacggcagccccgagagcccccagctgccctgggccgagtacagcgagcccaagaagctgcccggcgacgacagactgatgaagaacagagccgaccacagaagcagccccaacgtggccaaccagccccccagccccggcggcaagagcgcctacgccagcggcaccaccgccaagatcaccagcgtgagcaccggcaacctgtgcaccgaggagcagacccccccccccagacccgaggcctaccccatccccacccagacctacaccagagagtacttcaccttccccgccagcaagagccaggacagaatggcccccccccagaaccagtggcccaactacgaggagaagccccacatgcacaccgacagcaaccacagcagcatcgccatccagagagtgaccagaagccaggaggagctgagagaggacaaggcctaccagctggagagacacagaatcgaggccgccatggacagaaagagcgacagcgacatgtggatcaaccagagcagcagcctggacagcagcaccagcagccaggagcacctgaaccacagcagcaagagcgtgacccccgccagcaccctgaccaagagcggccccggcagatggaagacccccgccgccatccccgccacccccgtggccgtgagccagcccatcagaaccgacctgccccccccccccccccccccccccgtgcactacgccggcgacttcgacggcatgagcatggacctgcccctgccccccccccccagcgccaaccagatcggcctgcccagcgcccaggtggccgccgccgagagaagaaagagagaggagcaccagagatggtacgagaaggagaaggccagactggaggaggagagagagagaaagagaagagagcaggagagaaagctgggccagatgagaacccagagcctgaaccccgcccccttcagccccctgaccgcccagcagatgaagcccgagaagcccagcaccctgcagagaccccaggagaccgtgatcagagagctgcagccccagcagcagcccagaaccatcgagagaagagacctgcagtacatcaccgtgagcaaggaggagctgagcagcggcgacagcctgagccccgacccctggaagagagacgccaaggagaagctggagaagcagcagcagatgcacatcgtggacatgctgagcaaggagatccaggagctgcagagcaagcccgacagaagcgccgaggagagcgacagactgagaaagctgatgctggagtggcagttccagaagagactgcaggagagcaagcagaaggacgaggacgacgaggaggaggaggacgacgacgtggacaccatgctgatcatgcagagactggaggccgagagaagagccagactgcaggacgaggagagaagaagacagcagcagctggaggagatgagaaagagagaggccgaggacagagccagacaggaggaggagagaagaagacaggaggaggagagaaccaagagagacgccgaggagaagagaagacaggaggagggctactacagcagactggaggccgagagaagaagacagcacgacgaggccgccagaagactgctggagcccgaggcccccggccccaacagctaccccggcagcaccggcgccgccgtgggcgcccacgacgcctgcagagacgccaaggagaagagaagcaagagccaggacgccgacagccccggcagcagcggcgcccccgagaacctgaccttcaaggagagacagagactgttcagccagggccaggacgtgagcaacaaggtgaaggccagcagaaagctgaccgagctggagaacgagctgaacaccaagtag

SEQ ID NO: 89852 - DNA, 5475 bp, Artificial Sequence
  Description of Artificial Sequence: Synthetic coding sequence
atgagcgccggcggcagagacgaggagagaagaaagctggccgacatcatccaccactggaacgccaacagactggacctgttcgagatcagccagcccaccgaggacctggagttccacggcgtgatgagattctacttccaggacaaggccgccggcaacttcgccaccaagtgcatcagagtgagcagcaccgccaccacccaggacgtgatcgagaccctggccgagaagttcagacccgacatgagaatgctgagcagccccaagtacagcctgtacgaggtgcacgtgagcggcgagagaagactggacatcgacgagaagcccctggtggtgcagctgaactggaacaaggacgacagagagggcagattcgtgctgaagaacgagaacgacgccatcccccccaagaaggcccagagcaacggccccgagaagcaggagaaggagggcgtgatccagaacttcaagagaaccctgagcaagaaggagaagaaggagaagaagaagagagagaaggaggccctgagacaggccagcgacaaggacgacagacccttccagggcgaggacgtggagaacagcagactggccgccgaggtgtacaaggacatgcccgagaccagcttcaccagaaccatcagcaaccccgaggtggtgatgaagagaagaagacagcagaagctggagaagagaatgcaggagttcagaagcagcgacggcagacccgacagcggcggcaccctgagaatctacgccgacagcctgaagcccaacatcccctacaagaccatcctgctgagcaccaccgaccccgccgacttcgccgtggccgaggccctggagaagtacggcctggagaaggagaaccccaaggactactgcatcgccagagtgatgctgccccccggcgcccagcacagcgacgagaagggcgccaaggagatcatcctggacgacgacgagtgccccctgcagatcttcagagagtggcccagcgacaagggcatcctggtgttccagctgaagagaagaccccccgaccacatccccaagaagaccaagaagcacctggagggcaagacccccaagggcaaggagagagccgacggcagcggctacggcagcaccctgccccccgagaagctgccctacctggtggagctgagccccggcagaagaaaccacttcgcctactacaactaccacacctacgaggacggcagcgacagcagagacaagcccaagctgtacagactgcagctgagcgtgaccgaggtgggcaccgagaagctggacgacaacagcatccagctgttcggccccggcatccagccccaccactgcgacctgaccaacatggacggcgtggtgaccgtgacccccagaagcatggacgccgagacctacgtggagggccagagaatcagcgagaccaccatgctgcagagcggcatgaaggtgcagttcggcgccagccacgtgttcaagttcgtggaccccagccaggaccacgccctggccaagagaagcgtggacggcggcctgatggtgaagggccccagacacaagcccggcatcgtgcaggagaccaccttcgacctgggcggcgacatccacagcggcaccgccctgcccaccagcaagagcaccaccagactggacagcgacagagtgagcagcgccagcagcaccgccgagagaggcatggtgaagcccatgatcagagtggagcagcagcccgactacagaagacaggagagcagaacccaggacgccagcggccccgagctgatcctgcccgccagcatcgagttcagagagagcagcgaggacagcttcctgagcgccatcatcaactacaccaacagcagcaccgtgcacttcaagctgagccccacctacgtgctgtacatggcctgcagatacgtgctgagcaaccagtacagacccgacatcagccccaccgagagaacccacaaggtgatcgccgtggtgaacaagatggtgagcatgatggagggcgtgatccagaagcagaagaacatcgccggcgccctggccttctggatggccaacgccagcgagctgctgaacttcatcaagcaggacagagacctgagcagaatcaccctggacgcccaggacgtgctggcccacctggtgcagatggccttcaagtacctggtgcactgcctgcagagcgagctgaacaactacatgcccgccttcctggacgaccccgaggagaacagcctgcagagacccaagatcgacgacgtgctgcacaccctgaccggcgccatgagcctgctgagaagatgcagagtgaacgccgccctgaccatccagctgttcagccagctgttccacttcatcaacatgtggctgttcaacagactggtgaccgaccccgacagcggcctgtgcagccactactggggcgccatcatcagacagcagctgggccacatcgaggcctgggccgagaagcagggcctggagctggccgccgactgccacctgagcagaatcgtgcaggccaccaccctgctgaccatggacaagtacgcccccgacgacatccccaacatcaacagcacctgcttcaagctgaacagcctgcagctgcaggccctgctgcagaactaccactgcgcccccgacgagcccttcatccccaccgacctgatcgagaacgtggtgaccgtggccgagaacaccgccgacgagctggccagaagcgacggcagagaggtgcagctggaggaggaccccgacctgcagctgcccttcctgctgcccgaggacggctacagctgcgacgtggtgagaaacatccccaacggcctgcaggagttcctggaccccctgtgccagagaggcttctgcagactgatcccccacaccagaagccccggcacctggaccatctacttcgagggcgccgactacgagagccacctgctgagagagaacaccgagctggcccagcccctgagaaaggagcccgagatcatcaccgtgaccctgaagaagcagaacggcatgggcctgagcatcgtggccgccaagggcgccggccaggacaagctgggcatctacgtgaagagcgtggtgaagggcggcgccgccgacgtggacggcagactggccgccggcgaccagctgctgagcgtggacggcagaagcctggtgggcctgagccaggagagagccgccgagctgatgaccagaaccagcagcgtggtgaccctggaggtggccaagcagggcgccatctaccacggcctggccaccctgctgaaccagcccagccccatgatgcagagaatcagcgacagaagaggcagcggcaagcccagacccaagagcgagggcttcgagctgtacaacaacagcacccagaacggcagccccgagagcccccagctgccctgggccgagtacagcgagcccaagaagctgcccggcgacgacagactgatgaagaacagagccgaccacagaagcagccccaacgtggccaaccagccccccagccccggcggcaagagcgcctacgccagcggcaccaccgccaagatcaccagcgtgagcaccggcaacctgtgcaccgaggagcagacccccccccccagacccgaggcctaccccatccccacccagacctacaccagagagtacttcaccttccccgccagcaagagccaggacagaatggcccccccccagaaccagtggcccaactacgaggagaagccccacatgcacaccgacagcaaccacagcagcatcgccatccagagagtgaccagaagccaggaggagctgagagaggacaaggcctaccagctggagagacacagaatcgaggccgccatggacagaaagagcgacagcgacatgtggatcaaccagagcagcagcctggacagcagcaccagcagccaggagcacctgaaccacagcagcaagagcgtgacccccgccagcaccctgaccaagagcggccccggcagatggaagacccccgccgccatccccgccacccccgtggccgtgagccagcccatcagaaccgacctgccccccccccccccccccccccccgtgcactacgccggcgacttcgacggcatgagcatggacctgcccctgccccccccccccagcgccaaccagatcggcctgcccagcgcccaggtggccgccgccgagagaagaaagagagaggagcaccagagatggtacgagaaggagaaggccagactggaggaggagagagagagaaagagaagagagcaggagagaaagctgggccagatgagaacccagagcctgaaccccgcccccttcagccccctgaccgcccagcagatgaagcccgagaagcccagcaccctgcagagaccccaggagaccgtgatcagagagctgcagccccagcagcagcccagaaccatcgagagaagagacctgcagtacatcaccgtgagcaaggaggagctgagcagcggcgacagcctgagccccgacccctggaagagagacgccaaggagaagctggagaagcagcagcagatgcacatcgtggacatgctgagcaaggagatccaggagctgcagagcaagcccgacagaagcgccgaggagagcgacagactgagaaagctgatgctggagtggcagttccagaagagactgcaggagagcaagcagaaggacgaggacgacgaggaggaggaggacgacgacgtggacaccatgctgatcatgcagagactggaggccgagagaagagccagactgcaggacgaggagagaagaagacagcagcagctggaggagatgagaaagagagaggccgaggacagagccagacaggaggaggagagaagaagacaggaggaggagagaaccaagagagacgccgaggagaagagaagacaggaggagggctactacagcagactggaggccgagagaagaagacagcacgacgaggccgccagaagactgctggagcccgaggcccccggcctgtgcagaccccccctgcccagagactacgagccccccagccccagccccgcccccggcgccccccccccccccccccagagaaacgccagctacctgaagacccaggtgctgagccccgacagcctgttcaccgccaagttcgtggcctacaacgaggaggaggaggaggaggactgcagcctggccggccccaacagctaccccggcagcaccggcgccgccgtgggcgcccacgacgcctgcagagacgccaaggagaagagaagcaagagccaggacgccgacagccccggcagcagcggcgcccccgagaacctgaccttcaaggagagacagagactgttcagccagggccaggacgtgagcaacaaggtgaaggccagcagaaagctgaccgagctggagaacgagctgaacaccaagtag

SEQ ID NO: 89853 - DNA, 3282 bp, Artificial Sequence
  Description of Artificial Sequence: Synthetic coding sequence
atgaaggagatggtgggcggctgctgcgtgtgcagcgacgagagaggctgggccgagaaccccctggtgtactgcgacggccacgcctgcagcgtggtggtgcaccaggcctgctacggcatcgtgcaggtgcccaccggcccctggttctgcagaaagtgcgagagccaggagagagccgccagagtgagatgcgagctgtgcccccacaaggacggcgccctgaagagaaccgacaacggcggctgggcccacgtggtgtgcgccctgtacatccccgaggtgcagttcgccaacgtgctgaccatggagcccatcgtgctgcagtacgtgccccacgacagattcaacaagacctgctacatctgcgaggagcagggcagagagagcaaggccgccagcggcgcctgcatgacctgcaacagacacggctgcagacaggccttccacgtgacctgcgcccagatggccggcctgctgtgcgaggaggaggtgctggaggtggacaacgtgaagtactgcggctactgcaagtaccacttcagcaagatgaagaccagcagacacagcagcggcggcggcggcggcggcgccggcggcggcggcggcagcatgggcggcggcggcagcggcttcatcagcggcagaagaagcagaagcgccagccccagcacccagcaggagaagcaccccacccaccacgagagaggccagaagaagagcagaaaggacaaggagagactgaagcagaagcacaagaagagacccgagagcccccccagcatcctgaccccccccgtggtgcccaccgccgacaaggtgagcagcagcgccagcagcagcagccaccacgaggccagcacccaggagaccagcgagagcagcagagagagcaagggcaagaagagcagcagccacagcctgagccacaagggcaagaagctgagcagcggcaagggcgtgagcagcttcaccagcgccagcagcagcagcagcagcagcagcagcagcagcggcggccccttccagcccgccgtgagcagcctgcagagcagccccgacttcagcgccttccccaagctggagcagcccgaggaggacaagtacagcaagcccaccgcccccgcccccagcgccccccccagccccagcgcccccgagccccccaaggccgacctgttcgagcagaaggtggtgttcagcggcttcggccccatcatgagattcagcaccaccaccagcagcagcggcagagccagagcccccagccccggcgactacaagagcccccacgtgaccggcagcggcgccagcgccggcacccacaagagaatgcccgccctgagcgccacccccgtgcccgccgacgagacccccgagaccggcctgaaggagaagaagcacaaggccagcaagagaagcagacacggccccggcagacccaagggcagcagaaacaaggagggcaccggcggccccgccgcccccagcctgcccagcgcccagctggccggcttcaccgccaccgccgccagccccttcagcggcggcagcctggtgagcagcggcctgggcggcctgagcagcagaaccttcggccccagcggcagcctgcccagcctgagcctggagagccccctgctgggcgccggcatctacaccagcaacaaggaccccatcagccacagcggcggcatgctgagagccgtgtgcagcacccccctgagcagcagcctgctgggcccccccggcaccagcgccctgcccagactgagcagaagccccttcaccagcaccctgcccagcagcagcgccagcatcagcaccacccaggtgttcagcctggccggcagcaccttcagcctgcccagcacccacatcttcggcacccccatgggcgccgtgaaccccctgctgagccaggccgagagcagccacaccgagcccgacctggaggactgcagcttcagatgcagaggcaccagcccccaggagagcctgagcagcatgagccccatcagcagcctgcccgccctgttcgaccagaccgccagcgccccctgcggcggcggccagctggaccccgccgcccccggcaccaccaacatggagcagctgctggagaagcagggcgacggcgaggccggcgtgaacatcgtggagatgctgaaggccctgcacgccctgcagaaggagaaccagagactgcaggagcagatcctgagcctgaccgccaagaaggagagactgcagatcctgaacgtgcagctgagcgtgcccttccccgccctgcccgccgccctgcccgccgccaacggccccgtgcccggcccctacggcctgcccccccaggccggcagcagcgacagcctgagcaccagcaagagcccccccggcaagagcagcctgggcctggacaacagcctgagcaccagcagcgaggacccccacagcggctgccccagcagaagcagcagcagcctgagcttccacagcacccccccccccctgcccctgctgcagcagagccccgccaccctgcccctggccctgcccggcgcccccgcccccctgcccccccagccccagaacggcctgggcagagcccccggcgccgccggcctgggcgccatgcccatggccgagggcctgctgggcggcctggccggcagcggcggcctgcccctgaacggcctgctgggcggcctgaacggcgccgccgcccccaaccccgccagcctgagccaggccggcggcgcccccaccctgcagctgcccggctgcctgaacagcctgaccgagcagcagagacacctgctgcagcagcaggagcagcagctgcagcagctgcagcagctgctggccagcccccagctgacccccgagcaccagaccgtggtgtaccagatgatccagcagatccagcagaagagagagctgcagagactgcagatggccggcggcagccagctgcccatggccagcctgctggccggcagcagcacccccctgctgagcgccggcacccccggcctgctgcccaccgccagcgccccccccctgctgcccgccggcgccctggtggcccccagcctgggcaacaacaccagcctgatggccgccgccgccgccgccgccgccgtggccgccgccggcggcccccccgtgctgaccgcccagaccaaccccttcctgagcctgagcggcgccgagggcagcggcggcggccccaagggcggcaccgccgacaagggcgccagcgccaaccaggagaagggctag

SEQ ID NO: 89854 - DNA, 978 bp, Artificial Sequence
  Description of Artificial Sequence: Synthetic coding sequence
atgaaggagatggtgggcggctgctgcgtgtgcagcgacgagagaggctgggccgagaaccccctggtgtactgcgacggccacgcctgcagcgtggtggtgcaccaggcctgctacggcatcgtgcaggtgcccaccggcccctggttctgcagaaagtgcgagagccaggagagagccgccagagtgagatgcgagctgtgcccccacaaggacggcgccctgaagagaaccgacaacggcggctgggcccacgtggtgtgcgccctgtacatccccgaggtgcagttcgccaacgtgctgaccatggagcccatcgtgctgcagtacgtgccccacgacagattcaacaagacctgctacatctgcgaggagcagggcagagagagcaaggccgccagcggcgcctgcatgacctgcaacagacacggctgcagacaggccttccacgtgacctgcgcccagatggccggcctgctgtgcgaggaggaggtgctggaggtggacaacgtgaagtactgcggctactgcaagtaccacttcagcaagatgaagaccagcagacacagcagcggcggcggcggcggcggcgccggcggcggcggcggcagcatgggcggcggcggcagcggcttcatcagcggcagaagaagcagaagcgccagccccagcacccagcaggagaagcaccccacccaccacgagagaggccagaagaagagcagaaaggacaaggagagactgaagcagaagcacaagaagagacccgagagcccccccagcatcctgaccccccccgtggtgcccaccgccgacaagcccagaagaggccaccagagccccaccaaccacggcatcggcagcctgggctgctgcctgcccgacacccccatctgcctgtgccccgagggcctgagccccggcctgctgagcgccgagagcggcggcagacacagcggcctgctgagcaagttctag

SEQ ID NO: 89855 - DNA, 16614 bp, Artificial Sequence
  Description of Artificial Sequence: Synthetic coding sequence
atggacagccagaagctggccggcgaggacaaggacagcgagcccgccgccgacggccccgccgccagcgaggaccccagcgccaccgagagcgacctgcccaacccccacgtgggcgaggtgagcgtgctgagcagcggcagccccagactgcaggagaccccccaggactgcagcggcggccccgtgagaagatgcgccctgtgcaactgcggcgagcccagcctgcacggccagagagagctgagaagattcgagctgcccttcgactggcccagatgccccgtggtgagccccggcggcagccccggccccaacgaggccgtgctgcccagcgaggacctgagccagatcggcttccccgagggcctgacccccgcccacctgggcgagcccggcggcagctgctgggcccaccactggtgcgccgcctggagcgccggcgtgtggggccaggagggccccgagctgtgcggcgtggacaaggccatcttcagcggcatcagccagagatgcagccactgcaccagactgggcgccagcatcccctgcagaagccccggctgccccagactgtaccacttcccctgcgccaccgccagcggcagcttcctgagcatgaagaccctgcagctgctgtgccccgagcacagcgagggcgccgcctacctggaggaggccagatgcgccgtgtgcgagggccccggcgagctgtgcgacctgttcttctgcaccagctgcggccaccactaccacggcgcctgcctggacaccgccctgaccgccagaaagagagccggctggcagtgccccgagtgcaaggtgtgccaggcctgcagaaagcccggcaacgacagcaagatgctggtgtgcgagacctgcgacaagggctaccacaccttctgcctgaagccccccatggaggagctgcccgcccacagctggaagtgcaaggcctgcagagtgtgcagagcctgcggcgccggcagcgccgagctgaaccccaacagcgagtggttcgagaactacagcctgtgccacagatgccacaaggcccagggcggccagaccatcagaagcgtggccgagcagcacacccccgtgtgcagcagattcagcccccccgagcccggcgacacccccaccgacgagcccgacgccctgtacgtggcctgccagggccagcccaagggcggccacgtgaccagcatgcagcccaaggagcccggccccctgcagtgcgaggccaagcccctgggcaaggccggcgtgcagctggagccccagctggaggcccccctgaacgaggagatgcccctgctgcccccccccgaggagagccccctgagccccccccccgaggagagccccaccagccccccccccgaggccagcagactgagccccccccccgaggagctgcccgccagccccctgcccgaggccctgcacctgagcagacccctggaggagagccccctgagccccccccccgaggagagccccctgagccccccccccgagagcagccccttcagccccctggaggagagccccctgagcccccccgaggagagcccccccagccccgccctggagacccccctgagccccccccccgaggccagccccctgagcccccccttcgaggagagccccctgagccccccccccgaggagctgcccaccagccccccccccgaggccagcagactgagccccccccccgaggagagccccatgagccccccccccgaggagagccccatgagccccccccccgaggccagcagactgttcccccccttcgaggagagccccctgagccccccccccgaggagagccccctgagccccccccccgaggccagcagactgagccccccccccgaggacagccccatgagccccccccccgaggagagccccatgagccccccccccgaggtgagcagactgagccccctgcccgtggtgagcagactgagccccccccccgaggagagccccctgagccccccccccgaggagagccccaccagccccccccccgaggccagcagactgagccccccccccgaggacagccccaccagccccccccccgaggacagccccgccagccccccccccgaggacagcctgatgagcctgcccctggaggagagccccctgctgcccctgcccgaggagccccagctgtgccccagaagcgagggcccccacctgagccccagacccgaggagccccacctgagccccagacccgaggagccccacctgagcccccaggccgaggagccccacctgagcccccagcccgaggagccctgcctgtgcgccgtgcccgaggagccccacctgagcccccaggccgagggcccccacctgagcccccagcccgaggagctgcacctgagcccccagaccgaggagccccacctgagccccgtgcccgaggagccctgcctgagcccccagcccgaggagagccacctgagcccccagagcgaggagccctgcctgagccccagacccgaggagagccacctgagccccgagctggagaagccccccctgagccccagacccgagaagccccccgaggagcccggccagtgccccgcccccgaggagctgcccctgttccccccccccggcgagcccagcctgagccccctgctgggcgagcccgccctgagcgagcccggcgagccccccctgagccccctgcccgaggagctgcccctgagccccagcggcgagcccagcctgagcccccagctgatgccccccgaccccctgcccccccccctgagccccatcatcaccgccgccgccccccccgccctgagccccctgggcgagctggagtaccccttcggcgccaagggcgacagcgaccccgagagccccctggccgcccccatcctggagacccccatcagccccccccccgaggccaactgcaccgaccccgagcccgtgccccccatgatcctgccccccagccccggcagccccgtgggccccgccagccccatcctgatggagcccctgcccccccagtgcagccccctgctgcagcacagcctggtgccccagaacagcccccccagccagtgcagcccccccgccctgcccctgagcgtgcccagccccctgagccccatcggcaaggtggtgggcgtgagcgacgaggccgagctgcacgagatggagaccgagaaggtgagcgagcccgagtgccccgccctggagcccagcgccaccagccccctgcccagccccatgggcgacctgagctgccccgcccccagccccgcccccgccctggacgacttcagcggcctgggcgaggacaccgcccccctggacggcatcgacgcccccggcagccagcccgagcccggccagacccccggcagcctggccagcgagctgaagggcagccccgtgctgctggaccccgaggagctggcccccgtgacccccatggaggtgtaccccgagtgcaagcagaccgccggccagggcagcccctgcgaggagcaggaggagcccagagcccccgtggcccccaccccccccaccctgatcaagagcgacatcgtgaacgagatcagcaacctgagccagggcgacgccagcgccagcttccccggcagcgagcccctgctgggcagccccgaccccgagggcggcggcagcctgagcatggagctgggcgtgagcaccgacgtgagccccgccagagacgagggcagcctgagactgtgcaccgacagcctgcccgagaccgacgacagcctgctgtgcgacgccggcaccgccatcagcggcggcaaggccgagggcgagaagggcagaagaagaagcagccccgccagaagcagaatcaagcagggcagaagcagcagcttccccggcagaagaagacccagaggcggcgcccacggcggcagaggcagaggcagagccagactgaagagcaccgccagcagcatcgagaccctggtggtggccgacatcgacagcagccccagcaaggaggaggaggaggaggacgacgacaccatgcagaacaccgtggtgctgttcagcaacaccgacaagttcgtgctgatgcaggacatgtgcgtggtgtgcggcagcttcggcagaggcgccgagggccacctgctggcctgcagccagtgcagccagtgctaccacccctactgcgtgaacagcaagatcaccaaggtgatgctgctgaagggctggagatgcgtggagtgcatcgtgtgcgaggtgtgcggccaggccagcgaccccagcagactgctgctgtgcgacgactgcgacatcagctaccacacctactgcctggacccccccctgctgaccgtgcccaagggcggctggaagtgcaagtggtgcgtgagctgcatgcagtgcggcgccgccagccccggcttccactgcgagtggcagaacagctacacccactgcggcccctgcgccagcctggtgacctgccccatctgccacgccccctacgtggaggaggacctgctgatccagtgcagacactgcgagagatggatgcacgccggctgcgagagcctgttcaccgaggacgacgtggagcaggccgccgacgagggcttcgactgcgtgagctgccagccctacgtggtgaagcccgtggcccccgtggccccccccgagctggtgcccatgaaggtgaaggagcccgagccccagtacttcagattcgagggcgtgtggctgaccgagaccggcatggccctgctgagaaacctgaccatgagccccctgcacaagagaagacagagaagaggcagactgggcctgcccggcgaggccggcctggagggcagcgagcccagcgacgccctgggccccgacgacaagaaggacggcgacctggacaccgacgagctgctgaagggcgagggcggcgtggagcacatggagtgcgagatcaagctggagggccccgtgagccccgacgtggagcccggcaaggaggagaccgaggagagcaagaagagaaagagaaagccctacagacccggcatcggcggcttcatggtgagacagagaaagagccacaccagaaccaagaagggccccgccgcccaggccgaggtgctgagcggcgacggccagcccgacgaggtgatccccgccgacctgcccgccgagggcgccgtggagcagagcctggccgagggcgacgagaagaagaagcagcagagaagaggcagaaagaagagcaagctggaggacatgttccccgcctacctgcaggaggccttcttcggcaaggagctgctggacctgagcagaaaggccctgttcgccgtgggcgtgggcagacccagcttcggcctgggcacccccaaggccaagggcgacggcggcagcgagagaaaggagctgcccaccagccagaagggcgacgacggccccgacatcgccgacgaggagagcagaggcctggagggcaaggccgacacccccggccccgaggacggcggcgtgaaggccagccccgtgcccagcgaccccgagaagcccggcacccccggcgagggcatgctgagcagcgacctggacagaatcagcaccgaggagctgcccaagatggagagcaaggacctgcagcagctgttcaaggacgtgctgggcagcgagagagagcagcacctgggctgcggcacccccggcctggagggcagcagaacccccctgcagagacccttcctgcagggcggcctgcccctgggcaacctgcccagcagcagccccatggacagctaccccggcctgtgccagagccccttcctggacagcagagagagaggcggcttcttcagccccgagcccggcgagcccgacagcccctggaccggcagcggcggcaccacccccagcacccccaccacccccaccaccgagggcgagggcgacggcctgagctacaaccagagaagcctgcagagatgggagaaggacgaggagctgggccagctgagcaccatcagccccgtgctgtacgccaacatcaacttccccaacctgaagcaggactaccccgactggagcagcagatgcaagcagatcatgaagctgtggagaaaggtgcccgccgccgacaaggccccctacctgcagaaggccaaggacaacagagccgcccacagaatcaacaaggtgcagaagcaggccgagagccagatcaacaagcagaccaaggtgggcgacatcgccagaaagaccgacagacccgccctgcacctgagaatccccccccagcccggcgccctgggcagccccccccccgccgccgcccccaccatcttcatcggcagccccaccacccccgccggcctgagcaccagcgccgacggcttcctgaagccccccgccggcagcgtgcccggccccgacagccccggcgagctgttcctgaagctgcccccccaggtgcccgcccaggtgcccagccaggaccccttcggcctggcccccgcctaccccctggagcccagattccccaccgccccccccacctaccccccctaccccagccccaccggcgcccccgcccagccccccatgctgggcgccagcagcagacccggcgccggccagcccggcgagttccacaccaccccccccggcacccccagacaccagcccagcacccccgaccccttcctgaagcccagatgccccagcctggacaacctggccgtgcccgagagccccggcgtgggcggcggcaaggccagcgagcccctgctgagccccccccccttcggcgagagcagaaaggccctggaggtgaagaaggaggagctgggcgccagcagccccagctacggcccccccaacctgggcttcgtggacagccccagcagcggcacccacctgggcggcctggagctgaagacccccgacgtgttcaaggcccccctgacccccagagccagccaggtggagccccagagccccggcctgggcctgagaccccaggagcccccccccgcccaggccctggcccccagcccccccagccaccccgacatcttcagacccggcagctacaccgacccctacgcccagccccccctgacccccagaccccagccccccccccccgagagctgctgcgccctgccccccagaagcctgcccagcgaccccttcagcagagtgcccgccagcccccagagccagagcagcagccagagccccctgacccccagacccctgagcgccgaggccttctgccccagccccgtgacccccagattccagagccccgacccctacagcagaccccccagcagaccccagagcagagaccccttcgcccccctgcacaagccccccagaccccagccccccgaggtggccttcaaggccggcagcctggcccacaccagcctgggcgccggcggcttccccgccgccctgcccgccggccccgccggcgagctgcacgccaaggtgcccagcggccagccccccaacttcgtgagaagccccggcaccggcgccttcgtgggcacccccagccccatgagattcaccttcccccaggccgtgggcgagcccagcctgaagccccccgtgccccagcccggcctgccccccccccacggcatcaacagccacttcggccccggccccaccctgggcaagccccagagcaccaactacaccgtggccaccggcaacttccaccccagcggcagccccctgggccccagcagcggcagcaccggcgagagctacggcctgagccccctgagaccccccagcgtgctgcccccccccgcccccgacggcagcctgccctacctgagccacggcgccagccagagaagcggcatcaccagccccgtggagaagagagaggaccccggcaccggcatgggcagcagcctggccaccgccgagctgcccggcacccaggaccccggcatgagcggcctgagccagaccgagctggagaagcagagacagagacagagactgagagagctgctgatcagacagcagatccagagaaacaccctgagacaggagaaggagaccgccgccgccgccgccggcgccgtgggcccccccggcagctggggcgccgagcccagcagccccgccttcgagcagctgagcagaggccagacccccttcgccggcacccaggacaagagcagcctggtgggcctgccccccagcaagctgagcggccccatcctgggccccggcagcttccccagcgacgacagactgagcagaccccccccccccgccacccccagcagcatggacgtgaacagcagacagctggtgggcggcagccaggccttctaccagagagccccctaccccggcagcctgcccctgcagcagcagcagcagcagctgtggcagcagcagcaggccaccgccgccaccagcatgagattcgccatgagcgccagattccccagcacccccggccccgagctgggcagacaggccctgggcagccccctggccggcatcagcaccagactgcccggccccggcgagcccgtgcccggccccgccggccccgcccagttcatcgagctgagacacaacgtgcagaagggcctgggccccggcggcacccccttccccggccagggccccccccagagacccagattctaccccgtgagcgaggacccccacagactggcccccgagggcctgagaggcctggccgtgagcggcctgcccccccagaagcccagcgccccccccgcccccgagctgaacaacagcctgcaccccaccccccacaccaagggccccaccctgcccaccggcctggagctggtgaacagaccccccagcagcaccgagctgggcagacccaaccccctggccctggaggccggcaagctgccctgcgaggaccccgagctggacgacgacttcgacgcccacaaggccctggaggacgacgaggagctggcccacctgggcctgggcgtggacgtggccaagggcgacgacgagctgggcaccctggagaacctggagaccaacgacccccacctggacgacctgctgaacggcgacgagttcgacctgctggcctacaccgaccccgagctggacaccggcgacaagaaggacatcttcaacgagcacctgagactggtggagagcgccaacgagaaggccgagagagaggccctgctgagaggcgtggagcccggccccctgggccccgaggagagacccccccccgccgccgacgccagcgagcccagactggccagcgtgctgcccgaggtgaagcccaaggtggaggagggcggcagacaccccagcccctgccagttcaccatcgccacccccaaggtggagcccgcccccgccgccaacagcctgggcctgggcctgaagcccggccagagcatgatgggcagcagagacaccagaatgggcaccggccccttcagcagcagcggccacaccgccgagaaggccagcttcggcgccaccggcggcccccccgcccacctgctgacccccagccccctgagcggccccggcggcagcagcctgctggagaagttcgagctggagagcggcgccctgaccctgcccggcggccccgccgccagcggcgacgagctggacaagatggagagcagcctggtggccagcgagctgcccctgctgatcgaggacctgctggagcacgagaagaaggagctgcagaagaagcagcagctgagcgcccagctgcagcccgcccagcagcagcagcagcagcagcagcagcacagcctgctgagcgcccccggccccgcccaggccatgagcctgccccacgagggcagcagccccagcctggccggcagccagcagcagctgagcctgggcctggccggcgccagacagcccggcctgccccagcccctgatgcccacccagccccccgcccacgccctgcagcagagactggcccccagcatggccatggtgagcaaccagggccacatgctgagcggccagcacggcggccaggccggcctggtgccccagcagagcagccagcccgtgctgagccagaagcccatgggcaccatgccccccagcatgtgcatgaagccccagcagctggccatgcagcagcagctggccaacagcttcttccccgacaccgacctggacaagttcgccgccgaggacatcatcgaccccatcgccaaggccaagatggtggccctgaagggcatcaagaaggtgatggcccagggcagcatcggcgtggcccccggcatgaacagacagcaggtgagcctgctggcccagagactgagcggcggccccagcagcgacctgcagaaccacgtggccgccggcagcggccaggagagaagcgccggcgaccccagccagcccagacccaacccccccaccttcgcccagggcgtgatcaacgaggccgaccagagacagtacgaggagtggctgttccacacccagcagctgctgcagatgcagctgaaggtgctggaggagcagatcggcgtgcacagaaagagcagaaaggccctgtgcgccaagcagagaaccgccaagaaggccggcagagagttccccgaggccgacgccgagaagctgaagctggtgaccgagcagcagagcaagatccagaagcagctggaccaggtgagaaagcagcagaaggagcacaccaacctgatggccgagtacagaaacaagcagcagcagcagcagcagcagcagcagcagcagcagcagcagcacagcgccgtgctggccctgagccccagccagagccccagactgctgaccaagctgcccggccagctgctgcccggccacggcctgcagcccccccagggcccccccggcggccaggccggcggcctgagactgacccccggcggcatggccctgcccggccagcccggcggccccttcctgaacaccgccctggcccagcagcagcagcagcagcacagcggcggcgccggcagcctggccggccccagcggcggcttcttccccggcaacctggccctgagaagcctgggccccgacagcagactgctgcaggagagacagctgcagctgcagcagcagagaatgcagctggcccagaagctgcagcagcagcagcagcagcagcagcagcagcagcacctgctgggccaggtggccatccagcagcagcagcagcagggccccggcgtgcagaccaaccaggccctgggccccaagccccagggcctgatgccccccagcagccaccagggcctgctggtgcagcagctgagcccccagcccccccagggcccccagggcatgctgggccccgcccaggtggccgtgctgcagcagcagcaccccggcgccctgggcccccagggcccccacagacaggtgctgatgacccagagcagagtgctgagcagcccccagctggcccagcagggccagggcctgatgggccacagactggtgaccgcccagcagcagcagcagcagcagcagcaccagcagcagggcagcatggccggcctgagccacctgcagcagagcctgatgagccacagcggccagcccaagctgagcgcccagcccatgggcagcctgcagcagctgcagcagcagcagcagctgcagcagcagcagcagctgcagcagcagcagcagcagcagctgcagcagcagcagcagctgcagcagcagcagctgcagcagcagcagcagcagcagcagctgcagcagcagcagcagcagcagctgcagcagcagcagcagcagctgcagcagcagcagcagcagcagcagcagcagttccagcagcagcagcagcagcagcagatgggcctgctgaaccagagcagaaccctgctgagcccccagcagcagcagcagcagcaggtggccctgggccccggcatgcccgccaagcccctgcagcacttcagcagccccggcgccctgggccccaccctgctgctgaccggcaaggagcagaacaccgtggaccccgccgtgagcagcgaggccaccgagggccccagcacccaccagggcggccccctggccatcggcaccacccccgagagcatggccaccgagcccggcgaggtgaagcccagcctgagcggcgacagccagctgctgctggtgcagccccagccccagccccagcccagcagcctgcagctgcagccccccctgagactgcccggccagcagcagcagcaggtgagcctgctgcacaccgccggcggcggcagccacggccagctgggcagcggcagcagcagcgaggccagcagcgtgccccacctgctggcccagcccagcgtgagcctgggcgaccagcccggcagcatgacccagaacctgctgggcccccagcagcccatgctggagagacccatgcagaacaacaccggcccccagccccccaagcccggccccgtgctgcagagcggccagggcctgcccggcgtgggcatcatgcccaccgtgggccagctgagagcccagctgcagggcgtgctggccaagaacccccagctgagacacctgagcccccagcagcagcagcagctgcaggccctgctgatgcagagacagctgcagcagagccaggccgtgagacagacccccccctaccaggagcccggcacccagaccagccccctgcagggcctgctgggctgccagccccagctgggcggcttccccggcccccagaccggccccctgcaggagctgggcgccggccccagaccccagggcccccccagactgcccgccccccccggcgccctgagcaccggccccgtgctgggccccgtgcaccccacccccccccccagcagcccccaggagcccaagagacccagccagctgcccagccccagcagccagctgcccaccgaggcccagctgccccccacccaccccggcacccccaagccccagggccccaccctggagcccccccccggcagagtgagccccgccgccgcccagctggccgacaccctgttcagcaagggcctgggcccctgggacccccccgacaacctggccgagacccagaagcccgagcagagcagcctggtgcccggccacctggaccaggtgaacggccaggtggtgcccgaggccagccagctgagcatcaagcaggagcccagagaggagccctgcgccctgggcgcccagagcgtgaagagagaggccaacggcgagcccatcggcgcccccggcaccagcaaccacctgctgctggccggccccagaagcgaggccggccacctgctgctgcagaagctgctgagagccaagaacgtgcagctgagcaccggcagaggcagcgagggcctgagagccgagatcaacggccacatcgacagcaagctggccggcctggagcagaagctgcagggcacccccagcaacaaggaggacgccgccgccagaaagcccctgacccccaagcccaagagagtgcagaaggccagcgacagactggtgagcagcagaaagaagctgagaaaggaggacggcgtgagagccagcgaggccctgctgaagcagctgaagcaggagctgagcctgctgcccctgaccgagcccgccatcaccgccaacttcagcctgttcgcccccttcggcagcggctgccccgtgaacggccagagccagctgagaggcgccttcggcagcggcgccctgcccaccggccccgactactacagccagctgctgaccaagaacaacctgagcaacccccccaccccccccagcagcctgccccccacccccccccccagcgtgcagcagaagatggtgaacggcgtgacccccagcgaggagctgggcgagcaccccaaggacgccgccagcgccagagacagcgagagagccctgagagacaccagcgaggtgaagagcctggacctgctggccgccctgcccacccccccccacaaccagaccgaggacgtgagaatggagagcgacgaggacagcgacagccccgacagcatcgtgcccgccagcagccccgagagcatcctgggcgaggaggcccccagattcccccacctgggcagcggcagatgggagcaggaggacagagccctgagccccgtgatccccctgatccccagagccagcatccccgtgttccccgacaccaagccctacggcgccctgggcctggaggtgcccggcaagctgcccgtgaccacctgggagaagggcaagggcagcgaggtgagcgtgatgctgaccgtgagcgccgccgccgccaagaacctgaacggcgtgatggtggccgtggccgagctgctgagcatgaagatccccaacagctacgaggtgctgttccccgagagccccgccagagccggcaccgagcccaagaagggcgaggccgagggccccggcggcaaggagaagggcctggagggcaagagccccgacaccggccccgactggctgaagcagttcgacgccgtgctgcccggctacaccctgaagagccagctggacatcctgagcctgctgaagcaggagagccccgcccccgagccccccacccagcacagctacacctacaacgtgagcaacctggacgtgagacagctgagcgcccccccccccgaggagcccagccccccccccagccccctggcccccagccccgccagcccccccaccgagcccctggtggagctgcccaccgagcccctggccgagccccccgtgcccagccccctgcccctggccagcagccccgagagcgccagacccaagcccagagccagaccccccgaggagggcgaggacagcagaccccccagactgaagaagtggaagggcgtgagatggaagagactgagactgctgctgaccatccagaagggcagcggcagacaggaggacgagagagaggtggccgagttcatggagcagctgggcaccgccctgagacccgacaaggtgcccagagacatgagaagatgctgcttctgccacgaggagggcgacggcgccaccgacggccccgccagactgctgaacctggacctggacctgtgggtgcacctgaactgcgccctgtggagcaccgaggtgtacgagacccagggcggcgccctgatgaacgtggaggtggccctgcacagaggcctgctgaccaagtgcagcctgtgccagagaaccggcgccaccagcagctgcaacagaatgagatgccccaacgtgtaccacttcgcctgcgccatcagagccaagtgcatgttcttcaaggacaagaccatgctgtgccccatgcacaagatcaagggcccctgcgagcaggagctgagcagcttcgccgtgttcagaagagtgtacatcgagagagacgaggtgaagcagatcgccagcatcatccagagaggcgagagactgcacatgttcagagtgggcggcctggtgttccacgccatcggccagctgctgccccaccagatggccgacttccacagcgccaccgccctgtaccccgtgggctacgaggccaccagaatctactggagcctgagaaccaacaacagaagatgctgctacagatgcagcatcggcgagaacaacggcagacccgagttcgtgatcaaggtgatcgagcagggcctggaggacctggtgttcaccgacgccagcccccaggccgtgtggaacagaatcatcgagcccgtggccgccatgagaaaggaggccgacatgctgagactgttccccgagtacctgaagggcgaggagctgttcggcctgaccgtgcacgccgtgctgagaatcgccgagagcctgcccggcgtggagagctgccagaactacctgttcagatacggcagacaccccctgatggagctgcccctgatgatcaaccccaccggctgcgccagaagcgagcccaagatcctgacccactacaagagaccccacaccctgaacagcaccagcatgagcaaggcctaccagagcaccttcaccggcgagaccaacaccccctacagcaagcagttcgtgcacagcaagagcagccagtacagaagactgagaaccgagtggaagaacaacgtgtacctggccagaagcagaatccagggcctgggcctgtacgccgccaaggacctggagaagcacaccatggtgatcgagtacatcggcaccatcatcagaaacgaggtggccaacagaagagagaagatctacgaggagcagaacagaggcatctacatgttcagaatcaacaacgagcacgtgatcgacgccaccctgaccggcggccccgccagatacatcaaccacagctgcgcccccaactgcgtggccgaggtggtgaccttcgacaaggaggacaagatcatcatcatcagcagcagaagaatccccaagggcgaggagctgacctacgactaccagttcgacttcgaggacgaccagcacaagatcccctgccactgcggcgcctggaactgcagaaagtggatgaactag

SEQ ID NO: 89856 - DNA, 441 bp, Artificial Sequence
  Description of Artificial Sequence: Synthetic coding sequence
atggacagccagaagctggccggcgaggacaaggacagcgagcccgccgccgacggccccgccgccagcgaggaccccagcgccaccgagagcgacctgcccaacccccacgtgggcgaggtgagcgtgctgagcagcggcagccccagactgcaggagaccccccaggactgcagcggcggccccgtgagaagatgcgccctgtgcaactgcggcgagcccagcctgcacggccagagagagctgagaagattcgagctgcccttcgactggcccagatgccccgtggtgagccccggcggcagccccggccccaacgaggccgtgctgcccagcgaggacctgagccagatcggcttccccgagggcctgacccccgcccacctgggcgagcccggcggcagctgctgggcccaccactggtgcgccgcctggagctag

SEQ ID NO: 89857 - DNA, 14736 bp, Artificial Sequence
  Description of Artificial Sequence: Synthetic coding sequence
atgagcagcgaggaggacaagagcgtggagcagccccagccccccccccccccccccgaggagcccggcgcccccgcccccagccccgccgccgccgacaagagacccagaggcagacccagaaaggacggcgccagccccttccagagagccagaaagaagcccagaagcagaggcaagaccgccgtggaggacgaggacagcatggacggcctggagaccaccgagaccgagaccatcgtggagaccgagatcaaggagcagagcgccgaggaggacgccgaggccgaggtggacaacagcaagcagctgatccccaccctgcagagaagcgtgagcgaggagagcgccaacagcctggtgagcgtgggcgtggaggccaagatcagcgagcagctgtgcgccttctgctactgcggcgagaagagcagcctgggccagggcgacctgaagcagttcagaatcacccccggcttcatcctgccctggagaaaccagcccagcaacaagaaggacatcgacgacaacagcaacggcacctacgagaagatgcagaacagcgcccccagaaagcagagaggccagagaaaggagagaagcccccagcagaacatcgtgagctgcgtgagcgtgagcacccagaccgccagcgacgaccaggccggcaagctgtgggacgagctgagcctggtgggcctgcccgacgccatcgacatccaggccctgttcgacagcaccggcacctgctgggcccaccacagatgcgtggagtggagcctgggcgtgtgccagatggaggagcccctgctggtgaacgtggacaaggccgtggtgagcggcagcaccgagagatgcgccttctgcaagcacctgggcgccaccatcaagtgctgcgaggagaagtgcacccagatgtaccactacccctgcgccgccggcgccggcaccttccaggacttcagccacatcttcctgctgtgccccgagcacatcgaccaggcccccgagagaagcaaggaggacgccaactgcgccgtgtgcgacagccccggcgacctgctggaccagttcttctgcaccacctgcggccagcactaccacggcatgtgcctggacatcgccgtgacccccctgaagagagccggctggcagtgccccgagtgcaaggtgtgccagaactgcaagcagagcggcgaggacagcaagatgctggtgtgcgacacctgcgacaagggctaccacaccttctgcctgcagcccgtgatgaagagcgtgcccaccaacggctggaagtgcaagaactgcagaatctgcatcgagtgcggcaccagaagcagcagccagtggcaccacaactgcctgatctgcgacaactgctaccagcagcaggacaacctgtgccccttctgcggcaagtgctaccaccccgagctgcagaaggacatgctgcactgcaacatgtgcaagagatgggtgcacctggagtgcgacaagcccaccgaccacgagctggacacccagctgaaggaggagtacatctgcatgtactgcaagcacctgggcgccgagatggacagactgcagcccggcgaggaggtggagatcgccgagctgaccaccgactacaacaacgagatggaggtggagggccccgaggaccagatggtgttcagcgagcaggccgccaacaaggacgtgaacggccaggagagcacccccggcatcgtgcccgacgccgtgcaggtgcacaccgaggagcagcagaagagccaccccagcgagagcctggacaccgacagcctgctgatcgccgtgagcagccagcacaccgtgaacaccgagctggagaagcagatcagcaacgaggtggacagcgaggacctgaagatgagcagcgaggtgaagcacatctgcggcgaggaccagatcgaggacaagatggaggtgaccgagaacatcgaggtggtgacccaccagatcaccgtgcagcaggagcagctgcagctgctggaggagcccgagaccgtggtgagcagagaggagagcagaccccccaagctggtgatggagagcgtgaccctgcccctggagaccctggtgagcccccacgaggagagcatcagcctgtgccccgaggagcagctggtgatcgagagactgcagggcgagaaggagcagaaggagaacagcgagctgagcaccggcctgatggacagcgagatgacccccaccatcgagggctgcgtgaaggacgtgagctaccagggcggcaagagcatcaagctgagcagcgagaccgagagcagcttcagcagcagcgccgacatcagcaaggccgacgtgagcagcagccccacccccagcagcgacctgcccagccacgacatgctgcacaactaccccagcgccctgagcagcagcgccggcaacatcatgcccaccacctacatcagcgtgacccccaagatcggcatgggcaagcccgccatcaccaagagaaagttcagccccggcagacccagaagcaagcagggcgcctggagcacccacaacaccgtgagcccccccagctggagccccgacatcagcgagggcagagagatcttcaagcccagacagctgcccggcagcgccatctggagcatcaaggtgggcagaggcagcggcttccccggcaagagaagacccagaggcgccggcctgagcggcagaggcggcagaggcagaagcaagctgaagagcggcatcggcgccgtggtgctgcccggcgtgagcaccgccgacatcagcagcaacaaggacgacgaggagaacagcatgcacaacaccgtggtgctgttcagcagcagcgacaagttcaccctgaaccaggacatgtgcgtggtgtgcggcagcttcggccagggcgccgagggcagactgctggcctgcagccagtgcggccagtgctaccacccctactgcgtgagcatcaagatcaccaaggtggtgctgagcaagggctggagatgcctggagtgcaccgtgtgcgaggcctgcggcaaggccaccgaccccggcagactgctgctgtgcgacgactgcgacatcagctaccacacctactgcctggacccccccctgcagaccgtgcccaagggcggctggaagtgcaagtggtgcgtgtggtgcagacactgcggcgccaccagcgccggcctgagatgcgagtggcagaacaactacacccagtgcgccccctgcgccagcctgagcagctgccccgtgtgctacagaaactacagagaggaggacctgatcctgcagtgcagacagtgcgacagatggatgcacgccgtgtgccagaacctgaacaccgaggaggaggtggagaacgtggccgacatcggcttcgactgcagcatgtgcagaccctacatgcccgccagcaacgtgcccagcagcgactgctgcgagagcagcctggtggcccagatcgtgaccaaggtgaaggagctggacccccccaagacctacacccaggacggcgtgtgcctgaccgagagcggcatgacccagctgcagagcctgaccgtgaccgtgcccagaagaaagagaagcaagcccaagctgaagctgaagatcatcaaccagaacagcgtggccgtgctgcagaccccccccgacatccagagcgagcacagcagagacggcgagatggacgacagcagagagggcgagctgatggactgcgacggcaagagcgagagcagccccgagagagaggccgtggacgacgagaccaagggcgtggagggcaccgacggcgtgaagaagagaaagagaaagccctacagacccggcatcggcggcttcatggtgagacagagaagcagaaccggccagggcaagaccaagagaagcgtgatcagaaaggacagcagcggcagcatcagcgagcagctgccctgcagagacgacggctggagcgagcagctgcccgacaccctggtggacgagagcgtgagcgtgaccgagagcaccgagaagatcaagaagagatacagaaagagaaagaacaagctggaggagaccttccccgcctacctgcaggaggccttcttcggcaaggacctgctggacaccagcagacagagcaagatcagcctggacaacctgagcgaggacggcgcccagctgctgtacaagaccaacatgaacaccggcttcctggaccccagcctggaccccctgctgagcagcagcagcgcccccaccaagagcggcacccacggccccgccgacgaccccctggccgacatcagcgaggtgctgaacaccgacgacgacatcctgggcatcatcagcgacgacctggccaagagcgtggaccacagcgacatcggccccgtgaccgacgaccccagcagcctgccccagcccaacgtgaaccagagcagcagacccctgagcgaggagcagctggacggcatcctgagccccgagctggacaagatggtgaccgacggcgccatcctgggcaagctgtacaagatccccgagctgggcggcaaggacgtggaggacctgttcaccgccgtgctgagccccgccaacacccagcccacccccctgccccagccccccccccccacccagctgctgcccatccacaaccaggacgccttcagcagaatgcccctgatgaacggcctgatcggcagcagcccccacctgccccacaacagcctgccccccggcagcggcctgggcaccttcagcgccatcgcccagagcagctaccccgacgccagagacaagaacagcgccttcaaccccatggccagcgaccccaacaacagctggaccagcagcgcccccaccgtggagggcgagaacgacaccatgagcaacgcccagagaagcaccctgaagtgggagaaggaggaggccctgggcgagatggccaccgtggcccccgtgctgtacaccaacatcaacttccccaacctgaaggaggagttccccgactggaccaccagagtgaagcagatcgccaagctgtggagaaaggccagcagccaggagagagccccctacgtgcagaaggccagagacaacagagccgccctgagaatcaacaaggtgcagatgagcaacgacagcatgaagagacagcagcagcaggacagcatcgaccccagcagcagaatcgacagcgagctgttcaaggaccccctgaagcagagagagagcgagcacgagcaggagtggaagttcagacagcagatgagacagaagagcaagcagcaggccaagatcgaggccacccagaagctggagcaggtgaagaacgagcagcagcagcagcagcagcagcagttcggcagccagcacctgctggtgcagagcggcagcgacacccccagcagcggcatccagagccccctgaccccccagcccggcaacggcaacatgagccccgcccagagcttccacaaggagctgttcaccaagcagccccccagcacccccaccagcaccagcagcgacgacgtgttcgtgaagccccaggcccccccccccccccccgcccccagcagaatccccatccaggacagcctgagccaggcccagaccagccagccccccagcccccaggtgttcagccccggcagcagcaacagcagaccccccagccccatggacccctacgccaagatggtgggcacccccagacccccccccgtgggccacagcttcagcagaagaaacagcgccgcccccgtggagaactgcacccccctgagcagcgtgagcagacccctgcagatgaacgagaccaccgccaacagacccagccccgtgagagacctgtgcagcagcagcaccaccaacaacgacccctacgccaagccccccgacacccccagacccgtgatgaccgaccagttccccaagagcctgggcctgagcagaagccccgtggtgagcgagcagaccgccaagggccccatcgccgccggcaccagcgaccacttcaccaagcccagccccagagccgacgtgttccagagacagagaatccccgacagctacgccagacccctgctgacccccgcccccctggacagcggccccggccccttcaagacccccatgcagcccccccccagcagccaggacccctacggcagcgtgagccaggccagcagaagactgagcgtggacccctacgagagacccgccctgacccccagacccatcgacaacttcagccacaaccagagcaacgacccctacagccagccccccctgaccccccaccccgccgtgaacgagagcttcgcccaccccagcagagccttcagccagcccggcaccatcagcagacccaccagccaggacccctacagccagccccccggcacccccagacccgtggtggacagctacagccagagcagcggcaccgccagaagcaacaccgacccctacagccagccccccggcacccccagacccaccaccgtggacccctacagccagcagccccagacccccagacccagcacccagaccgacctgttcgtgacccccgtgaccaaccagagacacagcgacccctacgcccacccccccggcacccccagacccggcatcagcgtgccctacagccagccccccgccacccccagacccagaatcagcgagggcttcaccagaagcagcatgaccagacccgtgctgatgcccaaccaggaccccttcctgcaggccgcccagaacagaggccccgccctgcccggccccctggtgagaccccccgacacctgcagccagacccccagaccccccggccccggcctgagcgacaccttcagcagagtgagccccagcgccgccagagacccctacgaccagagccccatgacccccagaagccagagcgacagcttcggcaccagccagaccgcccacgacgtggccgaccagcccagacccggcagcgagggcagcttctgcgccagcagcaacagccccatgcacagccagggccagcagttcagcggcgtgagccagctgcccggccccgtgcccaccagcggcgtgaccgacacccagaacaccgtgaacatggcccaggccgacaccgagaagctgagacagagacagaagctgagagagatcatcctgcagcagcagcagcagaagaagatcgccggcagacaggagaagggcagccaggacagccccgccgtgccccaccccggccccctgcagcactggcagcccgagaacgtgaaccaggccttcaccagacccccccccccctaccccggcaacatcagaagccccgtggccccccccctgggccccagatacgccgtgttccccaaggaccagagaggcccctacccccccgacgtggccagcatgggcatgagaccccacggcttcagattcggcttccccggcggcagccacggcaccatgcccagccaggagagattcctggtgcccccccagcagatccagggcagcggcgtgagcccccagctgagaagaagcgtgagcgtggacatgcccagacccctgaacaacagccagatgaacaaccccgtgggcctgccccagcacttcagcccccagagcctgcccgtgcagcagcacaacatcctgggccaggcctacatcgagctgagacacagagcccccgacggcagacagagactgcccttcagcgccccccccggcagcgtggtggaggccagcagcaacctgagacacggcaacttcatccccagacccgacttccccggccccagacacaccgaccccatgagaagacccccccagggcctgcccaaccagctgcccgtgcaccccgacctggagcaggtgccccccagccagcaggagcagggccacagcgtgcacagcagcagcatggtgatgagaaccctgaaccaccccctgggcggcgagttcagcgaggcccccctgagcaccagcgtgcccagcgagaccaccagcgacaacctgcagatcaccacccagcccagcgacggcctggaggagaagctggacagcgacgaccccagcgtgaaggagctggacgtgaaggacctggagggcgtggaggtgaaggacctggacgacgaggacctggagaacctgaacctggacaccgaggacggcaaggtggtggagctggacaccctggacaacctggagaccaacgaccccaacctggacgacctgctgagaagcggcgagttcgacatcatcgcctacaccgaccccgagctggacatgggcgacaagaagagcatgttcaacgaggagctggacctgcccatcgacgacaagctggacaaccagtgcgtgagcgtggagcccaagaagaaggagcaggagaacaagaccctggtgctgagcgacaagcacagcccccagaagaagagcaccgtgaccaacgaggtgaagaccgaggtgctgagccccaacagcaaggtggagagcaagtgcgagaccgagaagaacgacgagaacaaggacaacgtggacaccccctgcagccaggccagcgcccacagcgacctgaacgacggcgagaagaccagcctgcacccctgcgaccccgacctgttcgagaagagaaccaacagagagaccgccggccccagcgccaacgtgatccaggccagcacccagctgcccgcccaggacgtgatcaacagctgcggcatcaccggcagcacccccgtgctgagcagcctgctggccaacgagaagagcgacaacagcgacatcagacccagcggcagcccccccccccccaccctgcccgccagccccagcaaccacgtgagcagcctgccccccttcatcgccccccccggcagagtgctggacaacgccatgaacagcaacgtgaccgtggtgagcagagtgaaccacgtgttcagccagggcgtgcaggtgaaccccggcctgatccccggccagagcaccgtgaaccacagcctgggcaccggcaagcccgccacccagaccggcccccagaccagccagagcggcaccagcagcatgagcggcccccagcagctgatgatcccccagaccctggcccagcagaacagagagagacccctgctgctggaggagcagcccctgctgctgcaggacctgctggaccaggagagacaggagcagcagcagcagagacagatgcaggccatgatcagacagagaagcgagcccttcttccccaacatcgacttcgacgccatcaccgaccccatcatgaaggccaagatggtggccctgaagggcatcaacaaggtgatggcccagaacaacctgggcatgccccccatggtgatgagcagattccccttcatgggccaggtggtgaccggcacccagaacagcgagggccagaacctgggcccccaggccatcccccaggacggcagcatcacccaccagatcagcagacccaacccccccaacttcggccccggcttcgtgaacgacagccagagaaagcagtacgaggagtggctgcaggagacccagcagctgctgcagatgcagcagaagtacctggaggagcagatcggcgcccacagaaagagcaagaaggccctgagcgccaagcagagaaccgccaagaaggccggcagagagttccccgaggaggacgccgagcagctgaagcacgtgaccgagcagcagagcatggtgcagaagcagctggagcagatcagaaagcagcagaaggagcacgccgagctgatcgaggactacagaatcaagcagcagcagcagtgcgccatggccccccccaccatgatgcccagcgtgcagccccagccccccctgatccccggcgccaccccccccaccatgagccagcccaccttccccatggtgccccagcagctgcagcaccagcagcacaccaccgtgatcagcggccacaccagccccgtgagaatgcccagcctgcccggctggcagcccaacagcgcccccgcccacctgcccctgaacccccccagaatccagccccccatcgcccagctgcccatcaagacctgcacccccgcccccggcaccgtgagcaacgccaacccccagagcggccccccccccagagtggagttcgacgacaacaaccccttcagcgagagcttccaggagagagagagaaaggagagactgagagagcagcaggagagacagagaatccagctgatgcaggaggtggacagacagagagccctgcagcagagaatggagatggagcagcacggcatggtgggcagcgagatcagcagcagcagaaccagcgtgagccagatccccttctacagcagcgacctgccctgcgacttcatgcagcccctgggccccctgcagcagagcccccagcaccagcagcagatgggccaggtgctgcagcagcagaacatccagcagggcagcatcaacagccccagcacccagaccttcatgcagaccaacgagagaagacaggtgggcccccccagcttcgtgcccgacagccccagcatccccgtgggcagccccaacttcagcagcgtgaagcagggccacggcaacctgagcggcaccagcttccagcagagccccgtgagacccagcttcacccccgccctgcccgccgccccccccgtggccaacagcagcctgccctgcggccaggacagcaccatcacccacggccacagctaccccggcagcacccagagcctgatccagctgtacagcgacatcatccccgaggagaagggcaagaagaagagaaccagaaagaagaagagagacgacgacgccgagagcaccaaggcccccagcaccccccacagcgacatcaccgccccccccacccccggcatcagcgagaccaccagcacccccgccgtgagcacccccagcgagctgccccagcaggccgaccaggagagcgtggagcccgtgggccccagcacccccaacatggccgccggccagctgtgcaccgagctggagaacaagctgcccaacagcgacttcagccaggccacccccaaccagcagacctacgccaacagcgaggtggacaagctgagcatggagacccccgccaagaccgaggagatcaagctggagaaggccgagaccgagagctgccccggccaggaggagcccaagctggaggagcagaacggcagcaaggtggagggcaacgccgtggcctgccccgtgagcagcgcccagagccccccccacagcgccggcgcccccgccgccaagggcgacagcggcaacgagctgctgaagcacctgctgaagaacaagaagagcagcagcctgctgaaccagaagcccgagggcagcatctgcagcgaggacgactgcaccaaggacaacaagctggtggagaagcagaaccccgccgagggcctgcagaccctgggcgcccagatgcagggcggcttcggctgcggcaaccagctgcccaagaccgacggcggcagcgagaccaagaagcagagaagcaagagaacccagagaaccggcgagaaggccgcccccagaagcaagaagagaaagaaggacgaggaggagaagcaggccatgtacagcagcaccgacaccttcacccacctgaagcagcagaacaacctgagcaacccccccaccccccccgccagcctgccccccacccccccccccatggcctgccagaagatggccaacggcttcgccaccaccgaggagctggccggcaaggccggcgtgctggtgagccacgaggtgaccaagaccctgggccccaagcccttccagctgcccttcagaccccaggacgacctgctggccagagccctggcccagggccccaagaccgtggacgtgcccgccagcctgcccacccccccccacaacaaccaggaggagctgagaatccaggaccactgcggcgacagagacacccccgacagcttcgtgcccagcagcagccccgagagcgtggtgggcgtggaggtgagcagataccccgacctgagcctggtgaaggaggagccccccgagcccgtgcccagccccatcatccccatcctgcccagcaccgccggcaagagcagcgagagcagaagaaacgacatcaagaccgagcccggcaccctgtacttcgccagccccttcggccccagccccaacggccccagaagcggcctgatcagcgtggccatcaccctgcaccccaccgccgccgagaacatcagcagcgtggtggccgccttcagcgacctgctgcacgtgagaatccccaacagctacgaggtgagcagcgcccccgacgtgcccagcatgggcctggtgagcagccacagaatcaaccccggcctggagtacagacagcacctgctgctgagaggccccccccccggcagcgccaacccccccagactggtgagcagctacagactgaagcagcccaacgtgcccttcccccccaccagcaacggcctgagcggctacaaggacagcagccacggcatcgccgagagcgccgccctgagaccccagtggtgctgccactgcaaggtggtgatcctgggcagcggcgtgagaaagagcttcaaggacctgaccctgctgaacaaggacagcagagagagcaccaagagagtggagaaggacatcgtgttctgcagcaacaactgcttcatcctgtacagcagcaccgcccaggccaagaacagcgagaacaaggagagcatccccagcctgccccagagccccatgagagagacccccagcaaggccttccaccagtacagcaacaacatcagcaccctggacgtgcactgcctgccccagctgcccgagaaggccagcccccccgccagcccccccatcgccttcccccccgccttcgaggccgcccaggtggaggccaagcccgacgagctgaaggtgaccgtgaagctgaagcccagactgagagccgtgcacggcggcttcgaggactgcagacccctgaacaagaagtggagaggcatgaagtggaagaagtggagcatccacatcgtgatccccaagggcaccttcaagcccccctgcgaggacgagatcgacgagttcctgaagaagctgggcaccagcctgaagcccgaccccgtgcccaaggactacagaaagtgctgcttctgccacgaggagggcgacggcctgaccgacggccccgccagactgctgaacctggacctggacctgtgggtgcacctgaactgcgccctgtggagcaccgaggtgtacgagacccaggccggcgccctgatcaacgtggagctggccctgagaagaggcctgcagatgaagtgcgtgttctgccacaagaccggcgccaccagcggctgccacagattcagatgcaccaacatctaccacttcacctgcgccatcaaggcccagtgcatgttcttcaaggacaagaccatgctgtgccccatgcacaagcccaagggcatccacgagcaggagctgagctacttcgccgtgttcagaagagtgtacgtgcagagagacgaggtgagacagatcgccagcatcgtgcagagaggcgagagagaccacaccttcagagtgggcagcctgatcttccacaccatcggccagctgctgccccagcagatgcaggccttccacagccccaaggccctgttccccgtgggctacgaggccagcagactgtactggagcaccagatacgccaacagaagatgcagatacctgtgcagcatcgaggagaaggacggcagacccgtgttcgtgatcagaatcgtggagcagggccacgaggacctggtgctgagcgacatcagccccaagggcgtgtgggacaagatcctggagcccgtggcctgcgtgagaaagaagagcgagatgctgcagctgttccccgcctacctgaagggcgaggacctgttcggcctgaccgtgagcgccgtggccagaatcgccgagagcctgcccggcgtggaggcctgcgagaactacaccttcagatacggcagaaaccccctgatggagctgcccctggccgtgaaccccaccggctgcgccagaagcgagcccaagatgagcgcccacgtgaagagattcgtgctgagaccccacaccctgaacagcaccagcaccagcaagagcttccagagcaccgtgaccggcgagctgaacgccccctacagcaagcagttcgtgcacagcaagagcagccagtacagaaagatgaagaccgagtggaagagcaacgtgtacctggccagaagcagaatccagggcctgggcctgtacgccgccagagacatcgagaagcacaccatggtgatcgagtacatcggcaccatcatcagaaacgaggtggccaacagaaaggagaagctgtacgagagccagaacagaggcgtgtacatgttcagaatggacaacgaccacgtgatcgacgccaccctgaccggcggccccgccagatacatcaaccacagctgcgcccccaactgcgtggccgaggtggtgaccttcgagagaggccacaagatcatcatcagcagcagcagaagaatccagaagggcgaggagctgtgctacgactacaagttcgacttcgaggacgaccagcacaagatcccctgccactgcggcgccgtgaactgcagaaagtggatgaactag

SEQ ID NO: 89858 - DNA, 14907 bp, Artificial Sequence
  Description of Artificial Sequence: Synthetic coding sequence
atgagcagcgaggaggacaagagcgtggagcagccccagccccccccccccccccccgaggagcccggcgcccccgcccccagccccgccgccgccgacaagagacccagaggcagacccagaaaggacggcgccagccccttccagagagccagaaagaagcccagaagcagaggcaagaccgccgtggaggacgaggacagcatggacggcctggagaccaccgagaccgagaccatcgtggagaccgagatcaaggagcagagcgccgaggaggacgccgaggccgaggtggacaacagcaagcagctgatccccaccctgcagagaagcgtgagcgaggagagcgccaacagcctggtgagcgtgggcgtggaggccaagatcagcgagcagctgtgcgccttctgctactgcggcgagaagagcagcctgggccagggcgacctgaagcagttcagaatcacccccggcttcatcctgccctggagaaaccagcccagcaacaagaaggacatcgacgacaacagcaacggcacctacgagaagatgcagaacagcgcccccagaaagcagagaggccagagaaaggagagaagcccccagcagaacatcgtgagctgcgtgagcgtgagcacccagaccgccagcgacgaccaggccggcaagctgtgggacgagctgagcctggtgggcctgcccgacgccatcgacatccaggccctgttcgacagcaccggcacctgctgggcccaccacagatgcgtggagtggagcctgggcgtgtgccagatggaggagcccctgctggtgaacgtggacaaggccgtggtgagcggcagcaccgagagatgcgccttctgcaagcacctgggcgccaccatcaagtgctgcgaggagaagtgcacccagatgtaccactacccctgcgccgccggcgccggcaccttccaggacttcagccacatcttcctgctgtgccccgagcacatcgaccaggcccccgagagaagcaaggaggacgccaactgcgccgtgtgcgacagccccggcgacctgctggaccagttcttctgcaccacctgcggccagcactaccacggcatgtgcctggacatcgccgtgacccccctgaagagagccggctggcagtgccccgagtgcaaggtgtgccagaactgcaagcagagcggcgaggacagcaagatgctggtgtgcgacacctgcgacaagggctaccacaccttctgcctgcagcccgtgatgaagagcgtgcccaccaacggctggaagtgcaagaactgcagaatctgcatcgagtgcggcaccagaagcagcagccagtggcaccacaactgcctgatctgcgacaactgctaccagcagcaggacaacctgtgccccttctgcggcaagtgctaccaccccgagctgcagaaggacatgctgcactgcaacatgtgcaagagatgggtgcacctggagtgcgacaagcccaccgaccacgagctggacacccagctgaaggaggagtacatctgcatgtactgcaagcacctgggcgccgagatggacagactgcagcccggcgaggaggtggagatcgccgagctgaccaccgactacaacaacgagatggaggtggagggccccgaggaccagatggtgttcagcgagcaggccgccaacaaggacgtgaacggccaggagagcacccccggcatcgtgcccgacgccgtgcaggtgcacaccgaggagcagcagaagagccaccccagcgagagcctggacaccgacagcctgctgatcgccgtgagcagccagcacaccgtgaacaccgagctggagaagcagatcagcaacgaggtggacagcgaggacctgaagatgagcagcgaggtgaagcacatctgcggcgaggaccagatcgaggacaagatggaggtgaccgagaacatcgaggtggtgacccaccagatcaccgtgcagcaggagcagctgcagctgctggaggagcccgagaccgtggtgagcagagaggagagcagaccccccaagctggtgatggagagcgtgaccctgcccctggagaccctggtgagcccccacgaggagagcatcagcctgtgccccgaggagcagctggtgatcgagagactgcagggcgagaaggagcagaaggagaacagcgagctgagcaccggcctgatggacagcgagatgacccccaccatcgagggctgcgtgaaggacgtgagctaccagggcggcaagagcatcaagctgagcagcgagaccgagagcagcttcagcagcagcgccgacatcagcaaggccgacgtgagcagcagccccacccccagcagcgacctgcccagccacgacatgctgcacaactaccccagcgccctgagcagcagcgccggcaacatcatgcccaccacctacatcagcgtgacccccaagatcggcatgggcaagcccgccatcaccaagagaaagttcagccccggcagacccagaagcaagcagggcgcctggagcacccacaacaccgtgagcccccccagctggagccccgacatcagcgagggcagagagatcttcaagcccagacagctgcccggcagcgccatctggagcatcaaggtgggcagaggcagcggcttccccggcaagagaagacccagaggcgccggcctgagcggcagaggcggcagaggcagaagcaagctgaagagcggcatcggcgccgtggtgctgcccggcgtgagcaccgccgacatcagcagcaacaaggacgacgaggagaacagcatgcacaacaccgtggtgctgttcagcagcagcgacaagttcaccctgaaccaggacatgtgcgtggtgtgcggcagcttcggccagggcgccgagggcagactgctggcctgcagccagtgcggccagtgctaccacccctactgcgtgagcatcaagatcaccaaggtggtgctgagcaagggctggagatgcctggagtgcaccgtgtgcgaggcctgcggcaaggccaccgaccccggcagactgctgctgtgcgacgactgcgacatcagctaccacacctactgcctggacccccccctgcagaccgtgcccaagggcggctggaagtgcaagtggtgcgtgtggtgcagacactgcggcgccaccagcgccggcctgagatgcgagtggcagaacaactacacccagtgcgccccctgcgccagcctgagcagctgccccgtgtgctacagaaactacagagaggaggacctgatcctgcagtgcagacagtgcgacagatggatgcacgccgtgtgccagaacctgaacaccgaggaggaggtggagaacgtggccgacatcggcttcgactgcagcatgtgcagaccctacatgcccgccagcaacgtgcccagcagcgactgctgcgagagcagcctggtggcccagatcgtgaccaaggtgaaggagctggacccccccaagacctacacccaggacggcgtgtgcctgaccgagagcggcatgacccagctgcagagcctgaccgtgaccgtgcccagaagaaagagaagcaagcccaagctgaagctgaagatcatcaaccagaacagcgtggccgtgctgcagaccccccccgacatccagagcgagcacagcagagacggcgagatggacgacagcagagagggcgagctgatggactgcgacggcaagagcgagagcagccccgagagagaggccgtggacgacgagaccaagggcgtggagggcaccgacggcgtgaagaagagaaagagaaagccctacagacccggcatcggcggcttcatggtgagacagagaagcagaaccggccagggcaagaccaagagaagcgtgatcagaaaggacagcagcggcagcatcagcgagcagctgccctgcagagacgacggctggagcgagcagctgcccgacaccctggtggacgagagcgtgagcgtgaccgagagcaccgagaagatcaagaagagatacagaaagagaaagaacaagctggaggagaccttccccgcctacctgcaggaggccttcttcggcaaggacctgctggacaccagcagacagagcaagatcagcctggacaacctgagcgaggacggcgcccagctgctgtacaagaccaacatgaacaccggcttcctggaccccagcctggaccccctgctgagcagcagcagcgcccccaccaagagcggcacccacggccccgccgacgaccccctggccgacatcagcgaggtgctgaacaccgacgacgacatcctgggcatcatcagcgacgacctggccaagagcgtggaccacagcgacatcggccccgtgaccgacgaccccagcagcctgccccagcccaacgtgaaccagagcagcagacccctgagcgaggagcagctggacggcatcctgagccccgagctggacaagatggtgaccgacggcgccatcctgggcaagctgtacaagatccccgagctgggcggcaaggacgtggaggacctgttcaccgccgtgctgagccccgccaacacccagcccacccccctgccccagccccccccccccacccagctgctgcccatccacaaccaggacgccttcagcagaatgcccctgatgaacggcctgatcggcagcagcccccacctgccccacaacagcctgccccccggcagcggcctgggcaccttcagcgccatcgcccagagcagctaccccgacgccagagacaagaacagcgccttcaaccccatggccagcgaccccaacaacagctggaccagcagcgcccccaccgtggagggcgagaacgacaccatgagcaacgcccagagaagcaccctgaagtgggagaaggaggaggccctgggcgagatggccaccgtggcccccgtgctgtacaccaacatcaacttccccaacctgaaggaggagttccccgactggaccaccagagtgaagcagatcgccaagctgtggagaaaggccagcagccaggagagagccccctacgtgcagaaggccagagacaacagagccgccctgagaatcaacaaggtgcagatgagcaacgacagcatgaagagacagcagcagcaggacagcatcgaccccagcagcagaatcgacagcgagctgttcaaggaccccctgaagcagagagagagcgagcacgagcaggagtggaagttcagacagcagatgagacagaagagcaagcagcaggccaagatcgaggccacccagaagctggagcaggtgaagaacgagcagcagcagcagcagcagcagcagttcggcagccagcacctgctggtgcagagcggcagcgacacccccagcagcggcatccagagccccctgaccccccagcccggcaacggcaacatgagccccgcccagagcttccacaaggagctgttcaccaagcagccccccagcacccccaccagcaccagcagcgacgacgtgttcgtgaagccccaggcccccccccccccccccgcccccagcagaatccccatccaggacagcctgagccaggcccagaccagccagccccccagcccccaggtgttcagccccggcagcagcaacagcagaccccccagccccatggacccctacgccaagatggtgggcacccccagacccccccccgtgggccacagcttcagcagaagaaacagcgccgcccccgtggagaactgcacccccctgagcagcgtgagcagacccctgcagatgaacgagaccaccgccaacagacccagccccgtgagagacctgtgcagcagcagcaccaccaacaacgacccctacgccaagccccccgacacccccagacccgtgatgaccgaccagttccccaagagcctgggcctgagcagaagccccgtggtgagcgagcagaccgccaagggccccatcgccgccggcaccagcgaccacttcaccaagcccagccccagagccgacgtgttccagagacagagaatccccgacagctacgccagacccctgctgacccccgcccccctggacagcggccccggccccttcaagacccccatgcagcccccccccagcagccaggacccctacggcagcgtgagccaggccagcagaagactgagcgtggacccctacgagagacccgccctgacccccagacccatcgacaacttcagccacaaccagagcaacgacccctacagccagccccccctgaccccccaccccgccgtgaacgagagcttcgcccaccccagcagagccttcagccagcccggcaccatcagcagacccaccagccaggacccctacagccagccccccggcacccccagacccgtggtggacagctacagccagagcagcggcaccgccagaagcaacaccgacccctacagccagccccccggcacccccagacccaccaccgtggacccctacagccagcagccccagacccccagacccagcacccagaccgacctgttcgtgacccccgtgaccaaccagagacacagcgacccctacgcccacccccccggcacccccagacccggcatcagcgtgccctacagccagccccccgccacccccagacccagaatcagcgagggcttcaccagaagcagcatgaccagacccgtgctgatgcccaaccaggaccccttcctgcaggccgcccagaacagaggccccgccctgcccggccccctggtgagaccccccgacacctgcagccagacccccagaccccccggccccggcctgagcgacaccttcagcagagtgagccccagcgccgccagagacccctacgaccagagccccatgacccccagaagccagagcgacagcttcggcaccagccagaccgcccacgacgtggccgaccagcccagacccggcagcgagggcagcttctgcgccagcagcaacagccccatgcacagccagggccagcagttcagcggcgtgagccagctgcccggccccgtgcccaccagcggcgtgaccgacacccagaacaccgtgaacatggcccaggccgacaccgagaagctgagacagagacagaagctgagagagatcatcctgcagcagcagcagcagaagaagatcgccggcagacaggagaagggcagccaggacagccccgccgtgccccaccccggccccctgcagcactggcagcccgagaacgtgaaccaggccttcaccagacccccccccccctaccccggcaacatcagaagccccgtggccccccccctgggccccagatacgccgtgttccccaaggaccagagaggcccctacccccccgacgtggccagcatgggcatgagaccccacggcttcagattcggcttccccggcggcagccacggcaccatgcccagccaggagagattcctggtgcccccccagcagatccagggcagcggcgtgagcccccagctgagaagaagcgtgagcgtggacatgcccagacccctgaacaacagccagatgaacaaccccgtgggcctgccccagcacttcagcccccagagcctgcccgtgcagcagcacaacatcctgggccaggcctacatcgagctgagacacagagcccccgacggcagacagagactgcccttcagcgccccccccggcagcgtggtggaggccagcagcaacctgagacacggcaacttcatccccagacccgacttccccggccccagacacaccgaccccatgagaagacccccccagggcctgcccaaccagctgcccgtgcaccccgacctggagcaggtgccccccagccagcaggagcagggccacagcgtgcacagcagcagcatggtgatgagaaccctgaaccaccccctgggcggcgagttcagcgaggcccccctgagcaccagcgtgcccagcgagaccaccagcgacaacctgcagatcaccacccagcccagcgacggcctggaggagaagctggacagcgacgaccccagcgtgaaggagctggacgtgaaggacctggagggcgtggaggtgaaggacctggacgacgaggacctggagaacctgaacctggacaccgaggacggcaaggtggtggagctggacaccctggacaacctggagaccaacgaccccaacctggacgacctgctgagaagcggcgagttcgacatcatcgcctacaccgaccccgagctggacatgggcgacaagaagagcatgttcaacgaggagctggacctgcccatcgacgacaagctggacaaccagtgcgtgagcgtggagcccaagaagaaggagcaggagaacaagaccctggtgctgagcgacaagcacagcccccagaagaagagcaccgtgaccaacgaggtgaagaccgaggtgctgagccccaacagcaaggtggagagcaagtgcgagaccgagaagaacgacgagaacaaggacaacgtggacaccccctgcagccaggccagcgcccacagcgacctgaacgacggcgagaagaccagcctgcacccctgcgaccccgacctgttcgagaagagaaccaacagagagaccgccggccccagcgccaacgtgatccaggccagcacccagctgcccgcccaggacgtgatcaacagctgcggcatcaccggcagcacccccgtgctgagcagcctgctggccaacgagaagagcgacaacagcgacatcagacccagcggcagcccccccccccccaccctgcccgccagccccagcaaccacgtgagcagcctgccccccttcatcgccccccccggcagagtgctggacaacgccatgaacagcaacgtgaccgtggtgagcagagtgaaccacgtgttcagccagggcgtgcaggtgaaccccggcctgatccccggccagagcaccgtgaaccacagcctgggcaccggcaagcccgccacccagaccggcccccagaccagccagagcggcaccagcagcatgagcggcccccagcagctgatgatcccccagaccctggcccagcagaacagagagagacccctgctgctggaggagcagcccctgctgctgcaggacctgctggaccaggagagacaggagcagcagcagcagagacagatgcaggccatgatcagacagagaagcgagcccttcttccccaacatcgacttcgacgccatcaccgaccccatcatgaaggccaagatggtggccctgaagggcatcaacaaggtgatggcccagaacaacctgggcatgccccccatggtgatgagcagattccccttcatgggccaggtggtgaccggcacccagaacagcgagggccagaacctgggcccccaggccatcccccaggacggcagcatcacccaccagatcagcagacccaacccccccaacttcggccccggcttcgtgaacgacagccagagaaagcagtacgaggagtggctgcaggagacccagcagctgctgcagatgcagcagaagtacctggaggagcagatcggcgcccacagaaagagcaagaaggccctgagcgccaagcagagaaccgccaagaaggccggcagagagttccccgaggaggacgccgagcagctgaagcacgtgaccgagcagcagagcatggtgcagaagcagctggagcagatcagaaagcagcagaaggagcacgccgagctgatcgaggactacagaatcaagcagcagcagcagtgcgccatggccccccccaccatgatgcccagcgtgcagccccagccccccctgatccccggcgccaccccccccaccatgagccagcccaccttccccatggtgccccagcagctgcagcaccagcagcacaccaccgtgatcagcggccacaccagccccgtgagaatgcccagcctgcccggctggcagcccaacagcgcccccgcccacctgcccctgaacccccccagaatccagccccccatcgcccagctgcccatcaagacctgcacccccgcccccggcaccgtgagcaacgccaacccccagagcggccccccccccagagtggagttcgacgacaacaaccccttcagcgagagcttccaggagagagagagaaaggagagactgagagagcagcaggagagacagagaatccagctgatgcaggaggtggacagacagagagccctgcagcagagaatggagatggagcagcacggcatggtgggcagcgagatcagcagcagcagaaccagcgtgagccagatccccttctacagcagcgacctgccctgcgacttcatgcagcccctgggccccctgcagcagagcccccagcaccagcagcagatgggccaggtgctgcagcagcagaacatccagcagggcagcatcaacagccccagcacccagaccttcatgcagaccaacgagagaagacaggtgggcccccccagcttcgtgcccgacagccccagcatccccgtgggcagccccaacttcagcagcgtgaagcagggccacggcaacctgagcggcaccagcttccagcagagccccgtgagacccagcttcacccccgccctgcccgccgccccccccgtggccaacagcagcctgccctgcggccaggacagcaccatcacccacggccacagctaccccggcagcacccagagcctgatccagctgtacagcgacatcatccccgaggagaagggcaagaagaagagaaccagaaagaagaagagagacgacgacgccgagagcaccaaggcccccagcaccccccacagcgacatcaccgccccccccacccccggcatcagcgagaccaccagcacccccgccgtgagcacccccagcgagctgccccagcaggccgaccaggagagcgtggagcccgtgggccccagcacccccaacatggccgccggccagctgtgcaccgagctggagaacaagctgcccaacagcgacttcagccaggccacccccaaccagcagacctacgccaacagcgaggtggacaagctgagcatggagacccccgccaagaccgaggagatcaagctggagaaggccgagaccgagagctgccccggccaggaggagcccaagctggaggagcagaacggcagcaaggtggagggcaacgccgtggcctgccccgtgagcagcgcccagagccccccccacagcgccggcgcccccgccgccaagggcgacagcggcaacgagctgctgaagcacctgctgaagaacaagaagagcagcagcctgctgaaccagaagcccgagggcagcatctgcagcgaggacgactgcaccaaggacaacaagctggtggagaagcagaaccccgccgagggcctgcagaccctgggcgcccagatgcagggcggcttcggctgcggcaaccagctgcccaagaccgacggcggcagcgagaccaagaagcagagaagcaagagaacccagagaaccggcgagaaggccgcccccagaagcaagaagagaaagaaggacgaggaggagaagcaggccatgtacagcagcaccgacaccttcacccacctgaagcaggtgagacagctgagcctgctgcccctgatggagcccatcatcggcgtgaacttcgcccacttcctgccctacggcagcggccagttcaacagcggcaacagactgctgggcaccttcggcagcgccaccctggagggcgtgagcgactactacagccagctgatctacaagcagaacaacctgagcaacccccccaccccccccgccagcctgccccccacccccccccccatggcctgccagaagatggccaacggcttcgccaccaccgaggagctggccggcaaggccggcgtgctggtgagccacgaggtgaccaagaccctgggccccaagcccttccagctgcccttcagaccccaggacgacctgctggccagagccctggcccagggccccaagaccgtggacgtgcccgccagcctgcccacccccccccacaacaaccaggaggagctgagaatccaggaccactgcggcgacagagacacccccgacagcttcgtgcccagcagcagccccgagagcgtggtgggcgtggaggtgagcagataccccgacctgagcctggtgaaggaggagccccccgagcccgtgcccagccccatcatccccatcctgcccagcaccgccggcaagagcagcgagagcagaagaaacgacatcaagaccgagcccggcaccctgtacttcgccagccccttcggccccagccccaacggccccagaagcggcctgatcagcgtggccatcaccctgcaccccaccgccgccgagaacatcagcagcgtggtggccgccttcagcgacctgctgcacgtgagaatccccaacagctacgaggtgagcagcgcccccgacgtgcccagcatgggcctggtgagcagccacagaatcaaccccggcctggagtacagacagcacctgctgctgagaggccccccccccggcagcgccaacccccccagactggtgagcagctacagactgaagcagcccaacgtgcccttcccccccaccagcaacggcctgagcggctacaaggacagcagccacggcatcgccgagagcgccgccctgagaccccagtggtgctgccactgcaaggtggtgatcctgggcagcggcgtgagaaagagcttcaaggacctgaccctgctgaacaaggacagcagagagagcaccaagagagtggagaaggacatcgtgttctgcagcaacaactgcttcatcctgtacagcagcaccgcccaggccaagaacagcgagaacaaggagagcatccccagcctgccccagagccccatgagagagacccccagcaaggccttccaccagtacagcaacaacatcagcaccctggacgtgcactgcctgccccagctgcccgagaaggccagcccccccgccagcccccccatcgccttcccccccgccttcgaggccgcccaggtggaggccaagcccgacgagctgaaggtgaccgtgaagctgaagcccagactgagagccgtgcacggcggcttcgaggactgcagacccctgaacaagaagtggagaggcatgaagtggaagaagtggagcatccacatcgtgatccccaagggcaccttcaagcccccctgcgaggacgagatcgacgagttcctgaagaagctgggcaccagcctgaagcccgaccccgtgcccaaggactacagaaagtgctgcttctgccacgaggagggcgacggcctgaccgacggccccgccagactgctgaacctggacctggacctgtgggtgcacctgaactgcgccctgtggagcaccgaggtgtacgagacccaggccggcgccctgatcaacgtggagctggccctgagaagaggcctgcagatgaagtgcgtgttctgccacaagaccggcgccaccagcggctgccacagattcagatgcaccaacatctaccacttcacctgcgccatcaaggcccagtgcatgttcttcaaggacaagaccatgctgtgccccatgcacaagcccaagggcatccacgagcaggagctgagctacttcgccgtgttcagaagagtgtacgtgcagagagacgaggtgagacagatcgccagcatcgtgcagagaggcgagagagaccacaccttcagagtgggcagcctgatcttccacaccatcggccagctgctgccccagcagatgcaggccttccacagccccaaggccctgttccccgtgggctacgaggccagcagactgtactggagcaccagatacgccaacagaagatgcagatacctgtgcagcatcgaggagaaggacggcagacccgtgttcgtgatcagaatcgtggagcagggccacgaggacctggtgctgagcgacatcagccccaagggcgtgtgggacaagatcctggagcccgtggcctgcgtgagaaagaagagcgagatgctgcagctgttccccgcctacctgaagggcgaggacctgttcggcctgaccgtgagcgccgtggccagaatcgccgagagcctgcccggcgtggaggcctgcgagaactacaccttcagatacggcagaaaccccctgatggagctgcccctggccgtgaaccccaccggctgcgccagaagcgagcccaagatgagcgcccacgtgaagagattcgtgctgagaccccacaccctgaacagcaccagcaccagcaagagcttccagagcaccgtgaccggcgagctgaacgccccctacagcaagcagttcgtgcacagcaagagcagccagtacagaaagatgaagaccgagtggaagagcaacgtgtacctggccagaagcagaatccagggcctgggcctgtacgccgccagagacatcgagaagcacaccatggtgatcgagtacatcggcaccatcatcagaaacgaggtggccaacagaaaggagaagctgtacgagagccagaacagaggcgtgtacatgttcagaatggacaacgaccacgtgatcgacgccaccctgaccggcggccccgccagatacatcaaccacagctgcgcccccaactgcgtggccgaggtggtgaccttcgagagaggccacaagatcatcatcagcagcagcagaagaatccagaagggcgaggagctgtgctacgactacaagttcgacttcgaggacgaccagcacaagatcccctgccactgcggcgccgtgaactgcagaaagtggatgaactag

SEQ ID NO: 89859 - DNA, 4575 bp, Artificial Sequence
  Description of Artificial Sequence: Synthetic coding sequence
ctgatgcaggaggtggacagacagagagccctgcagcagagaatggagatggagcagcacggcatggtgggcagcgagatcagcagcagcagaaccagcgtgagccagatccccttctacagcagcgacctgccctgcgacttcatgcagcccctgggccccctgcagcagagcccccagcaccagcagcagatgggccaggtgctgcagcagcagaacatccagcagggcagcatcaacagccccagcacccagaccttcatgcagaccaacgagagaagacaggtgggcccccccagcttcgtgcccgacagccccagcatccccgtgggcagccccaacttcagcagcgtgaagcagggccacggcaacctgagcggcaccagcttccagcagagccccgtgagacccagcttcacccccgccctgcccgccgccccccccgtggccaacagcagcctgccctgcggccaggacagcaccatcacccacggccacagctaccccggcagcacccagagcctgatccagctgtacagcgacatcatccccgaggagaagggcaagaagaagagaaccagaaagaagaagagagacgacgacgccgagagcaccaaggcccccagcaccccccacagcgacatcaccgccccccccacccccggcatcagcgagaccaccagcacccccgccgtgagcacccccagcgagctgccccagcaggccgaccaggagagcgtggagcccgtgggccccagcacccccaacatggccgccggccagctgtgcaccgagctggagaacaagctgcccaacagcgacttcagccaggccacccccaaccagcagacctacgccaacagcgaggtggacaagctgagcatggagacccccgccaagaccgaggagatcaagctggagaaggccgagaccgagagctgccccggccaggaggagcccaagctggaggagcagaacggcagcaaggtggagggcaacgccgtggcctgccccgtgagcagcgcccagagccccccccacagcgccggcgcccccgccgccaagggcgacagcggcaacgagctgctgaagcacctgctgaagaacaagaagagcagcagcctgctgaaccagaagcccgagggcagcatctgcagcgaggacgactgcaccaaggacaacaagctggtggagaagcagaaccccgccgagggcctgcagaccctgggcgcccagatgcagggcggcttcggctgcggcaaccagctgcccaagaccgacggcggcagcgagaccaagaagcagagaagcaagagaacccagagaaccggcgagaaggccgcccccagaagcaagaagagaaagaaggacgaggaggagaagcaggccatgtacagcagcaccgacaccttcacccacctgaagcagcagctgagcctgctgcccctgatggagcccatcatcggcgtgaacttcgcccacttcctgccctacggcagcggccagttcaacagcggcaacagactgctgggcaccttcggcagcgccaccctggagggcgtgagcgactactacagccagctgatctacaagaagatggccaacggcttcgccaccaccgaggagctggccggcaaggccggcgtgctggtgagccacgaggtgaccaagaccctgggccccaagcccttccagctgcccttcagaccccaggacgacctgctggccagagccctggcccagggccccaagaccgtggacgtgcccgccagcctgcccacccccccccacaacaaccaggaggagctgagaatccaggaccactgcggcgacagagacacccccgacagcttcgtgcccagcagcagccccgagagcgtggtgggcgtggaggtgagcagataccccgacctgagcctggtgaaggaggagccccccgagcccgtgcccagccccatcatccccatcctgcccagcaccgccggcaagagcagcgagagcagaagaaacgacatcaagaccgagcccggcaccctgtacttcgccagccccttcggccccagccccaacggccccagaagcggcctgatcagcgtggccatcaccctgcaccccaccgccgccgagaacatcagcagcgtggtggccgccttcagcgacctgctgcacgtgagaatccccaacagctacgaggtgagcagcgcccccgacgtgcccagcatgggcctggtgagcagccacagaatcaaccccggcctggagtacagacagcacctgctgctgagaggccccccccccggcagcgccaacccccccagactggtgagcagctacagactgaagcagcccaacgtgcccttcccccccaccagcaacggcctgagcggctacaaggacagcagccacggcatcgccgagagcgccgccctgagaccccagtggtgctgccactgcaaggtggtgatcctgggcagcggcgtgagaaagagcttcaaggacctgaccctgctgaacaaggacagcagagagagcaccaagagagtggagaaggacatcgtgttctgcagcaacaactgcttcatcctgtacagcagcaccgcccaggccaagaacagcgagaacaaggagagcatccccagcctgccccagagccccatgagagagacccccagcaaggccttccaccagtacagcaacaacatcagcaccctggacgtgcactgcctgccccagctgcccgagaaggccagcccccccgccagcccccccatcgccttcccccccgccttcgaggccgcccaggtggaggccaagcccgacgagctgaaggtgaccgtgaagctgaagcccagactgagagccgtgcacggcggcttcgaggactgcagacccctgaacaagaagtggagaggcatgaagtggaagaagtggagcatccacatcgtgatccccaagggcaccttcaagcccccctgcgaggacgagatcgacgagttcctgaagaagctgggcaccagcctgaagcccgaccccgtgcccaaggactacagaaagtgctgcttctgccacgaggagggcgacggcctgaccgacggccccgccagactgctgaacctggacctggacctgtgggtgcacctgaactgcgccctgtggagcaccgaggtgtacgagacccaggccggcgccctgatcaacgtggagctggccctgagaagaggcctgcagatgaagtgcgtgttctgccacaagaccggcgccaccagcggctgccacagattcagatgcaccaacatctaccacttcacctgcgccatcaaggcccagtgcatgttcttcaaggacaagaccatgctgtgccccatgcacaagcccaagggcatccacgagcaggagctgagctacttcgccgtgttcagaagagtgtacgtgcagagagacgaggtgagacagatcgccagcatcgtgcagagaggcgagagagaccacaccttcagagtgggcagcctgatcttccacaccatcggccagctgctgccccagcagatgcaggccttccacagccccaaggccctgttccccgtgggctacgaggccagcagactgtactggagcaccagatacgccaacagaagatgcagatacctgtgcagcatcgaggagaaggacggcagacccgtgttcgtgatcagaatcgtggagcagggccacgaggacctggtgctgagcgacatcagccccaagggcgtgtgggacaagatcctggagcccgtggcctgcgtgagaaagaagagcgagatgctgcagctgttccccgcctacctgaagggcgaggacctgttcggcctgaccgtgagcgccgtggccagaatcgccgagagcctgcccggcgtggaggcctgcgagaactacaccttcagatacggcagaaaccccctgatggagctgcccctggccgtgaaccccaccggctgcgccagaagcgagcccaagatgagcgcccacgtgaagagaccccacaccctgaacagcaccagcaccagcaagagcttccagagcaccgtgaccggcgagctgaacgccccctacagcaagcagttcgtgcacagcaagagcagccagtacagaaagatgaagaccgagtggaagagcaacgtgtacctggccagaagcagaatccagggcctgggcctgtacgccgccagagacatcgagaagcacaccatggtgatcgagtacatcggcaccatcatcagaaacgaggtggccaacagaaaggagaagctgtacgagagccagaacagaggcgtgtacatgttcagaatggacaacgaccacgtgatcgacgccaccctgaccggcggccccgccagatacatcaaccacagctgcgcccccaactgcgtggccgaggtggtgaccttcgagagaggccacaagatcatcatcagcagcagcagaagaatccagaagggcgaggagctgtgctacgactacaagttcgacttcgaggacgaccagcacaagatcccctgccactgcggcgccgtgaactgcagaaagtggatgaactag

SEQ ID NO: 89860 - DNA, 351 bp, Artificial Sequence
  Description of Artificial Sequence: Synthetic coding sequence
atggtgatcgagtacatcggcaccatcatcagaaacgaggtggccaacagaaaggagaagctgtacgagagccagaacagaggcgtgtacatgttcagaatggacaacgaccacgtgatcgacgccaccctgaccggcggccccgccagatacatcaaccacagctgcgcccccaactgcgtggccgaggtggtgaccttcgagagaggccacaagatcatcatcagcagcagcagaagaatccagaagggcgaggagctgtgctacgactacaagttcgacttcgaggacgaccagcacaagatcccctgccactgcggcgccgtgaactgcagaaagtggatgaactag

SEQ ID NO: 89861 - DNA, 5577 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccccccaccccccccgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagagcggcgagaaggagcagcacatcagcaagtgcaagaaggccttcagagagggcagcagaaagagcagcagagtgaagggcagcgcccccgagatcgaccccagcagcgacggcagcaacttcggctgggagaccaagatcaaggcctggatggacagatacgaggaggccaacaacaaccagtacagcgagggcgtgcagagagaggcccagagaatcgccctgagactgggcaacggcaacgacaagaaggagatgaacaagagcgacctgaacaccaacaacctgctgttcaagccccccgtggagagccacatccagaagaacaagaagatcctgaagagcgccaaggacctgccccccgacgccctgatcatcgagtacagaggcaagttcatgctgagagagcagttcgaggccaacggctacttcttcaagagaccctaccccttcgtgctgttctacagcaagttccacggcctggagatgtgcgtggacgccagaaccttcggcaacgaggccagattcatcagaagaagctgcacccccaacgccgaggtgagacacgagatccaggacggcaccatccacctgtacatctacagcatccacagcatccccaagggcaccgagatcaccatcgccttcgacttcgactacggcaactgcaagtacaaggtggactgcgcctgcctgaaggagaaccccgagtgccccgtgctgaagagaagcagcgagagcatggagaacatcaacagcggctacgagaccagaagaaagaagggcaagaaggacaaggacatcagcaaggagaaggacacccagaaccagaacatcaccctggactgcgagggcaccaccaacaagatgaagagccccgagaccaagcagagaaagctgagccccctgagactgagcgtgagcaacaaccaggagcccgacttcatcgacgacatcgaggagaagacccccatcagcaacgaggtggagatggagagcgaggagcagatcgccgagagaaagagaaagatgaccagagaggagagaaagatggaggccatcctgcaggccttcgccagactggagaagagagagaagagaagagagcaggccctggagagaatcagcaccgccaagaccgaggtgaagaccgagtgcaaggacacccagatcgtgagcgacgccgaggtgatccaggagcaggccaaggaggagaacgccagcaagcccacccccgccaaggtgaacagaaccaagcagagaaagagcttcagcagaagcagaacccacatcggccagcagagaagaagacacagaaccgtgagcatgtgcagcgacatccagcccagcagccccgacatcgaggtgaccagccagcagaacgacatcgagaacaccgtgctgaccatcgagcccgagaccgagaccgccctggccgagatcatcaccgagaccgaggtgcccgccctgaacaagtgccccaccaagtaccccaagaccaagaagcacctggtgaacgagtggctgagcgagaagaacgagaagaccggcaagcccagcgacggcctgagcgagagacccctgagaatcaccaccgaccccgaggtgctggccacccagctgaacagcctgcccggcctgacctacagcccccacgtgtacagcacccccaagcactacatcagattcaccagccccttcctgagcgagaagagaagaagaaaggagcccaccgagaacatcagcggcagctgcaagaagagatggctgaagcaggccctggaggaggagaacagcgccatcctgcacagattcaacagcccctgccaggagagaagcagaagccccgccgtgaacggcgagaacaagagccccctgctgctgaacgacagctgcagcctgcccgacctgaccacccccctgaagaagagaagattctaccagctgctggacagcgtgtacagcgagaccagcacccccacccccagcccctacgccacccccacccacaccgacatcacccccatggaccccagcttcgccaccccccccagaatcaagagcgacgacgagacctgcagaaacggctacaagcccatctacagccccgtgacccccgtgacccccggcacccccggcaacaccatgcacttcgagaacatcagcagccccgagagcagccccgagatcaagagaagaacctacagccaggagggctacgacagaagcagcaccatgctgaccctgggccccttcagaaacagcaacctgaccgagctgggcctgcaggagatcaagaccatcggctacaccagccccagaagcagaaccgaggtgaacagacagtgccccggcgagaaggagcccgtgagcgacctgcagctgggcctggacgccgtggagcccaccgccctgcacaagaccctggagacccccgcccacgacagagccgagcccaacagccagctggacagcacccacagcggcagaggcaccatgtacagcagctgggtgaagagccccgacagaaccggcgtgaacttcagcgtgaacagcaacctgagagacctgacccccagccaccagctggaggtgggcggcggcttcagaatcagcgagagcaagtgcctgatgcaggacgacaccagaggcatgttcatggagaccaccgtgttctgcaccagcgaggacggcctggtgagcggcttcggcagaaccgtgaacgacaacctgatcgacggcaactgcaccccccagaaccccccccagaagaagaaggtgagcctgctggagtacagaaagagacagagagaggccagaaagagcggcagcaagaccgagaacttccccctgatcagcgtgagcccccacgccagcggcagcctgagcaacaacggcgacggctgcgccagcagcaacgacaacggcgagcaggtggaccacaccgccagcctgcccctgcccacccccgccaccgtgtacaacgccaccagcgaggagaccagcaacaactgccccgtgaaggacgccaccgccagcgagaagaacgagcccgaggtgcagtggaccgccagcaccagcgtggagcaggtgagagagagaagctaccagagagccctgctgctgagcgaccacagaaaggacaaggacagcggcggcgagagcccctgcgtgagctgcagccccagccacgtgcagagcagccccagcagccacagcaaccacatcccccagctgcaggccaagggccccgtgcccagcttcagcgagctgatggaggaccccgaccccgagaaccccgagcccaccaccaccaacgagtgccccagccccgacaccagccagaacacctgcaagagcccccccaagatgagcaagcccggcagccccggcagcgtgatccccgcccaggcccacggcaagatcttcaccaagcccgacccccagtgggacagcaccgtgagcgccagcgaggccgagaacggcgtgcacctgaagaccgagctgcagcagaagcagctgagcaacaacaaccaggccctgagcaagaaccaccccccccagacccacgtgagaaacagcagcgagcagctgagccagaagctgcccagcgtgcccaccaagctgcactgcccccccagcccccacctggagaacccccccaagagcagcaccccccacacccccgtgcagcacggctacctgagccccaagccccccagccagcagctgggcagcccctacagaccccaccacagccagagcccccaggtgggcaccccccagagagagccccagagaaacttctaccccgccgcccagaacctgcccgccaacacccagcaggccaccagcggcaccctgttcacccagacccccagcggccagagcagcgccacctacagccagttcaaccagcagagcctgaacagcaccgcccccccccccccccccccccccccccccagcagcagctactaccagaaccagcagcccagcgccaacttccagaactacaaccagctgaagggcagcctgagccagcagaccgtgttcaccagcggccccaaccaggccctgcccggcaccaccagccagcagaccgtgcccggccaccacgtgacccccggccacttcctgcccagccagaaccccaccatccaccaccagaccgccgccgccgtggtgccccccccccccccccccccccccgcccccggcccccacctggtgcagcagcccaacagccaccagcagcacagcgtggcccacgtggtgggccccgtgcacgccgtgacccccggcagccacatccacagccagaccgccggccaccacctgcccccccccccccccccccccggccccgccccccaccaccacccccccccccaccccagcaccggcctgcagggcctgcaggcccagcaccagcacgtggtgaacagcgcccccccccccccccccccccccccccccagcagcgtgctggccagcggccaccacaccaccagcgcccaggccctgcaccaccccccccaccagggcccccccctgttccccagcagcgcccaccccaccgtgcccccctaccccagccaggccacccaccacaccaccctgggccccggcccccagcaccagcccagcggcaccggcccccactgccccctgcccgtgaccggcccccacctgcagccccagggccccaacagcatccccacccccaccgccagcggcttctgcccccaccccggcagcgtggccctgccccacggcgtgcagggcccccagcaggccagccccgtgcccggccagatccccatccacagagcccaggtgccccccaccttccagaacaactaccacggcagcggctggcactag

SEQ ID NO: 89862 - DNA, 5577 bp, Artificial Sequence; identical to SEQ ID NO: 89861
  Description of Artificial Sequence: Synthetic coding sequence

SEQ ID NO: 89863 - DNA, 5451 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccccccaccccccccgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagagcggcgagaaggagcagcacatcagcaagtgcaagaaggccttcagagagggcagcagaaagagcagcagagtgaagggcagcgcccccgagatcgaccccagcagcgacggcagcaacttcggctgggagaccaagatcaaggcctggatggacagatacgaggaggccaacaacaaccagtacagcgagggcgtgcagagagaggcccagagaatcgccctgagactgggcaacggcaacgacaagaaggagatgaacaagagcgacctgaacaccaacaacctgctgttcaagccccccgtggagagccacatccagaagaacaagaagatcctgaagagcgccaaggacctgccccccgacgccctgatcatcgagtacagaggcaagttcatgctgagagagcagttcgaggccaacggctacttcttcaagagaccctaccccttcgtgctgttctacagcaagttccacggcctggagatgtgcgtggacgccagaaccttcggcaacgaggccagattcatcagaagaagctgcacccccaacgccgaggtgagacacgagatccaggacggcaccatccacctgtacatctacagcatccacagcatccccaagggcaccgagatcaccatcgccttcgacttcgactacggcaactgcaagtacaaggtggactgcgcctgcctgaaggagaaccccgagtgccccgtgctgaagagaagcagcgagagcatggagaacatcaacagcggctacgagaccagaagaaagaagggcaagaaggacaaggacatcagcaaggagaaggacacccagaaccagaacatcaccctggactgcgagggcaccaccaacaagatgaagagccccgagaccaagcagagaaagctgagccccctgagactgagcgtgagcaacaaccaggagcccgacttcatcgacgacatcgaggagaagacccccatcagcaacgaggtggagatggagagcgaggagcagatcgccgagagaaagagaaagatgaccagagaggagagaaagatggaggccatcctgcaggccttcgccagactggagaagagagagaagagaagagagcaggccctggagagaatcagcaccgccaagaccgaggtgaagaccgagtgcaaggacacccagatcgtgagcgacgccgaggtgatccaggagcaggccaaggaggagaacgccagcaagcccacccccgccaaggtgaacagaaccaagcagagaaagagcttcagcagaagcagaacccacatcggccagcagagaagaagacacagaaccgtgagcatgtgcagcgacatccagcccagcagccccgacatcgaggtgaccagccagcagaacgacatcgagaacaccgtgctgaccatcgagcccgagaccgagaccgccctggccgagatcatcaccgagaccgaggtgcccgccctgaacaagtgccccaccaagtaccccaagaccaagaagcacctggtgaacgagtggctgagcgagaagaacgagaagaccggcaagcccagcgacggcctgagcgagagacccctgagaatcaccaccgaccccgaggtgctggccacccagctgaacagcctgcccggcctgacctacagcccccacgtgtacagcacccccaagcactacatcagattcaccagccccttcctgagcgagaagagaagaagaaaggagcccaccgagaacatcagcggcagctgcaagaagagatggctgaagcaggccctggaggaggagaacagcgccatcctgcacagattcaacagcccctgccaggagagaagcagaagccccgccgtgaacggcgagaacaagagccccctgctgctgaacgacagctgcagcctgcccgacctgaccacccccctgaagaagagaagattctaccagctgctggacagcgtgtacagcgagaccagcacccccacccccagcccctacgccacccccacccacaccgacatcacccccatggaccccagcttcgccaccccccccagaatcaagagcgacgacgagacctgcagaaacggctacaagcccatctacagccccgtgacccccgtgacccccggcacccccggcaacaccatgcacttcgagaacatcagcagccccgagagcagccccgagatcaagagaagaacctacagccaggagggctacgacagaagcagcaccatgctgaccctgggccccttcagaaacagcaacctgaccgagctgggcctgcaggagatcaagaccatcggctacaccagccccagaagcagaaccgaggtgaacagacagtgccccggcgagaaggagcccgtgagcgacctgcagctgggcctggacgccgtggagcccaccgccctgcacaagaccctggagacccccgcccacgacagagccgagcccaacagccagctggacagcacccacagcggcagaggcaccatgtacagcagctgggtgaagagccccgacagaaccggcgtgaacttcagcgtgaacagcaacctgagagacctgacccccagccaccagctggaggtgggcggcggcttcagaatcagcgagagcaagtgcctgatgcaggacgacaccagaggcatgttcatggagaccaccgtgttctgcaccagcgaggacggcctggtgagcggcttcggcagaaccgtgaacgacaacctgatcgacggcaactgcaccccccagaaccccccccagaagaagaaggtgagcctgctggagtacagaaagagacagagagaggccagaaagagcggcagcaagaccgagaacttccccctgatcagcgtgagcccccacgccagcggcagcctgagcaacaacggcgacggctgcgccagcagcaacgacaacggcgagcaggtggaccacaccgccagcctgcccctgcccacccccgccaccgtgtacaacgccaccagcgaggagaccagcaacaactgccccgtgaaggacgccaccgccagcgagaagaacgagcccgaggtgcagtggaccgccagcaccagcgtggagcaggtgagagagagaagctaccagagagccctgctgctgagcgaccacagaaaggacaaggacagcgaccccgaccccgagaaccccgagcccaccaccaccaacgagtgccccagccccgacaccagccagaacacctgcaagagcccccccaagatgagcaagcccggcagccccggcagcgtgatccccgcccaggcccacggcaagatcttcaccaagcccgacccccagtgggacagcaccgtgagcgccagcgaggccgagaacggcgtgcacctgaagaccgagctgcagcagaagcagctgagcaacaacaaccaggccctgagcaagaaccaccccccccagacccacgtgagaaacagcagcgagcagctgagccagaagctgcccagcgtgcccaccaagctgcactgcccccccagcccccacctggagaacccccccaagagcagcaccccccacacccccgtgcagcacggctacctgagccccaagccccccagccagcagctgggcagcccctacagaccccaccacagccagagcccccaggtgggcaccccccagagagagccccagagaaacttctaccccgccgcccagaacctgcccgccaacacccagcaggccaccagcggcaccctgttcacccagacccccagcggccagagcagcgccacctacagccagttcaaccagcagagcctgaacagcaccgcccccccccccccccccccccccccccccagcagcagctactaccagaaccagcagcccagcgccaacttccagaactacaaccagctgaagggcagcctgagccagcagaccgtgttcaccagcggccccaaccaggccctgcccggcaccaccagccagcagaccgtgcccggccaccacgtgacccccggccacttcctgcccagccagaaccccaccatccaccaccagaccgccgccgccgtggtgccccccccccccccccccccccccgcccccggcccccacctggtgcagcagcccaacagccaccagcagcacagcgtggcccacgtggtgggccccgtgcacgccgtgacccccggcagccacatccacagccagaccgccggccaccacctgcccccccccccccccccccccggccccgccccccaccaccacccccccccccaccccagcaccggcctgcagggcctgcaggcccagcaccagcacgtggtgaacagcgcccccccccccccccccccccccccccccagcagcgtgctggccagcggccaccacaccaccagcgcccaggccctgcaccaccccccccaccagggcccccccctgttccccagcagcgcccaccccaccgtgcccccctaccccagccaggccacccaccacaccaccctgggccccggcccccagcaccagcccagcggcaccggcccccactgccccctgcccgtgaccggcccccacctgcagccccagggccccaacagcatccccacccccaccgccagcggcttctgcccccaccccggcagcgtggccctgccccacggcgtgcagggcccccagcaggccagccccgtgcccggccagatccccatccacagagcccaggtgccccccaccttccagaacaactaccacggcagcggctggcactag

SEQ ID NO: 89864 - DNA, 1770 bp, Artificial Sequence
  Description of Artificial Sequence: Synthetic coding sequence
atgcacttcgagaacatcagcagccccgagagcagccccgagatcaagagaagaacctacagccaggagggctacgacagaagcagcaccatgctgaccctgggccccttcagaaacagcaacctgaccgagctgggcctgcaggagatcaagaccatcggctacaccagccccagaagcagaaccgaggtgaacagacagtgccccggcgagaaggagcccgtgagcgacctgcagctgggcctggacgccgtggagcccaccgccctgcacaagaccctggagacccccgcccacgacagagccgagcccaacagccagctggacagcacccacagcggcagaggcaccatgtacagcagctgggtgaagagccccgacagaaccggcgtgaacttcagcgtgaacagcaacctgagagacctgacccccagccaccagctggaggtgggcggcggcttcagaatcagcgagagcaagtgcctgatgcaggacgacaccagaggcatgttcatggagaccaccgtgttctgcaccagcgaggacggcctggtgagcggcttcggcagaaccgtgaacgacaacctgatcgacggcaactgcaccccccagaaccccccccagaagaagaaggtgagcctgctggagtacagaaagagacagagagaggccagaaagagcggcagcaagaccgagaacttccccctgatcagcgtgagcccccacgccagcggcagcctgagcaacaacggcgacggctgcgccagcagcaacgacaacggcgagcaggtggaccacaccgccagcctgcccctgcccacccccgccaccgtgtacaacgccaccagcgaggagaccagcaacaactgccccgtgaaggacgccaccgccagcgagaagaacgagcccgaggtgcagtggaccgccagcaccagcgtggagcaggtgagagagagaagctaccagagagccctgctgctgagcgaccacagaaaggacaaggacagcggcggcgagagcccctgcgtgagctgcagccccagccacgtgcagagcagccccagcagccacagcaaccacatcccccagctgcaggccaagggccccgtgcccagcttcagcgagctgatggaggaccccgaccccgagaaccccgagcccaccaccaccaacgagtgccccagccccgacaccagccagaacacctgcaagagcccccccaagatgagcaagcccggcagccccggcagcgtgatccccgcccaggcccacggcaagatcttcaccaagcccgacccccagtgggacagcaccgtgagcgccagcgaggccgagaacggcgtgcacctgaagaccgagctgcagcagaagcagctgagcaacaacaaccaggccctgagcaagaaccaccccccccagacccacgtgagaaacagcagcgagcagctgagccagaagctgcccagcgtgcccaccaagctgcactgcccccccagcccccacctggagaacccccccaagagcagcaccccccacacccccgtgcagcacggctacctgagccccaagccccccagccagcagctgggcagcccctacagaccccaccacagccagagcccccaggtgggcaccccccagagagagccccagagaaacttctaccccgccgcccagaacctgcccgccaacacccagcaggccaccagcggcaccctgttcacccagacccccagcggccagagcagcgccacctacacccagagatag

SEQ ID NO: 89865 - DNA, 5337 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccccccaccccccccgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagagcggcgagaaggagcagcacatcagcaagtgcaagaaggccttcagagagggcagcagaaagagcagcagagtgaagggcagcgcccccgagatcgaccccagcagcgacggcagcaacttcggctgggagaccaagatcaaggcctggatggacagatacgaggaggccaacaacaaccagtacagcgagggcgtgcagagagaggcccagagaatcgccctgagactgggcaacggcaacgacaagaaggagatgaacaagagcgacctgaacaccaacaacctgctgttcaagccccccgtggagagccacatccagaagaacaagaagatcctgaagagcgccaaggacctgccccccgacgccctgatcatcgagtacagaggcaagttcatgctgagagagcagttcgaggccaacggctacttcttcaagagaccctaccccttcgtgctgttctacagcaagttccacggcctggagatgtgcgtggacgccagaaccttcggcaacgaggccagattcatcagaagaagctgcacccccaacgccgaggtgagacacgagatccaggacggcaccatccacctgtacatctacagcatccacagcatccccaagggcaccgagatcaccatcgccttcgacttcgactacggcaactgcaagtacaaggtggactgcgcctgcctgaaggagaaccccgagtgccccgtgctgaagagaagcagcgagagcatggagaacatcaacagcggctacgagaccagaagaaagaagggcaagaagaccagagaggagagaaagatggaggccatcctgcaggccttcgccagactggagaagagagagaagagaagagagcaggccctggagagaatcagcaccgccaagaccgaggtgaagaccgagtgcaaggacacccagatcgtgagcgacgccgaggtgatccaggagcaggccaaggaggagaacgccagcaagcccacccccgccaaggtgaacagaaccaagcagagaaagagcttcagcagaagcagaacccacatcggccagcagagaagaagacacagaaccgtgagcatgtgcagcgacatccagcccagcagccccgacatcgaggtgaccagccagcagaacgacatcgagaacaccgtgctgaccatcgagcccgagaccgagaccgccctggccgagatcatcaccgagaccgaggtgcccgccctgaacaagtgccccaccaagtaccccaagaccaagaagcacctggtgaacgagtggctgagcgagaagaacgagaagaccggcaagcccagcgacggcctgagcgagagacccctgagaatcaccaccgaccccgaggtgctggccacccagctgaacagcctgcccggcctgacctacagcccccacgtgtacagcacccccaagcactacatcagattcaccagccccttcctgagcgagaagagaagaagaaaggagcccaccgagaacatcagcggcagctgcaagaagagatggctgaagcaggccctggaggaggagaacagcgccatcctgcacagattcaacagcccctgccaggagagaagcagaagccccgccgtgaacggcgagaacaagagccccctgctgctgaacgacagctgcagcctgcccgacctgaccacccccctgaagaagagaagattctaccagctgctggacagcgtgtacagcgagaccagcacccccacccccagcccctacgccacccccacccacaccgacatcacccccatggaccccagcttcgccaccccccccagaatcaagagcgacgacgagacctgcagaaacggctacaagcccatctacagccccgtgacccccgtgacccccggcacccccggcaacaccatgcacttcgagaacatcagcagccccgagagcagccccgagatcaagagaagaacctacagccaggagggctacgacagaagcagcaccatgctgaccctgggccccttcagaaacagcaacctgaccgagctgggcctgcaggagatcaagaccatcggctacaccagccccagaagcagaaccgaggtgaacagacagtgccccggcgagaaggagcccgtgagcgacctgcagctgggcctggacgccgtggagcccaccgccctgcacaagaccctggagacccccgcccacgacagagccgagcccaacagccagctggacagcacccacagcggcagaggcaccatgtacagcagctgggtgaagagccccgacagaaccggcgtgaacttcagcgtgaacagcaacctgagagacctgacccccagccaccagctggaggtgggcggcggcttcagaatcagcgagagcaagtgcctgatgcaggacgacaccagaggcatgttcatggagaccaccgtgttctgcaccagcgaggacggcctggtgagcggcttcggcagaaccgtgaacgacaacctgatcgacggcaactgcaccccccagaaccccccccagaagaagaaggtgagcctgctggagtacagaaagagacagagagaggccagaaagagcggcagcaagaccgagaacttccccctgatcagcgtgagcccccacgccagcggcagcctgagcaacaacggcgacggctgcgccagcagcaacgacaacggcgagcaggtggaccacaccgccagcctgcccctgcccacccccgccaccgtgtacaacgccaccagcgaggagaccagcaacaactgccccgtgaaggacgccaccgccagcgagaagaacgagcccgaggtgcagtggaccgccagcaccagcgtggagcaggtgagagagagaagctaccagagagccctgctgctgagcgaccacagaaaggacaaggacagcggcggcgagagcccctgcgtgagctgcagccccagccacgtgcagagcagccccagcagccacagcaaccacatcccccagctgcaggccaagggccccgtgcccagcttcagcgagctgatggaggaccccgaccccgagaaccccgagcccaccaccaccaacgagtgccccagccccgacaccagccagaacacctgcaagagcccccccaagatgagcaagcccggcagccccggcagcgtgatccccgcccaggcccacggcaagatcttcaccaagcccgacccccagtgggacagcaccgtgagcgccagcgaggccgagaacggcgtgcacctgaagaccgagctgcagcagaagcagctgagcaacaacaaccaggccctgagcaagaaccaccccccccagacccacgtgagaaacagcagcgagcagctgagccagaagctgcccagcgtgcccaccaagctgcactgcccccccagcccccacctggagaacccccccaagagcagcaccccccacacccccgtgcagcacggctacctgagccccaagccccccagccagcagctgggcagcccctacagaccccaccacagccagagcccccaggtgggcaccccccagagagagccccagagaaacttctaccccgccgcccagaacctgcccgccaacacccagcaggccaccagcggcaccctgttcacccagacccccagcggccagagcagcgccacctacagccagttcaaccagcagagcctgaacagcaccgcccccccccccccccccccccccccccccagcagcagctactaccagaaccagcagcccagcgccaacttccagaactacaaccagctgaagggcagcctgagccagcagaccgtgttcaccagcggccccaaccaggccctgcccggcaccaccagccagcagaccgtgcccggccaccacgtgacccccggccacttcctgcccagccagaaccccaccatccaccaccagaccgccgccgccgtggtgccccccccccccccccccccccccgcccccggcccccacctggtgcagcagcccaacagccaccagcagcacagcgtggcccacgtggtgggccccgtgcacgccgtgacccccggcagccacatccacagccagaccgccggccaccacctgcccccccccccccccccccccggccccgccccccaccaccacccccccccccaccccagcaccggcctgcagggcctgcaggcccagcaccagcacgtggtgaacagcgcccccccccccccccccccccccccccccagcagcgtgctggccagcggccaccacaccaccagcgcccaggccctgcaccaccccccccaccagggcccccccctgttccccagcagcgcccaccccaccgtgcccccctaccccagccaggccacccaccacaccaccctgggccccggcccccagcaccagcccagcggcaccggcccccactgccccctgcccgtgaccggcccccacctgcagccccagggccccaacagcatccccacccccaccgccagcggcttctgcccccaccccggcagcgtggccctgccccacggcgtgcagggcccccagcaggccagccccgtgcccggccagatccccatccacagagcccaggtgccccccaccttccagaacaactaccacggcagcggctggcactag

SEQ ID NO: 89866 - DNA, 4962 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccccccaccccccccgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagagcggcgagaaggagcagcacatcagcaagtgcaagaaggccttcagagagggcagcagaaagagcagcagagtgaagggcagcgcccccgagatcgaccccagcagcgacggcagcaacttcggctgggagaccaagatcaaggcctggatggacagatacgaggaggccaacaacaaccagtacagcgagggcgtgcagagagaggcccagagaatcgccctgagactgggcaacggcaacgacaagaaggagatgaacaagagcgacctgaacaccaacaacctgctgttcaagccccccgtggagagccacatccagaagaacaagaagatcctgaagagcgccaaggacctgccccccgacgccctgatcatcgagtacagaggcaagttcatgctgagagagcagttcgaggccaacggctacttcttcaagagaccctaccccttcgtgctgttctacagcaagttccacggcctggagatgtgcgtggacgccagaaccttcggcaacgaggccagattcatcagaagaagctgcacccccaacgccgaggtgagacacgagatccaggacggcaccatccacctgtacatctacagcatccacagcatccccaagggcaccgagatcaccatcgccttcgacttcgactacggcaactgcaagtacaaggtggactgcgcctgcctgaaggagaaccccgagtgccccgtgctgaagagaagcagcgagagcatggagaacatcaacagcggctacgagaccagaagaaagaagggcaagaaggacaaggacatcagcaaggagaaggacacccagaaccagaacatcaccctggactgcgagggcaccaccaacaagatgaagagccccgagaccaagcagagaaagctgagccccctgagactgagcgtgagcaacaaccaggagcccgacttcatcgacgacatcgaggagaagacccccatcagcaacgaggtggagatggagagcgaggagcagatcgccgagagaaagagaaagatgaccagagaggagagaaagatggaggccatcctgcaggccttcgccagactggagaagagagagaagagaagagagcaggccctggagagaatcagcaccgccaagaccgaggtgaagaccgagtgcaaggacacccagatcgtgagcgacgccgaggtgatccaggagcaggccaaggaggagaacgccagcaagcccacccccgccaaggtgaacagaaccaagcagagaaagagcttcagcagaagcagaacccacatcggccagcagagaagaagacacagaaccgtgagcatgtgcagcgacatccagcccagcagccccgacatcgaggtgaccagccagcagaacgacatcgagaacaccgtgctgaccatcgagcccgagaccgagaccgccctggccgagatcatcaccgagaccgaggtgcccgccctgaacaagtgccccaccaagtaccccaagaccaagaagcacctggtgaacgagtggctgagcgagaagaacgagaagaccggcaagcccagcgacggcctgagcgagagacccctgagaatcaccaccgaccccgaggtgctggccacccagctgaacagcctgcccggcctgacctacagcccccacgtgtacagcacccccaagcactacatcagattcaccagccccttcctgagcgagaagagaagaagaaaggagcccaccgagaacatcagcggcagctgcaagaagagatggctgaagcaggccctggaggaggagaacagcgccatcctgcacagattcaacagcccctgccaggagagaagcagaagccccgccgtgaacggcgagaacaagagccccctgctgctgaacgacagctgcagcctgcccgacctgaccacccccctgaagaagagaagattctaccagctgctggacagcgtgtacagcgagaccagcacccccacccccagcccctacgccacccccacccacaccgacatcacccccatggaccccagcttcgccaccccccccagaatcaagagcgacgacgagacctgcagaaacggctacaagcccatctacagccccgtgacccccgtgacccccggcacccccggcaacaccatgcacttcgagaacatcagcagccccgagagcagccccgagatcaagagaagaacctacagccaggagggctacgacagaagcagcaccatgctgaccctgggccccttcagaaacagcaacctgaccgagctgggcctgcaggagatcaagaccatcggctacaccagccccagaagcagaaccgaggtgaacagacagtgccccggcgagaaggagcccgtgagcgacctgcagctgggcctggacgccgtggagcccaccgccctgcacaagaccctggagacccccgcccacgacagagccgagcccaacagccagctggacagcacccacagcggcagaggcaccatgtacagcagctgggtgaagagccccgacagaaccggcgtgaacttcagcgtgaacagcaacctgagagacctgacccccagccaccagctggaggtgggcggcggcttcagaatcagcgagagcaagtgcctgatgcaggacgacaccagaggcatgttcatggagaccaccgtgttctgcaccagcgaggacggcctggtgagcggcttcggcagaaccgtgaacgacaacctgatcgacggcaactgcaccccccagaaccccccccagaagaagaaggtgagcctgctggagtacagaaagagacagagagaggccagaaagagcggcagcaagaccgagaacttccccctgatcagcgtgagcccccacgccagcggcagcctgagcaacaacggcgacggctgcgccagcagcaacgacaacggcgagcaggtggaccacaccgccagcctgcccctgcccacccccgccaccgtgtacaacgccaccagcgaggagaccagcaacaactgccccgtgaaggacgccaccgccagcgagaagaacgagcccgaggtgcagtggaccgccagcaccagcgtggagcaggtgagagagagaagctaccagagagccctgctgctgagcgaccacagaaaggacaaggacagcggcggcgagagcccctgcgtgagctgcagccccagccacgtgcagagcagccccagcagccacagcaaccacatcccccagctgcaggccaagggccccgtgcccagcttcagcgagctgatggaggaccccgaccccgagaaccccgagcccaccaccaccaacgagtgccccagccccgacaccagccagaacacctgcaagagcccccccaagatgagcaagcccggcagccccggcagcgtgatccccgcccaggcccacggcaagatcttcaccaagcccgacccccagtgggacagcaccgtgagcgccagcgaggccgagaacggcgtgcacctgaagaccgagctgcagcagaagcagctgagcaacaacaaccaggccctgagcaagaaccaccccccccagacccacgtgagaaacagcagcgagcagctgagccagaagctgcccagcgtgcccaccaagctgcactgcccccccagcccccacctggagaacccccccaagagcagcaccccccacacccccgtgcagcacggctacctgagccccaagccccccagccagcagctgggcagcccctacagaccccaccacagccagagcccccaggtgggcaccccccagagagagccccagagaaacttctaccccgccgcccagaacctgcccgtgttctggctgctgggcatcatcccccaccagctgaagccctacaccacccacctgatcaaggacctgcacttcttcctgagagtgctgatccagctgtaccacagaatcccccacaagctgcacatcatccccctgtgggacagagaccccagcaccagcctgctggagcagggccacatcgtgcactacctgagccaggtgctgatcagcagccccaaggaccagaccgtgttccagcacctgctgctgcagggcagcgtgctgatcctggccctgtggccctgccacatgggcttcaaggacctgagcagacacctgcagtgcctggacagattccagttcaccgagcacagatgccaccagcacttcaagaccatcaccatgggccagggcggcatcaagatggacagcaagaacatcttcctgaacgtgctgtag

SEQ ID NO: 89867 - DNA, 378 bp, Artificial Sequence
  Description of Artificial Sequence: Synthetic coding sequence
tgaggcagcctgagcaacaacggcgacggctgcgccagcagcaacgacaacggcgagcaggtggaccacaccgccagcctgcccctgcccacccccgccaccgtgtacaacgccaccagcgaggagaccagcaacaactgccccgtgaaggacgccaccgccagcgagaagaacgagcccgaggtgcagtggaccgccagcaccagcgtggagcaggtgagagagagaagctaccagagagccctgctgctgagcgaccacagaaaggacaaggacagcgaccccgaccccgagaaccccgagcccaccaccaccaacgagtgccccagccccgacaccagccagaacacctgcaagagcccccccaagatgagctag

SEQ ID NO: 89868 - DNA, 216 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccctag

SEQ ID NO: 89869 - DNA, 1830 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccccccaccccccccgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagagcggcgagaaggagcagcacatcagcaagtgcaagaaggccttcagagagggcagcagaaagagcagcagagtgaagggcagcgcccccgagatcgaccccagcagcgacggcagcaacttcggctgggagaccaagatcaaggcctggatggacagatacgaggaggccaacaacaaccagtacagcgagggcgtgcagagagaggcccagagaatcgccctgagactgggcaacggcaacgacaagaaggagatgaacaagagcgacctgaacaccaacaacctgctgttcaagccccccgtggagagccacatccagaagaacaagaagatcctgaagagcgccaaggacctgccccccgacgccctgatcatcgagtacagaggcaagttcatgctgagagagcagttcgaggccaacggctacttcttcaagagaccctaccccttcgtgctgttctacagcaagttccacggcctggagatgtgcgtggacgccagaaccttcggcaacgaggccagattcatcagaagaagctgcacccccaacgccgaggtgagacacgagatccaggacggcaccatccacctgtacatctacagcatccacagcatccccaagggcaccgagatcaccatcgccttcgacttcgactacggcaactgcaagtacaaggtggactgcgcctgcctgaaggagaaccccgagtgccccgtgctgaagagaagcagcgagagcatggagaacatcaacagcggctacgagaccagaagaaagaagggcaagaaggacaaggacatcagcaaggagaaggacacccagaaccagaacatcaccctggactgcgagggcaccaccaacaagatgaagagccccgagaccaagcagagaaagctgagccccctgagactgagcgtgagcaacaaccaggagcccgacttcatcgacgacatcgaggagaagacccccatcagcaacgaggtggagatggagagcgaggagcagatcgccgagagaaagagaaagatggtgagctgggaggccagcagcctgggcctggtgaccgccgccctgcacatggtgatcgtggccgccttcacctgggccttcaccctgttcttcgaggtgagcgagtag

SEQ ID NO: 89870 - DNA, 693 bp, Artificial Sequence
  Description of Artificial Sequence: Synthetic coding sequence
atgagcatcgtgatccccctgggcgtggacaccgccgagaccagctacctggagatggccgccggcagcgagcccgagagcgtggaggccagccccgtggtggtggagaagagcaacagctacccccaccagctgtacaccagcagcagccaccacagccacagctacatcggcctgccctacgccgaccacaactacggcgccagacccccccccaccccccccgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagtag

SEQ ID NO: 89871 - DNA, 1362 bp, Artificial Sequence
  Description of Artificial Sequence: Synthetic coding sequence
atggtgctggtgctgagcgacaccagcgccagccccccccccagcgtgctgatcagcaagaacgaggtgggcatcttcaccacccccaacttcgacgagaccagcagcgccaccaccatcagcaccagcgaggacggcagctacggcaccgacgtgaccagatgcatctgcggcttcacccacgacgacggctacatgatctgctgcgacaagtgcagcgtgtggcagcacatcgactgcatgggcatcgacagacagcacatccccgacacctacctgtgcgagagatgccagcccagaaacctggacaaggagagagccgtgctgctgcagagaagaaagagagagaacatgagcgacggcgacaccagcgccaccgagagcggcgacgaggtgcccgtggagctgtacaccgccttccagcacacccccaccagcatcaccctgaccgccagcagagtgagcaaggtgaacgacaagagaagaaagaagagcggcgagaaggagcagcacatcagcaagtgcaagaaggccttcagagagggcagcagaaagagcagcagagtgaagggcagcgcccccgagatcgaccccagcagcgacggcagcaacttcggctgggagaccaagatcaaggcctggatggacagatacgaggaggccaacaacaaccagtacagcgagggcgtgcagagagaggcccagagaatcgccctgagactgggcaacggcaacgacaagaaggagatgaacaagagcgacctgaacaccaacaacctgctgttcaagccccccgtggagagccacatccagaagaacaagaagatcctgaagagcgccaaggacctgccccccgacgccctgatcatcgagtacagaggcaagttcatgctgagagagcagttcgaggccaacggctacttcttcaagagaccctaccccttcgtgctgttctacagcaagttccacggcctggagatgtgcgtggacgccagaaccttcggcaacgaggccagattcatcagaagaagctgcacccccaacgccgaggtgagacacgagatccaggacggcaccatccacctgtacatctacagcatccacagcatccccaagggcaccgagatcaccatcgccttcgacttcgactacggcaactgcaagtacaaggtggactgcgcctgcctgaaggagaaccccgagtgccccgtgctgaagagaagcagcgagagcatggagaacatcaacagcggctacgagaccagaagaaagaagggcaagaagaccaagatcttccagaagaagaagatccacaagatcagaatcctgctgtggatcgtgaaggagagacccaccaagtag

SEQ ID NO: 89872 - DNA, 969 bp, Artificial Sequence
  Description of Artificial Sequence: Synthetic coding sequence
atgcccgtgaccgtgaccagaaccaccatcaccaccaccaccaccagcagcagcggcctgggcagccccatgatcgtgggcagccccagagccctgacccagcccctgggcctgctgagactgctgcagctggtgagcacctgcgtggccttcagcctggtggccagcgtgggcgcctggaccggcagcatgggcaactggagcatgttcacctggtgcttctgcttcagcgtgaccctgatcatcctgatcgtggagctgtgcggcctgcaggccagattccccctgagctggagaaacttccccatcaccttcgcctgctacgccgccctgttctgcctgagcgccagcatcatctaccccaccacctacgtgcagttcctgagccacggcagaagcagagaccacgccatcgccgccaccttcttcagctgcatcgcctgcgtggcctacgccaccgaggtggcctggaccagagccagacccggcgagatcaccggctacatggccaccgtgcccggcctgctgaaggtgctggagaccttcgtggcctgcatcatcttcgccttcatcagcgaccccaacctgtaccagcaccagcccgccctggagtggtgcgtggccgtgtacgccatctgcttcatcctggccgccatcgccatcctgctgaacctgggcgagtgcaccaacgtgctgcccatccccttccccagcttcctgagcggcctggccctgctgagcgtgctgctgtacgccaccgccctggtgctgtggcccctgtaccagttcgacgagaagtacggcggccagcccagaagaagcagagacgtgagctgcagcagaagccacgcctactacgtgtgcgcctgggacagaagactggccgtggccatcctgaccgccatcaacctgctggcctacgtggccgacctggtgcacagcgcccacctggtgttcgtgaaggtgtag

SEQ ID NO: 89873 - DNA, 969 bp, Artificial Sequence; identical to SEQ ID NO: 89872
  Description of Artificial Sequence: Synthetic coding sequence

SEQ ID NO: 89874 - DNA, 969 bp, Artificial Sequence; identical to SEQ ID NO: 89872
  Description of Artificial Sequence: Synthetic coding sequence

SEQ ID NO: 89875 - DNA, 969 bp, Artificial Sequence; identical to SEQ ID NO: 89872
  Description of Artificial Sequence: Synthetic coding sequence

SEQ ID NO: 89876 - DNA, 969 bp, Artificial Sequence; identical to SEQ ID NO: 89872
  Description of Artificial Sequence: Synthetic coding sequence

SEQ ID NO: 89877 - DNA, 444 bp, Artificial Sequence
  Description of Artificial Sequence: Synthetic coding sequence
atgcccgtgaccgtgaccagaaccaccatcaccaccaccaccaccagcagcagcggcctgggcagccccatgatcgtgggcagccccagagccctgacccagcccctgggcctgctgagactgctgcagctggtgagcacctgcgtggccttcagcctggtggccagcgtgggcgcctggaccggcagcatgggcaactggagcatgttcacctggtgcttctgcttcagcgtgaccctgatcatcctgatcgtggagctgtgcggcctgcaggccagattccccctgagctggagaaacttccccatcaccttcgcctgctacgccgccctgttctgcctgagcgccagcatcatctaccccaccacctacgtgcagttcctgagccacggcagaagcagagaccacgccatcgccgccaccttcttcagctgcatcgcctag

SEQ ID NO: 89878 - DNA, 858 bp, Artificial Sequence
  Description of Artificial Sequence: Synthetic coding sequence
atgcccgtgaccgtgaccagaaccaccatcaccaccaccaccaccagcagcagcggcctgggcagccccatgatcgtgggcagccccagagccctgacccagcccctgggcctgctgagactgctgcagctggtgagcacctgcgtggccttcagcctggtggccagcgtgggcgcctggaccggcagcatgggcaactggagcatgttcacctggtgcttctgcttcagcgtgaccctgatcatcctgatcgtggagctgtgcggcctgcaggccagattccccctgagctggagaaacttccccatcaccttcttcagctgcatcgcctgcgtggcctacgccaccgaggtggcctggaccagagccagacccggcgagatcaccggctacatggccaccgtgcccggcctgctgaaggtgctggagaccttcgtggcctgcatcatcttcgccttcatcagcgaccccaacctgtaccagcaccagcccgccctggagtggtgcgtggccgtgtacgccatctgcttcatcctggccgccatcgccatcctgctgaacctgggcgagtgcaccaacgtgctgcccatccccttccccagcttcctgagcggcctggccctgctgagcgtgctgctgtacgccaccgccctggtgctgtggcccctgtaccagttcgacgagaagtacggcggccagcccagaagaagcagagacgtgagctgcagcagaagccacgcctactacgtgtgcgcctgggacagaagactggccgtggccatcctgaccgccatcaacctgctggcctacgtggccgacctggtgcacagcgcccacctggtgttcgtgaaggtgtag

SEQ ID NO: 89879 - DNA, 729 bp, Artificial Sequence
  Description of Artificial Sequence: Synthetic coding sequence
atgcccgtgaccgtgaccagaaccaccatcaccaccaccaccaccagcagcagcggcctgggcagccccatgatcgtgggcagccccagagccctgacccagcccctgggcctgctgagactgctgcagctggtgagcacctgcgtggccttcagcctggtggccagcgtgggcgcctggaccggcagcatgggcaactggagcatgttcacctggtgcttctgcttcagcgtgaccctgatcatcctgatcgtggagctgtgcggcctgcaggccagattccccctgagctggagaaacttccccatcaccttcgcctgctacgccgccctgttctgcctgagcgccagcatcatctaccccaccacctacgtgcagttcctgagccacggcagaagcagagaccacgccatcgccgccaccttcttcagctgcatcgcctgcgtggcctacgccaccgaggtggcctggaccagagccagacccggcgagatcaccggctacatggccaccgtgcccggcctgctgaaggtgctggagaccttcgtggcctgcatcatcttcgccttcatcagcgaccccaacctgtaccagcaccagcccgccctggagtggtgcgtggccgtgtacgccatctgcttcatcctggccgccatcgccatcctgctgaacctgggcgagtgcaccaacgtgctgcccatccccttccccagcttcctgagcggctag

SEQ ID NO: 89880 - DNA, 780 bp, Artificial Sequence
  Description of Artificial Sequence: Synthetic coding sequence
atgcccgtgaccgtgaccagaaccaccatcaccaccaccaccaccagcagcagcggcctgggcagccccatgatcgtgggcagccccagagccctgacccagcccctgggcctgctgagactgctgcagctggtgagcacctgcgtggccttcagcctggtggccagcgtgggcgcctggaccggcagcatgggcaactggagcatgttcacctggtgcttctgcttcagcgtgaccctgatcatcctgatcgtggagctgtgcggcctgcaggccagattccccctgagctggagaaacttccccatcaccttcgcctgctacgccgccctgttctgcctgagcgccagcatcatctaccccaccacctacgtgcagttcctgagccacggcagaagcagagaccacgccatcgccgccaccttcttcagctgcatcgcctgcgtggcctacgccaccgaggtggcctggaccagagccagacccggcgagatcaccggctacatggccaccgtgcccggcctgctgaaggtgctggagaccttcgtggcctgcatcatcttcgccttcatcagcgaccccaacctgtaccagcaccagcccgccctggagtggtgcgtggccgtgtacgccatctgcttcatcctggccgccatcgccatcctgctgaacctgggcgagtgcaccaacgtgctgcccatccccttccccagcttcctgagcggcctggccctgctgagcgtgctgctgtacgccaccgccctggtgctgtggccctag

SEQ ID NO: 89881 - DNA, 567 bp, Artificial Sequence
  Description of Artificial Sequence: Synthetic coding sequence
atgcccgtgaccgtgaccagaaccaccatcaccaccaccaccaccagcagcagcggcctgggcagccccatgatcgtgggcagccccagagccctgacccagcccctgggcctgctgagactgctgcagctggtgagcacctgcgtggccttcagcctggtggccagcgtgggcgcctggaccggcagcatgggcaactggagcatgttcacctggtgcttctgcttcagcgtgaccctgatcatcctgatcgtggagctgtgcggcctgcaggccagattccccctgagctggagaaacttccccatcaccttcgcctgctacgccgccctgttctgcctgagcgccagcatcatctaccccaccacctacgtgcagttcctgagccacggcagaagcagagaccacgccatcgccgccaccttcttcagctgcatcgcctgcgtggcctacgccaccgaggtggcctggaccagagccagacccggcgagatcaccggctacatggccaccgtgcccggcctgctgaaggtgctggagaccttcgtggcctgcatcatcttctag

SEQ ID NO: 89882 - DNA, 942 bp, Artificial Sequence
  Description of Artificial Sequence: Synthetic coding sequence
atggccctgagaatctgcgtgacctacacccccgccctgcccatcggcctgtgcaccagatgctgcctgtgcctggagcagagccccagctggtgccactgcctgagaggcgtgagcttcctgaccttccacctgcaccagagcgtgcccctgggcgacagagacagcctgctgatgttcaccagacaggccggccacttcgtggagggcagcaaggccggcagaagcagaggcagactgtgcctgagccaggccctgagagtggccgtgagaggcgccttcgtgagcctgtggttcgccgccggcgccggcgacagagagagaaacaagggcgacaagggcgcccagaccggcgccggcctgagccaggaggccgaggacgtggacgtgagcagagccagaagagtgaccgacgccccccagggcaccctgtgcggcaccggcaacagaaacagcggcagccagagcgccagagtggtgggcgtggcccacctgggcgaggccttcagagtgggcgtggagcaggccatcagcagctgccccgaggaggtgcacggcagacacggcctgagcatggagatcatgtgggccagaatggacgtggccctgagaagccccggcagaggcctgctggccggcgccggcgccctgtgcatgaccctggccgagagcagctgccccgactacgagagaggcagaagagcctgcctgaccctgcacagacaccccaccccccactgcagcacctggggcctgcccctgagagtggccggcagctggctgaccgtggtgaccgtggaggccctgggcggctggagaatgggcgtgagaagaaccggccaggtgggccccaccatgcaccccccccccgtgagcggcgccagccccctgctgctgcaccacctgctgctgctgctgctgatcatcatcctgacctgctag

SEQ ID NO: 89883 - DNA, 942 bp, Artificial Sequence; identical to SEQ ID NO: 89882
  Description of Artificial Sequence: Synthetic coding sequence

SEQ ID NO: 89884 - DNA, 279 bp, Artificial Sequence
  Description of Artificial Sequence: Synthetic coding sequence
atgcaggtgagcaccgccgccctggccgtgctgctgtgcaccatggccctgtgcaaccagttcagcgccagcctggccgccgacacccccaccgcctgctgcttcagctacaccagcagacagatcccccagaacttcatcgccgactacttcgagaccagcagccagtgcagcaagcccggcgtgatcttcctgaccaagagaagcagacaggtgtgcgccgaccccagcgaggagtgggtgcagaagtacgtgagcgacctggagctgagcgcctag

SEQ ID NO: 89885 - DNA, 2334 bp, Artificial Sequence
  Description of Artificial Sequence: Synthetic coding sequence
atgggcgtgcccttcttcagcagcctgagatgcatggtggacctgggcccctgctgggccggcggcctgaccgccgagatgaagctgctgctggccctggccggcctgctggccatcctggccaccccccagcccagcgagggcgccgcccccgccgtgctgggcgaggtggacaccagcctggtgctgagcagcatggaggaggccaagcagctggtggacaaggcctacaaggagagaagagagagcatcaagcagagactgagaagcggcagcgccagccccatggagctgctgagctacttcaagcagcccgtggccgccaccagaaccgccgtgagagccgccgactacctgcacgtggccctggacctgctggagagaaagctgagaagcctgtggagaagacccttcaacgtgaccgacgtgctgacccccgcccagctgaacgtgctgagcaagagcagcggctgcgcctaccaggacgtgggcgtgacctgccccgagcaggacaagtacagaaccatcaccggcatgtgcaacaacagatgcggctggctgggcgtggccgccggcaccggcctgagagaggccagcagaaccccccaggccagcagatgccagagacccgtgctgccctgcagaagaagccccaccctgggcgccagcaacagagccttcgtgagatggctgcccgccgagtacgaggacggcttcagcctgccctacggctggacccccggcgtgaagagaaacggcttccccgtggccctggccagagccgtgagcaacgagatcgtgagattccccaccgaccagctgacccccgaccaggagagaagcctgatgttcatgcagtggggccagctgctggaccacgacctggacttcacccccgagcccgccgccagagccagcttcgtgaccggcgtgaactgcgagaccagctgcgtgcagcagcccccctgcttccccctgaagatcccccccaacgaccccagaatcaagaaccaggccgactgcatccccttcttcagaagctgccccgcctgccccggcagcaacatcaccatcagaaaccagatcaacgccctgaccagcttcgtggacgccagcatggtgtacggcagcgaggagcccctggccagaaacctgagaaacatgagcaaccagctgggcctgctggccgtgaaccagagattccaggacaacggcagagccctgctgcccttcgacaacctgcacgacgacccctgcctgctgaccaacagaagcgccagaatcccctgcttcctggccggcgacaccagaagcagcgagatgcccgagctgaccagcatgcacaccctgctgctgagagagcacaacagactggccaccgagctgaagagcctgaaccccagatgggacggcgagagactgtaccaggaggccagaaagatcgtgggcgccatggtgcagatcatcacctacagagactacctgcccctggtgctgggccccaccgccatgagaaagtacctgcccacctacagaagctacaacgacagcgtggaccccagaatcgccaacgtgttcaccaacgccttcagatacggccacaccctgatccagcccttcatgttcagactggacaacagataccagcccatggagcccaaccccagagtgcccctgagcagagtgttcttcgccagctggagagtggtgctggagggcggcatcgaccccatcctgagaggcctgatggccacccccgccaagctgaacagacagaaccagatcgccgtggacgagatcagagagagactgttcgagcaggtgatgagaatcggcctggacctgcccgccctgaacatgcagagaagcagagaccacggcctgcccggctacaacgcctggagaagattctgcggcctgccccagcccgagaccgtgggccagctgggcaccgtgctgagaaacctgaagctggccagaaagctgatggagcagtacggcacccccaacaacatcgacatctggatgggcggcgtgagcgagcccctgaagagaaagggcagagtgggccccctgctggcctgcatcatcggcacccagttcagaaagctgagagacggcgacagattctggtgggagaacgagggcgtgttcagcatgcagcagagacaggccctggcccagatcagcctgcccagaatcatctgcgacaacaccggcatcaccaccgtgagcaagaacaacatcttcatgagcaacagctaccccagagacttcgtgaactgcagcaccctgcccgccctgaacctggccagctggagagaggccagctag

SEQ ID NO: 89886 - DNA, 1542 bp, Artificial Sequence
  Description of Artificial Sequence: Synthetic coding sequence
atgcccagctgggccctgttcatggtgaccagctgcctgctgctggccccccagaacctggcccaggtgagcagccaggacgtgagcctgctggccagcgacagcgagcccctgaagtgcttcagcagaaccttcgaggacctgacctgcttctgggacgaggaggaggccgcccccagcggcacctaccagctgctgtacgcctaccccagagagaagcccagagcctgccccctgagcagccagagcatgccccacttcggcaccagatacgtgtgccagttccccgaccaggaggaggtgagactgttcttccccctgcacctgtgggtgaagaacgtgttcctgaaccagaccagaacccagagagtgctgttcgtggacagcgtgggcctgcccgccccccccagcatcatcaaggccatgggcggcagccagcccggcgagctgcagatcagctgggaggagcccgcccccgagatcagcgacttcctgagatacgagctgagatacggccccagagaccccaagaacagcaccggccccaccgtgatccagctgatcgccaccgagacctgctgccccgccctgcagagaccccacagcgccagcgccctggaccagagcccctgcgcccagcccaccatgccctggcaggacggccccaagcagaccagccccagcagagaggccagcgccctgaccgccgagggcggcagctgcctgatcagcggcctgcagcccggcaacagctactggctgcagctgagaagcgagcccgacggcatcagcctgggcggcagctggggcagctggagcctgcccgtgaccgtggacctgcccggcgacgccgtggccctgggcctgcagtgcttcaccctggacctgaagaacgtgacctgccagtggcagcagcaggaccacgccagcagccagggcttcttctaccacagcagagccagatgctgccccagagacagataccccatctgggagaactgcgaggaggaggagaagaccaaccccggcctgcagaccccccagttcagcagatgccacttcaagagcagaaacgacagcatcatccacatcctggtggaggtgaccaccgcccccggcaccgtgcacagctacctgggcagccccttctggatccaccaggccgtgagactgcccacccccaacctgcactggagagagatcagcagcggccacctggagctggagtggcagcaccccagcagctgggccgcccaggagacctgctaccagctgagatacaccggcgagggccaccaggactggaaggtgctggagccccccctgggcgccagaggcggcaccctggagctgagacccagaagcagatacagactgcagctgagagccagactgaacggccccacctaccagggcccctggagcagctggagcgaccccaccagagtggagaccgccaccgagaccgcctggatcagcctggtgaccgccctgcacctggtgctgggcctgagcgccgtgctgggcctgctgctgctgtag

SEQ ID NO: 89887 - DNA, 1908 bp, Artificial Sequence
  Description of Artificial Sequence: Synthetic coding sequence
atgcccagctgggccctgttcatggtgaccagctgcctgctgctggccccccagaacctggcccaggtgagcagccaggacgtgagcctgctggccagcgacagcgagcccctgaagtgcttcagcagaaccttcgaggacctgacctgcttctgggacgaggaggaggccgcccccagcggcacctaccagctgctgtacgcctaccccagagagaagcccagagcctgccccctgagcagccagagcatgccccacttcggcaccagatacgtgtgccagttccccgaccaggaggaggtgagactgttcttccccctgcacctgtgggtgaagaacgtgttcctgaaccagaccagaacccagagagtgctgttcgtggacagcgtgggcctgcccgccccccccagcatcatcaaggccatgggcggcagccagcccggcgagctgcagatcagctgggaggagcccgcccccgagatcagcgacttcctgagatacgagctgagatacggccccagagaccccaagaacagcaccggccccaccgtgatccagctgatcgccaccgagacctgctgccccgccctgcagagaccccacagcgccagcgccctggaccagagcccctgcgcccagcccaccatgccctggcaggacggccccaagcagaccagccccagcagagaggccagcgccctgaccgccgagggcggcagctgcctgatcagcggcctgcagcccggcaacagctactggctgcagctgagaagcgagcccgacggcatcagcctgggcggcagctggggcagctggagcctgcccgtgaccgtggacctgcccggcgacgccgtggccctgggcctgcagtgcttcaccctggacctgaagaacgtgacctgccagtggcagcagcaggaccacgccagcagccagggcttcttctaccacagcagagccagatgctgccccagagacagataccccatctgggagaactgcgaggaggaggagaagaccaaccccggcctgcagaccccccagttcagcagatgccacttcaagagcagaaacgacagcatcatccacatcctggtggaggtgaccaccgcccccggcaccgtgcacagctacctgggcagccccttctggatccaccaggccgtgagactgcccacccccaacctgcactggagagagatcagcagcggccacctggagctggagtggcagcaccccagcagctgggccgcccaggagacctgctaccagctgagatacaccggcgagggccaccaggactggaaggtgctggagccccccctgggcgccagaggcggcaccctggagctgagacccagaagcagatacagactgcagctgagagccagactgaacggccccacctaccagggcccctggagcagctggagcgaccccaccagagtggagaccgccaccgagaccgcctggatcagcctggtgaccgccctgcacctggtgctgggcctgagcgccgtgctgggcctgctgctgctgagatggcagttccccgcccactacagaagactgagacacgccctgtggcccagcctgcccgacctgcacagagtgctgggccagtacctgagagacaccgccgccctgagcccccccaaggccaccgtgagcgacacctgcgaggaggtggagcccagcctgctggagatcctgcccaagagcagcgagagaacccccctgcccctgtgcagcagccaggcccagatggactacagaagactgcagcccagctgcctgggcaccatgcccctgagcgtgtgcccccccatggccgagagcggcagctgctgcaccacccacatcgccaaccacagctacctgcccctgagctactggcagcagccctag

SEQ ID NO: 89888 - DNA, 1650 bp, Artificial Sequence
  Description of Artificial Sequence: Synthetic coding sequence
atgcccagctgggccctgttcatggtgaccagctgcctgctgctggccccccagaacctggcccaggtgagcagccaggacgtgagcctgctggccagcgacagcgagcccctgaagtgcttcagcagaaccttcgaggacctgacctgcttctgggacgaggaggaggccgcccccagcggcacctaccagctgctgtacgcctaccccagagagaagcccagagcctgccccctgagcagccagagcatgccccacttcggcaccagatacgtgtgccagttccccgaccaggaggaggtgagactgttcttccccctgcacctgtgggtgaagaacgtgttcctgaaccagaccagaacccagagagtgctgttcgtggacagcgtgggcctgcccgccccccccagcatcatcaaggccatgggcggcagccagcccggcgagctgcagatcagctgggaggagcccgcccccgagatcagcgacttcctgagatacgagctgagatacggccccagagaccccaagaacagcaccggccccaccgtgatccagctgatcgccaccgagacctgctgccccgccctgcagagaccccacagcgccagcgccctggaccagagcccctgcgcccagcccaccatgccctggcaggacggccccaagcagaccagccccagcagagaggccagcgccctgaccgccgagggcggcagctgcctgatcagcggcctgcagcccggcaacagctactggctgcagctgagaagcgagcccgacggcatcagcctgggcggcagctggggcagctggagcctgcccgtgaccgtggacctgcccggcgacgccgtggccctgggcctgcagtgcttcaccctggacctgaagaacgtgacctgccagtggcagcagcaggaccacgccagcagccagggcttcttctaccacagcagagccagatgctgccccagagacagataccccatctgggagaactgcgaggaggaggagaagaccaaccccggcctgcagaccccccagttcagcagatgccacttcaagagcagaaacgacagcatcatccacatcctggtggaggtgaccaccgcccccggcaccgtgcacagctacctgggcagccccttctggatccaccaggccgtgagactgcccacccccaacctgcactggagagagatcagcagcggccacctggagctggagtggcagcaccccagcagctgggccgcccaggagacctgctaccagctgagatacaccggcgagggccaccaggactggaaggtgctggagccccccctgggcgccagaggcggcaccctggagctgagacccagaagcagatacagactgcagctgagagccagactgaacggccccacctaccagggcccctggagcagctggagcgaccccaccagagtggagaccgccaccgagaccgcctggatcagcctggtgaccgccctgcacctggtgctgggcctgagcgccgtgctgggcctgctgctgctgagatggcagttccccgcccactacagatacagacccagacaggccggcgactggagatggaccagatggagcagaagacccgtgaacagacacagctggttcgccctgtag

SEQ ID NO: 89889 - DNA, 2817 bp, Artificial Sequence
  Description of Artificial Sequence: Synthetic coding sequence
atgaccctgctgggcagcgagcacagcctgctgatcagaagcaagttcagaagcgtgctgcagctgagactgcagcagagaagaacccaggagcagctggccaaccagggcatcatcccccccctgaagagacccgccgagttccacgagcagagaaagcacctggacagcgacaaggccaagaacagcctgaagagaaaggccagaaacagatgcaacagcgccgacctggtgaacatgcacatcctgcaggccagcaccgccgagagaagcatccccaccgcccagatgaagctgaagagagccagactggccgacgacctgaacgagaagatcgccctgagacccggccccctggagctggtggagaagaacatcctgcccgtggacagcgccgtgaaggaggccatcaagggcaaccaggtgagcttcagcaagagcaccgacgccttcgccttcgaggaggacagcagcagcgacggcctgagccccgaccagaccagaagcgaggacccccagaacagcgccggcagcccccccgacgccaaggccagcgacacccccagcaccggcagcctgggcaccaaccaggacctggccagcggcagcgagaacgacagaaacgacagcgccagccagcccagccaccagagcgacgccggcaagcagggcctgggcccccccagcacccccatcgccgtgcacgccgccgtgaagagcaagagcctgggcgacagcaagaacagacacaagaagcccaaggaccccaagcccaaggtgaagaagctgaagtaccaccagtacatcccccccgaccagaaggccgagaagagccccccccccatggacagcgcctacgccagactgctgcagcagcagcagctgttcctgcagctgcagatcctgagccagcagcagcagcagcagcagcacagattcagctacctgggcatgcaccaggcccagctgaaggagcccaacgagcagatggtgagaaaccccaacagcagcagcacccccctgagcaacacccccctgagccccgtgaagaacagcttcagcggccagaccggcgtgagcagcttcaagcccggccccctgccccccaacctggacgacctgaaggtgagcgagctgagacagcagctgagaatcagaggcctgcccgtgagcggcaccaagaccgccctgatggacagactgagacccttccaggactgcagcggcaaccccgtgcccaacttcggcgacatcaccaccgtgaccttccccgtgacccccaacaccctgcccaactaccagagcagcagcagcaccagcgccctgagcaacggcttctaccacttcggcagcaccagcagcagcccccccatcagccccgccagcagcgacctgagcgtggccggcagcctgcccgacaccttcaacgacgccagccccagcttcggcctgcaccccagccccgtgcacgtgtgcaccgaggagagcctgatgagcagcctgaacggcggcagcgtgcccagcgagctggacggcctggacagcgagaaggacaagatgctggtggagaagcagaaggtgatcaacgagctgacctggaagctgcagcaggagcagagacaggtggaggagctgagaatgcagctgcagaagcagaagagaaacaactgcagcgagaagaagcccctgcccttcctggccgccagcatcaagcaggaggaggccgtgagcagctgccccttcgccagccaggtgcccgtgaagagacagagcagcagcagcgagtgccacccccccgcctgcgaggccgcccagctgcagcccctgggcaacgcccactgcgtggagagcagcgaccagaccaacgtgctgagcagcaccttcctgagcccccagtgcagcccccagcacagccccctgggcgccgtgaagagcccccagcacatcagcctgccccccagccccaacaacccccacttcctgcccagcagcagcggcgcccagggcgagggccacagagtgagcagccccatcagcagccaggtgtgcaccgcccagatggccggcctgcacagcagcgacaaggtgggccccaagttcagcatccccagccccaccttcagcaagagcagcagcgccatcagcgaggtgacccagccccccagctacgaggacgccgtgaagcagcagatgaccagaagccagcagatggacgagctgctggacgtgctgatcgagagcggcgagatgcccgccgacgccagagaggaccacagctgcctgcagaaggtgcccaagatccccagaagcagcagaagccccaccgccgtgctgaccaagcccagcgccagcttcgagcaggccagcagcggcagccagatccccttcgacccctacgccaccgacagcgacgagcacctggaggtgctgctgaacagccagagccccctgggcaagatgagcgacgtgaccctgctgaagatcggcagcgaggagccccacttcgacggcatcatggacggcttcagcggcaaggccgccgaggacctgttcaacgcccacgagatcctgcccggccccctgagccccatgcagacccagttcagccccagcagcgtggacagcaacggcctgcagctgagcttcaccgagagcccctgggagaccatggagtggctggacctgaccccccccaacagcacccccggcttcagcgccctgaccaccagcagccccagcatcttcaacatcgacttcctggacgtgaccgacctgaacctgaacagcagcatggacctgcacctgcagcagtggtag

SEQ ID NO: 89890 - DNA, 1989 bp, Artificial Sequence
  Description of Artificial Sequence: Synthetic coding sequence
atggacagcgcctacgccagactgctgcagcagcagcagctgttcctgcagctgcagatcctgagccagcagcagcagcagcagcagcacagattcagctacctgggcatgcaccaggcccagctgaaggagcccaacgagcagatggtgagaaaccccaacagcagcagcacccccctgagcaacacccccctgagccccgtgaagaacagcttcagcggccagaccggcgtgagcagcttcaagcccggccccctgccccccaacctggacgacctgaaggtgagcgagctgagacagcagctgagaatcagaggcctgcccgtgagcggcaccaagaccgccctgatggacagactgagacccttccaggactgcagcggcaaccccgtgcccaacttcggcgacatcaccaccgtgaccttccccgtgacccccaacaccctgcccaactaccagagcagcagcagcaccagcgccctgagcaacggcttctaccacttcggcagcaccagcagcagcccccccatcagccccgccagcagcgacctgagcgtggccggcagcctgcccgacaccttcaacgacgccagccccagcttcggcctgcaccccagccccgtgcacgtgtgcaccgaggagagcctgatgagcagcctgaacggcggcagcgtgcccagcgagctggacggcctggacagcgagaaggacaagatgctggtggagaagcagaaggtgatcaacgagctgacctggaagctgcagcaggagcagagacaggtggaggagctgagaatgcagctgcagaagcagaagagaaacaactgcagcgagaagaagcccctgcccttcctggccgccagcatcaagcaggaggaggccgtgagcagctgccccttcgccagccaggtgcccgtgaagagacagagcagcagcagcgagtgccacccccccgcctgcgaggccgcccagctgcagcccctgggcaacgcccactgcgtggagagcagcgaccagaccaacgtgctgagcagcaccttcctgagcccccagtgcagcccccagcacagccccctgggcgccgtgaagagcccccagcacatcagcctgccccccagccccaacaacccccacttcctgcccagcagcagcggcgcccagggcgagggccacagagtgagcagccccatcagcagccaggtgtgcaccgcccagaacagcggcgcccacgacggccacccccccagcttcagcccccacagcagcagcctgcacccccccttcagcggcgcccaggccgacagcagccacggcgccggcggcaacccctgccccaagagcccctgcgtgcagcagaagcagatgaccagaagccagcagatggacgagctgctggacgtgctgatcgagagcggcgagatgcccgccgacgccagagaggaccacagctgcctgcagaaggtgcccaagatccccagaagcagcagaagccccaccgccgtgctgaccaagcccagcgccagcttcgagcaggccagcagcggcagccagatccccttcgacccctacgccaccgacagcgacgagcacctggaggtgctgctgaacagccagagccccctgggcaagatgagcgacgtgaccctgctgaagatcggcagcgaggagccccacttcgacggcatcatggacggcttcagcggcaaggccgccgaggacctgttcaacgcccacgagatcctgcccggccccctgagccccatgcagacccagttcagccccagcagcgtggacagcaacggcctgcagctgagcttcaccgagagcccctgggagaccatggagtggctggacctgaccccccccaacagcacccccggcttcagcgccctgaccaccagcagccccagcatcttcaacatcgacttcctggacgtgaccgacctgaacctgaacagcagcatggacctgcacctgcagcagtggtag

SEQ ID NO: 89891 - DNA, 2055 bp, Artificial Sequence
  Description of Artificial Sequence: Synthetic coding sequence
atgaagctgaagagagccagactggccgacgacctgaacgagaagatcgccctgagacccggccccctggagctggtggagaagaacatcctgcccgtggacagcgccgtgaaggaggccatcaagggcaaccaggtgagcttcagcaagagcaccgacgccttcgccttcgaggaggacagcagcagcgacggcctgagccccgaccagaccagaagcgaggacccccagaacagcgccggcagcccccccgacgccaaggccagcgacacccccagcaccggcagcctgggcaccaaccaggacctggccagcggcagcgagaacgacagaaacgacagcgccagccagcccagccaccagagcgacgccggcaagcagggcctgggcccccccagcacccccatcgccgtgcacgccgccgtgaagagcaagagcctgggcgacagcaagaacagacacaagaagcccaaggaccccaagcccaaggtgaagaagctgaagtaccaccagtacatcccccccgaccagaaggccgagaagagccccccccccatggacagcgcctacgccagactgctgcagcagcagcagctgttcctgcagctgcagatcctgagccagcagcagcagcagcagcagcacagattcagctacctgggcatgcaccaggcccagctgaaggagcccaacgagcagatggtgagaaaccccaacagcagcagcacccccctgagcaacacccccctgagccccgtgaagaacagcttcagcggccagaccggcgtgagcagcttcaagcccggccccctgccccccaacctggacgacctgaaggtgagcgagctgagacagcagctgagaatcagaggcctgcccgtgagcggcaccaagaccgccctgatggacagactgagacccttccaggactgcagcggcaaccccgtgcccaacttcggcgacatcaccaccgtgaccttccccgtgacccccaacaccctgcccaactaccagagcagcagcagcaccagcgccctgagcaacggcttctaccacttcggcagcaccagcagcagcccccccatcagccccgccagcagcgacctgagcgtggccggcagcctgcccgacaccttcaacgacgccagccccagcttcggcctgcaccccagccccgtgcacgtgtgcaccgaggagagcctgatgagcagcctgaacggcggcagcgtgcccagcgagctggacggcctggacagcgagaaggacaagatgctggtggagaagcagaaggtgatcaacgagctgacctggaagctgcagcaggagcagagacaggtggaggagctgagaatgcagctgcagaagcagaagagaaacaactgcagcgagaagaagcccctgcccttcctggccgccagcatcaagcaggaggaggccgtgagcagctgccccttcgccagccaggtgcccgtgaagagacagagcagcagcagcgagtgccacccccccgcctgcgaggccgcccagctgcagcccctgggcaacgcccactgcgtggagagcagcgaccagaccaacgtgctgagcagcaccttcctgagcccccagtgcagcccccagcacagccccctgggcgccgtgaagagcccccagcacatcagcctgccccccagccccaacaacccccacttcctgcccagcagcagcggcgcccagggcgagggccacagagtgagcagccccatcagcagccaggtgtgcaccgcccagaacagcggcgcccacgacggccacccccccagcttcagcccccacagcagcagcctgcacccccccttcagcggcgcccaggccgacagcagccacggcgccggcggcaacccctgccccaagagcccctgcgtgcagcagaagatggccggcctgcacagcagcgacaaggtgggccccaagttcagcatccccagccccaccttcagcaagagcagcagcgccatcagcgaggtgacccagccccccagctacgaggacgccgtgaagcaggtgaccatgtag

SEQ ID NO: 89892 - DNA, 2961 bp, Artificial Sequence
  Description of Artificial Sequence: Synthetic coding sequence
atgaccctgctgggcagcgagcacagcctgctgatcagaagcaagttcagaagcgtgctgcagctgagactgcagcagagaagaacccaggagcagctggccaaccagggcatcatcccccccctgaagagacccgccgagttccacgagcagagaaagcacctggacagcgacaaggccaagaacagcctgaagagaaaggccagaaacagatgcaacagcgccgacctggtgaacatgcacatcctgcaggccagcaccgccgagagaagcatccccaccgcccagatgaagctgaagagagccagactggccgacgacctgaacgagaagatcgccctgagacccggccccctggagctggtggagaagaacatcctgcccgtggacagcgccgtgaaggaggccatcaagggcaaccaggtgagcttcagcaagagcaccgacgccttcgccttcgaggaggacagcagcagcgacggcctgagccccgaccagaccagaagcgaggacccccagaacagcgccggcagcccccccgacgccaaggccagcgacacccccagcaccggcagcctgggcaccaaccaggacctggccagcggcagcgagaacgacagaaacgacagcgccagccagcccagccaccagagcgacgccggcaagcagggcctgggcccccccagcacccccatcgccgtgcacgccgccgtgaagagcaagagcctgggcgacagcaagaacagacacaagaagcccaaggaccccaagcccaaggtgaagaagctgaagtaccaccagtacatcccccccgaccagaaggccgagaagagccccccccccatggacagcgcctacgccagactgctgcagcagcagcagctgttcctgcagctgcagatcctgagccagcagcagcagcagcagcagcacagattcagctacctgggcatgcaccaggcccagctgaaggagcccaacgagcagatggtgagaaaccccaacagcagcagcacccccctgagcaacacccccctgagccccgtgaagaacagcttcagcggccagaccggcgtgagcagcttcaagcccggccccctgccccccaacctggacgacctgaaggtgagcgagctgagacagcagctgagaatcagaggcctgcccgtgagcggcaccaagaccgccctgatggacagactgagacccttccaggactgcagcggcaaccccgtgcccaacttcggcgacatcaccaccgtgaccttccccgtgacccccaacaccctgcccaactaccagagcagcagcagcaccagcgccctgagcaacggcttctaccacttcggcagcaccagcagcagcccccccatcagccccgccagcagcgacctgagcgtggccggcagcctgcccgacaccttcaacgacgccagccccagcttcggcctgcaccccagccccgtgcacgtgtgcaccgaggagagcctgatgagcagcctgaacggcggcagcgtgcccagcgagctggacggcctggacagcgagaaggacaagatgctggtggagaagcagaaggtgatcaacgagctgacctggaagctgcagcaggagcagagacaggtggaggagctgagaatgcagctgcagaagcagaagagaaacaactgcagcgagaagaagcccctgcccttcctggccgccagcatcaagcaggaggaggccgtgagcagctgccccttcgccagccaggtgcccgtgaagagacagagcagcagcagcgagtgccacccccccgcctgcgaggccgcccagctgcagcccctgggcaacgcccactgcgtggagagcagcgaccagaccaacgtgctgagcagcaccttcctgagcccccagtgcagcccccagcacagccccctgggcgccgtgaagagcccccagcacatcagcctgccccccagccccaacaacccccacttcctgcccagcagcagcggcgcccagggcgagggccacagagtgagcagccccatcagcagccaggtgtgcaccgcccagaacagcggcgcccacgacggccacccccccagcttcagcccccacagcagcagcctgcacccccccttcagcggcgcccaggccgacagcagccacggcgccggcggcaacccctgccccaagagcccctgcgtgcagcagaagatggccggcctgcacagcagcgacaaggtgggccccaagttcagcatccccagccccaccttcagcaagagcagcagcgccatcagcgaggtgacccagccccccagctacgaggacgccgtgaagcagcagatgaccagaagccagcagatggacgagctgctggacgtgctgatcgagagcggcgagatgcccgccgacgccagagaggaccacagctgcctgcagaaggtgcccaagatccccagaagcagcagaagccccaccgccgtgctgaccaagcccagcgccagcttcgagcaggccagcagcggcagccagatccccttcgacccctacgccaccgacagcgacgagcacctggaggtgctgctgaacagccagagccccctgggcaagatgagcgacgtgaccctgctgaagatcggcagcgaggagccccacttcgacggcatcatggacggcttcagcggcaaggccgccgaggacctgttcaacgcccacgagatcctgcccggccccctgagccccatgcagacccagttcagccccagcagcgtggacagcaacggcctgcagctgagcttcaccgagagcccctgggagaccatggagtggctggacctgaccccccccaacagcacccccggcttcagcgccctgaccaccagcagccccagcatcttcaacatcgacttcctggacgtgaccgacctgaacctgaacagcagcatggacctgcacctgcagcagtggtag

SEQ ID NO: 89893 - DNA, 1947 bp, Artificial Sequence
  Description of Artificial Sequence: Synthetic coding sequence
ttcctgcagctgcagatcctgagccagcagcagcagcagcagcagcacagattcagctacctgggcatgcaccaggcccagctgaaggagcccaacgagcagatggtgagaaaccccaacagcagcagcacccccctgagcaacacccccctgagccccgtgaagaacagcttcagcggccagaccggcgtgagcagcttcaagcccggccccctgccccccaacctggacgacctgaaggtgagcgagctgagacagcagctgagaatcagaggcctgcccgtgagcggcaccaagaccgccctgatggacagactgagacccttccaggactgcagcggcaaccccgtgcccaacttcggcgacatcaccaccgtgaccttccccgtgacccccaacaccctgcccaactaccagagcagcagcagcaccagcgccctgagcaacggcttctaccacttcggcagcaccagcagcagcccccccatcagccccgccagcagcgacctgagcgtggccggcagcctgcccgacaccttcaacgacgccagccccagcttcggcctgcaccccagccccgtgcacgtgtgcaccgaggagagcctgatgagcagcctgaacggcggcagcgtgcccagcgagctggacggcctggacagcgagaaggacaagatgctggtggagaagcagaaggtgatcaacgagctgacctggaagctgcagcaggagcagagacaggtggaggagctgagaatgcagctgcagaagcagaagagaaacaactgcagcgagaagaagcccctgcccttcctggccgccagcatcaagcaggaggaggccgtgagcagctgccccttcgccagccaggtgcccgtgaagagacagagcagcagcagcgagtgccacccccccgcctgcgaggccgcccagctgcagcccctgggcaacgcccactgcgtggagagcagcgaccagaccaacgtgctgagcagcaccttcctgagcccccagtgcagcccccagcacagccccctgggcgccgtgaagagcccccagcacatcagcctgccccccagccccaacaacccccacttcctgcccagcagcagcggcgcccagggcgagggccacagagtgagcagccccatcagcagccaggtgtgcaccgcccagaacagcggcgcccacgacggccacccccccagcttcagcccccacagcagcagcctgcacccccccttcagcggcgcccaggccgacagcagccacggcgccggcggcaacccctgccccaagagcccctgcgtgcagcagaagcagatgaccagaagccagcagatggacgagctgctggacgtgctgatcgagagcggcgagatgcccgccgacgccagagaggaccacagctgcctgcagaaggtgcccaagatccccagaagcagcagaagccccaccgccgtgctgaccaagcccagcgccagcttcgagcaggccagcagcggcagccagatccccttcgacccctacgccaccgacagcgacgagcacctggaggtgctgctgaacagccagagccccctgggcaagatgagcgacgtgaccctgctgaagatcggcagcgaggagccccacttcgacggcatcatggacggcttcagcggcaaggccgccgaggacctgttcaacgcccacgagatcctgcccggccccctgagccccatgcagacccagttcagccccagcagcgtggacagcaacggcctgcagctgagcttcaccgagagcccctgggagaccatggagtggctggacctgaccccccccaacagcacccccggcttcagcgccctgaccaccagcagccccagcatcttcaacatcgacttcctggacgtgaccgacctgaacctgaacagcagcatggacctgcacctgcagcagtggtag

SEQ ID NO: 89894 - DNA, 1515 bp, Artificial Sequence
  Description of Artificial Sequence: Synthetic coding sequence
atgagattcttctgcgccagatgctgcagcttcggccccgagatgcccgccgtgcagctgctgctgctggcctgcctggtgtgggacgtgggcgccagaaccgcccagctgagaaaggccaacgaccagagcggcagatgccagtacaccttcagcgtggccagccccaacgagagcagctgccccgagcagagccaggccatgagcgtgatccacaacctgcagagagacagcagcacccagagactggacctggaggccaccaaggccagactgagcagcctggagagcctgctgcaccagctgaccctggaccaggccgccagaccccaggagacccaggagggcctgcagagagagctgggcaccctgagaagagagagagaccagctggagacccagaccagagagctggagaccgcctacagcaacctgctgagagacaagagcgtgctggaggaggagaagaagagactgagacaggagaacgagaacctggccagaagactggagagcagcagccaggaggtggccagactgagaagaggccagtgcccccagaccagagacaccgccagagccgtgccccccggcagcagagaggtgagcacctggaacctggacaccctggccttccaggagctgaagagcgagctgaccgaggtgcccgccagcagaatcctgaaggagagccccagcggctacctgagaagcggcgagggcgacaccggctgcggcgagctggtgtgggtgggcgagcccctgaccctgagaaccgccgagaccatcaccggcaagtacggcgtgtggatgagagaccccaagcccacctacccctacacccaggagaccacctggagaatcgacaccgtgggcaccgacgtgagacaggtgttcgagtacgacctgatcagccagttcatgcagggctaccccagcaaggtgcacatcctgcccagacccctggagagcaccggcgccgtggtgtacagcggcagcctgtacttccagggcgccgagagcagaaccgtgatcagatacgagctgaacaccgagaccgtgaaggccgagaaggagatccccggcgccggctaccacggccagttcccctacagctggggcggctacaccgacatcgacctggccgtggacgaggccggcctgtgggtgatctacagcaccgacgaggccaagggcgccatcgtgctgagcaagctgaaccccgagaacctggagctggagcagacctgggagaccaacatcagaaagcagagcgtggccaacgccttcatcatctgcggcaccctgtacaccgtgagcagctacaccagcgccgacgccaccgtgaacttcgcctacgacaccggcaccggcatcagcaagaccctgaccatccccttcaagaacagatacaagtacagcagcatgatcgactacaaccccctggagaagaagctgttcgcctgggacaacctgaacatggtgacctacgacatcaagctgagcaagatgtag

SEQ ID NO: 89895 - DNA, 1374 bp, Artificial Sequence
  Description of Artificial Sequence: Synthetic coding sequence
atgagattcttctgcgccagatgctgcagcttcggccccgagatgcccgccgtgcagctgctgctgctggcctgcctggtgtgggacgtgggcgccagaaccgcccagctgagaaaggccaacgaccagagcggcagatgccagtacaccttcagcgtggccagccccaacgagagcagctgccccgagcagagccaggccatgagcgtgatccacaacctgcagagagacagcagcacccagagactggacctggaggccaccaaggccagactgagcagcctggagagcctgctgagagacaagagcgtgctggaggaggagaagaagagactgagacaggagaacgagaacctggccagaagactggagagcagcagccaggaggtggccagactgagaagaggccagtgcccccagaccagagacaccgccagagccgtgccccccggcagcagagaggtgagcacctggaacctggacaccctggccttccaggagctgaagagcgagctgaccgaggtgcccgccagcagaatcctgaaggagagccccagcggctacctgagaagcggcgagggcgacaccggctgcggcgagctggtgtgggtgggcgagcccctgaccctgagaaccgccgagaccatcaccggcaagtacggcgtgtggatgagagaccccaagcccacctacccctacacccaggagaccacctggagaatcgacaccgtgggcaccgacgtgagacaggtgttcgagtacgacctgatcagccagttcatgcagggctaccccagcaaggtgcacatcctgcccagacccctggagagcaccggcgccgtggtgtacagcggcagcctgtacttccagggcgccgagagcagaaccgtgatcagatacgagctgaacaccgagaccgtgaaggccgagaaggagatccccggcgccggctaccacggccagttcccctacagctggggcggctacaccgacatcgacctggccgtggacgaggccggcctgtgggtgatctacagcaccgacgaggccaagggcgccatcgtgctgagcaagctgaaccccgagaacctggagctggagcagacctgggagaccaacatcagaaagcagagcgtggccaacgccttcatcatctgcggcaccctgtacaccgtgagcagctacaccagcgccgacgccaccgtgaacttcgcctacgacaccggcaccggcatcagcaagaccctgaccatccccttcaagaacagatacaagtacagcagcatgatcgactacaaccccctggagaagaagctgttcgcctgggacaacctgaacatggtgacctacgacatcaagctgagcaagatgtag

SEQ ID NO: 89896 - DNA, 1314 bp, Artificial Sequence
  Description of Artificial Sequence: Synthetic coding sequence
atgagcgtgatccacaacctgcagagagacagcagcacccagagactggacctggaggccaccaaggccagactgagcagcctggagagcctgctgcaccagctgaccctggaccaggccgccagaccccaggagacccaggagggcctgcagagagagctgggcaccctgagaagagagagagaccagctggagacccagaccagagagctggagaccgcctacagcaacctgctgagagacaagagcgtgctggaggaggagaagaagagactgagacaggagaacgagaacctggccagaagactggagagcagcagccaggaggtggccagactgagaagaggccagtgcccccagaccagagacaccgccagagccgtgccccccggcagcagagaggtgagcacctggaacctggacaccctggccttccaggagctgaagagcgagctgaccgaggtgcccgccagcagaatcctgaaggagagccccagcggctacctgagaagcggcgagggcgacaccggctgcggcgagctggtgtgggtgggcgagcccctgaccctgagaaccgccgagaccatcaccggcaagtacggcgtgtggatgagagaccccaagcccacctacccctacacccaggagaccacctggagaatcgacaccgtgggcaccgacgtgagacaggtgttcgagtacgacctgatcagccagttcatgcagggctaccccagcaaggtgcacatcctgcccagacccctggagagcaccggcgccgtggtgtacagcggcagcctgtacttccagggcgccgagagcagaaccgtgatcagatacgagctgaacaccgagaccgtgaaggccgagaaggagatccccggcgccggctaccacggccagttcccctacagctggggcggctacaccgacatcgacctggccgtggacgaggccggcctgtgggtgatctacagcaccgacgaggccaagggcgccatcgtgctgagcaagctgaaccccgagaacctggagctggagcagacctgggagaccaacatcagaaagcagagcgtggccaacgccttcatcatctgcggcaccctgtacaccgtgagcagctacaccagcgccgacgccaccgtgaacttcgcctacgacaccggcaccggcatcagcaagaccctgaccatccccttcaagaacagatacaagtacagcagcatgatcgactacaaccccctggagaagaagctgttcgcctgggacaacctgaacatggtgacctacgacatcaagctgagcaagatgtag

SEQ ID NO: 89897 - DNA, 1035 bp, Artificial Sequence
  Description of Artificial Sequence: Synthetic coding sequence
atgagattcttctgcgccagatgctgcagcttcggccccgagatgcccgccgtgcagctgctgctgctggcctgcctggtgtgggacgtgggcgccagaaccgcccagctgagaaaggccaacgaccagagcggcagatgccagtacaccttcagcgtggccagccccaacgagagcagctgccccgagcagagccaggccatgagcgtgatccacaacctgcagagagacagcagcacccagagactggacctggaggccaccaaggccagactgagcagcctggagagcctgctgcaccagctgaccctggaccaggccgccagaccccaggagacccaggagggcctgcagagagagctgggcaccctgagaagagagagagaccagctggagacccagaccagagagctggagaccgcctacagcaacctgctgagagacaagagcgtgctggaggaggagaagaagagactgagacaggagaacgagaacctggccagaagactggagagcagcagccaggaggtggccagactgagaagaggccagtgcccccagaccagagacaccgccagagccgtgccccccggcagcagagaggtgagcacctggaacctggacaccctggccttccaggagctgaagagcgagctgaccgaggtgcccgccagcagaatcctgaaggagagccccagcggctacctgagaagcggcgagggcgacaccggctgcggcgagctggtgtgggtgggcgagcccctgaccctgagaaccgccgagaccatcaccggcaagtacggcgtgtggatgagagaccccaagcccacctacccctacacccaggagaccacctggagaatcgacaccgtgggcaccgacgtgagacaggtgttcgagtacgacctgatcagccagttcatgcagggctaccccagcaaggtgcacatcctgcccagacccctggagagcaccggcgccgtggtgtacagcggcagcctgtacttcagagccctgagccccgagctgagctag

SEQ ID NO: 89898 - DNA, 1521 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcagcaacaagctgttccagtacgccagcaccgacatggacaaggtgctgctgaagtacaccgagtacaacgagccccacgagagcagaaccaacagcgacatcgtggagaccctgagaaagaagggcctgaacggctgcgagagccccgacgccgacgactacttcgagcacagccccctgagcgaggacagattcagcaagctgaacgaggacagcgacttcatcttcaagagaggcccccccggcctgcccccccagaacttcagcatgagcgtgaccgtgcccgtgaccagccccaacgccctgagctacaccaaccccggcagcagcctggtgagccccagcctggccgccagcagcaccctgaccgacagcagcatgctgagccccccccagaccaccctgcacagaaacgtgagccccggcgccccccagagaccccccagcaccggcaacgccggcggcatgctgagcaccaccgacctgaccgtgcccaacggcgccggcagcagccccgtgggcaacggcttcgtgaacagcagagccagccccaacctgatcggcgccaccggcgccaacagcctgggcaaggtgatgcccaccaagagcccccccccccccggcggcggcaacctgggcatgaacagcagaaagcccgacctgagagtggtgatcccccccagcagcaagggcatgatgccccccctgtacctgaagagacagctgaacaccaacaacacccagagaatcagcagcagccaggccacccagcccctggccacccccgtggtgagcgtgaccacccccagcctgcccccccagggcctggtgtacagcgccatgcccaccgcctacaacaccgactacagcctgaccagcgccgacctgagcgccctgcagggcttcaacagccccggcatgctgagcctgggccaggtgagcgcctggcagcagcaccacctgggccaggccgccctgagcagcctggtggccggcggccagctgagccagggcagcaacctgagcatcaacaccaaccagaacatcagcatcaagagcgagcccatcagcccccccagagacagaatgacccccagcggcttccagcagcagcagcagcagcagcagcagcagcagccccccccccccccccagccccagccccagcccccccagccccagcccagacaggagatgggcagaagccccgtggacagcctgagcagcagcagcagcagctacgacggcagcgacagagaggaccccagaggcgacttccacagccccatcgtgctgggcagaccccccaacaccgaggacagagagagccccagcgtgaagagaatgagaatggacgcctgggtgacctag

SEQ ID NO: 89899 - DNA, 1500 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcagcaacaagctgttccagtacgccagcaccgacatggacaaggtgctgctgaagtacaccgagtacaacgagccccacgagagcagaaccaacagcgacatcgtggaggccctgaacaagaaggagcacagaggctgcgacagccccgaccccgacaccagctacgtgctgaccccccacaccgaggagaagtacaagaagatcaacgaggagttcgacaacatgatgagaaaccacaagatcgcccccggcctgcccccccagaacttcagcatgagcgtgaccgtgcccgtgaccagccccaacgccctgagctacaccaaccccggcagcagcctggtgagccccagcctggccgccagcagcaccctgaccgacagcagcatgctgagccccccccagaccaccctgcacagaaacgtgagccccggcgccccccagagaccccccagcaccggcaacgccggcggcatgctgagcaccaccgacctgaccgtgcccaacggcgccggcagcagccccgtgggcaacggcttcgtgaacagcagagccagccccaacctgatcggcgccaccggcgccaacagcctgggcaaggtgatgcccaccaagagcccccccccccccggcggcggcaacctgggcatgaacagcagaaagcccgacctgagagtggtgatcccccccagcagcaagggcatgatgccccccctgaacacccagagaatcagcagcagccaggccacccagcccctggccacccccgtggtgagcgtgaccacccccagcctgcccccccagggcctggtgtacagcgccatgcccaccgcctacaacaccgactacagcctgaccagcgccgacctgagcgccctgcagggcttcaacagccccggcatgctgagcctgggccaggtgagcgcctggcagcagcaccacctgggccaggccgccctgagcagcctggtggccggcggccagctgagccagggcagcaacctgagcatcaacaccaaccagaacatcagcatcaagagcgagcccatcagcccccccagagacagaatgacccccagcggcttccagcagcagcagcagcagcagcagcagcagcagccccccccccccccccagccccagccccagcccccccagccccagcccagacaggagatgggcagaagccccgtggacagcctgagcagcagcagcagcagctacgacggcagcgacagagaggaccccagaggcgacttccacagccccatcgtgctgggcagaccccccaacaccgaggacagagagagccccagcgtgaagagaatgagaatggacgcctgggtgacctag

SEQ ID NO: 89900 - DNA, 1290 bp, Artificial Sequence
  Description of Artificial Sequence: Synthetic coding sequence
atgggcagaaagaagatccagatcaccagaatcatggacgagagaaacagacagaccctgagaaagaagggcctgaacggctgcgagagccccgacgccgacgactacttcgagcacagccccctgagcgaggacagattcagcaagctgaacgaggacagcgacttcatcttcaagagaggcccccccggcctgcccccccagaacttcagcatgagcgtgaccgtgcccgtgaccagccccaacgccctgagctacaccaaccccggcagcagcctggtgagccccagcctggccgccagcagcaccctgaccgacagcagcatgctgagccccccccagaccaccctgcacagaaacgtgagccccggcgccccccagagaccccccagcaccggcaacgccggcggcatgctgagcaccaccgacctgaccgtgcccaacggcgccggcagcagccccgtgggcaacggcttcgtgaacagcagagccagccccaacctgatcggcgccaccggcgccaacagcctgggcaaggtgatgcccaccaagagcccccccccccccggcggcggcaacctgggcatgaacagcagaaagcccgacctgagagtggtgatcccccccagcagcaagggcatgatgccccccctgaacacccagagaatcagcagcagccaggccacccagcccctggccacccccgtggtgagcgtgaccacccccagcctgcccccccagggcctggtgtacagcgccatgcccaccgcctacaacaccgactacagcctgaccagcgccgacctgagcgccctgcagggcttcaacagccccggcatgctgagcctgggccaggtgagcgcctggcagcagcaccacctgggccaggccgccctgagcagcctggtggccggcggccagctgagccagggcagcaacctgagcatcaacaccaaccagaacatcagcatcaagagcgagcccatcagcccccccagagacagaatgacccccagcggcttccagcagcagcagcagcagcagcagcagcagcagccccccccccccccccagccccagccccagcccccccagccccagcccagacaggagatgggcagaagccccgtggacagcctgagcagcagcagcagcagctacgacggcagcgacagagaggaccccagaggcgacttccacagccccatcgtgctgggcagaccccccaacaccgaggacagagagagccccagcgtgaagagaatgagaatggacgcctgggtgacctag

SEQ ID NO: 89901 - DNA, 1494 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcagcaacaagctgttccagtacgccagcaccgacatggacaaggtgctgctgaagtacaccgagtacaacgagccccacgagagcagaaccaacagcgacatcgtggagaccctgagaaagaagggcctgaacggctgcgagagccccgacgccgacgactacttcgagcacagccccctgagcgaggacagattcagcaagctgaacgaggacagcgacttcatcttcaagagaggcccccccggcctgcccccccagaacttcagcatgagcgtgaccgtgcccgtgaccagccccaacgccctgagctacaccaaccccggcagcagcctggtgagccccagcctggccgccagcagcaccctgaccgacagcagcatgctgagccccccccagaccaccctgcacagaaacgtgagccccggcgccccccagagaccccccagcaccggcaacgccggcggcatgctgagcaccaccgacctgaccgtgcccaacggcgccggcagcagccccgtgggcaacggcttcgtgaacagcagagccagccccaacctgatcggcgccaccggcgccaacagcctgggcaaggtgatgcccaccaagagcccccccccccccggcggcggcaacctgggcatgaacagcagaaagcccgacctgagagtggtgatcccccccagcagcaagggcatgatgccccccctgaacacccagagaatcagcagcagccaggccacccagcccctggccacccccgtggtgagcgtgaccacccccagcctgcccccccagggcctggtgtacagcgccatgcccaccgcctacaacaccgactacagcctgaccagcgccgacctgagcgccctgcagggcttcaacagccccggcatgctgagcctgggccaggtgagcgcctggcagcagcaccacctgggccaggccgccctgagcagcctggtggccggcggccagctgagccagggcagcaacctgagcatcaacaccaaccagaacatcagcatcaagagcgagcccatcagcccccccagagacagaatgacccccagcggcttccagcagcagcagcagcagcagcagcagcagcagccccccccccccccccagccccagccccagcccccccagccccagcccagacaggagatgggcagaagccccgtggacagcctgagcagcagcagcagcagctacgacggcagcgacagagaggaccccagaggcgacttccacagccccatcgtgctgggcagaccccccaacaccgaggacagagagagccccagcgtgaagagaatgagaatggacgcctgggtgacctag

SEQ ID NO: 89902 - DNA, 1494 bp, Artificial Sequence; identical to SEQ ID NO: 89901
  Description of Artificial Sequence: Synthetic coding sequence

SEQ ID NO: 89903 - DNA, 1518 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcagcaacaagctgttccagtacgccagcaccgacatggacaaggtgctgctgaagtacaccgagtacaacgagccccacgagagcagaaccaacagcgacatcgtggagaccctgagaaagaagggcctgaacggctgcgagagccccgacgccgacgactacttcgagcacagccccctgagcgaggacagattcagcaagctgaacgaggacagcgacttcatcttcaagagaggcccccccggcctgcccccccagaacttcagcatgagcgtgaccgtgcccgtgaccagccccaacgccctgagctacaccaaccccggcagcagcctggtgagccccagcctggccgccagcagcaccctgaccgacagcagcatgctgagccccccccagaccaccctgcacagaaacgtgagccccggcgccccccagagaccccccagcaccggcaacgccggcggcatgctgagcaccaccgacctgaccgtgcccaacggcgccggcagcagccccgtgggcaacggcttcgtgaacagcagagccagccccaacctgatcggcgccaccggcgccaacagcctgggcaaggtgatgcccaccaagagcccccccccccccggcggcggcaacctgggcatgaacagcagaaagcccgacctgagagtggtgatcccccccagcagcaagggcatgatgccccccctgagcgaggaggaggagctggagctgaacacccagagaatcagcagcagccaggccacccagcccctggccacccccgtggtgagcgtgaccacccccagcctgcccccccagggcctggtgtacagcgccatgcccaccgcctacaacaccgactacagcctgaccagcgccgacctgagcgccctgcagggcttcaacagccccggcatgctgagcctgggccaggtgagcgcctggcagcagcaccacctgggccaggccgccctgagcagcctggtggccggcggccagctgagccagggcagcaacctgagcatcaacaccaaccagaacatcagcatcaagagcgagcccatcagcccccccagagacagaatgacccccagcggcttccagcagcagcagcagcagcagcagcagcagcagccccccccccccccccagccccagccccagcccccccagccccagcccagacaggagatgggcagaagccccgtggacagcctgagcagcagcagcagcagctacgacggcagcgacagagaggaccccagaggcgacttccacagccccatcgtgctgggcagaccccccaacaccgaggacagagagagccccagcgtgaagagaatgagaatggacgcctgggtgacctag

SEQ ID NO: 89904 - DNA, 117 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtag

SEQ ID NO: 89905 - DNA, 1314 bp, Artificial Sequence
  Description of Artificial Sequence: Synthetic coding sequence
atgggcagaaagaagatccagatcaccagaatcatggacgagagaaacagacagaccctgagaaagaagggcctgaacggctgcgagagccccgacgccgacgactacttcgagcacagccccctgagcgaggacagattcagcaagctgaacgaggacagcgacttcatcttcaagagaggcccccccggcctgcccccccagaacttcagcatgagcgtgaccgtgcccgtgaccagccccaacgccctgagctacaccaaccccggcagcagcctggtgagccccagcctggccgccagcagcaccctgaccgacagcagcatgctgagccccccccagaccaccctgcacagaaacgtgagccccggcgccccccagagaccccccagcaccggcaacgccggcggcatgctgagcaccaccgacctgaccgtgcccaacggcgccggcagcagccccgtgggcaacggcttcgtgaacagcagagccagccccaacctgatcggcgccaccggcgccaacagcctgggcaaggtgatgcccaccaagagcccccccccccccggcggcggcaacctgggcatgaacagcagaaagcccgacctgagagtggtgatcccccccagcagcaagggcatgatgccccccctgagcgaggaggaggagctggagctgaacacccagagaatcagcagcagccaggccacccagcccctggccacccccgtggtgagcgtgaccacccccagcctgcccccccagggcctggtgtacagcgccatgcccaccgcctacaacaccgactacagcctgaccagcgccgacctgagcgccctgcagggcttcaacagccccggcatgctgagcctgggccaggtgagcgcctggcagcagcaccacctgggccaggccgccctgagcagcctggtggccggcggccagctgagccagggcagcaacctgagcatcaacaccaaccagaacatcagcatcaagagcgagcccatcagcccccccagagacagaatgacccccagcggcttccagcagcagcagcagcagcagcagcagcagcagccccccccccccccccagccccagccccagcccccccagccccagcccagacaggagatgggcagaagccccgtggacagcctgagcagcagcagcagcagctacgacggcagcgacagagaggaccccagaggcgacttccacagccccatcgtgctgggcagaccccccaacaccgaggacagagagagccccagcgtgaagagaatgagaatggacgcctgggtgacctag

SEQ ID NO: 89906 - DNA, 234 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcagcaacaagctgttccagtacgccagcaccgacatggacaaggtgctgctgaagtacaccgagtacaacgagccccacgagtag

SEQ ID NO: 89907 - DNA, 258 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcagcaacaagctgttccagtacgccagcaccgacatggacaaggtgctgctgaagtacaccgagtacaacgagccccacgagagcagaaccaacagcgacatcgtgtag

SEQ ID NO: 89908 - DNA, 1107 bp, Artificial Sequence
  Description of Artificial Sequence: Synthetic coding sequence
atgggcagaaagaagatccagatcagcagaatcctggaccagagaaacagacaggtgaccttcaccaagagaaagttcggcctgatgaagaaggcctacgagctgagcgtgctgtgcgactgcgagatcgccctgatcatcttcaacagcgccaacagactgttccagtacgccagcaccgacatggacagagtgctgctgaagtacaccgagtacagcgagccccacgagagcagaaccaacaccgacatcctggagaccctgaagagaagaggcatcggcctggacggccccgagctggagcccgacgagggccccgaggagcccggcgagaagttcagaagactggccggcgagggcggcgaccccgccctgcccagacccagactgtaccccgccgcccccgccatgcccagccccgacgtggtgtacggcgccctgcccccccccggctgcgaccccagcggcctgggcgaggccctgcccgcccagagcagacccagccccttcagacccgccgcccccaaggccggcccccccggcctggtgcaccccctgttcagccccagccacctgaccagcaagacccccccccccctgtacctgcccaccgagggcagaagaagcgacctgcccggcggcctggccggccccagaggcggcctgaacaccagcagaagcctgtacagcggcctgcagaacccctgcagcaccgccacccccggcccccccctgggcagcttccccttcctgcccggcggcccccccgagtacggcctgggcgaccccccccccccccccggcctgctgcagccccccaccctggccccctggcagcccagcagaggcgacggcccccccgccgtgagcagccagcccagcggcggcagaagcctgggcgaggagggcccccccaccagaggcgccagcccccccaccccccccgtgagcatcaagagcgagagactgagccccgcccccggcggccccggcgacttccccaagaccttcccctaccccctgctgctggccagaagcctggccgagcccctgagacccggccccgccctgagaagactgcccctggccgacggctggcccagatag

SEQ ID NO: 89909 - DNA, 894 bp, Artificial Sequence
  Description of Artificial Sequence: Synthetic coding sequence
atgggcagaaagaagatccagatcagcagaatcctggaccagagaaacagacaggtgaccttcaccaagagaaagttcggcctgatgaagaaggcctacgagctgagcgtgctgtgcgactgcgagatcgccctgatcatcttcaacagcgccaacagactgttccagtacgccagcaccgacatggacagagtgctgctgaagtacaccgagtacagcgagccccacgagagcagaaccaacaccgacatcctggaggtgccccagaccctgaagagaagaggcatcggcctggacggccccgagctggagcccgacgagggccccgaggagcccggcgagaagttcagaagactggccggcgagggcggcgaccccgccctgcccagacccagactgtaccccgccgcccccgccatgcccagccccgacgtggtgtacggcgccctgcccccccccggctgcgaccccagcggcctgggcgaggccctgcccgcccagagcagacccagccccttcagacccgccgcccccaaggccggcccccccggcctggtgcaccccctgttcagccccagccacctgaccagcaagacccccccccccctgtacctgcccaccgagggcagaagaagcgacctgcccggcggcctggccggccccagaggcggcctgaacaccagcagaagcctgtacagcggcctgcagaacccctgcagcaccgccacccccggcccccccctgggcagcttccccttcctgcccggcggcccccccgagtacggcctgggcgaccccccccccccccccggcctgctgcagccccccaccctggccccctggcagcccagcagaggcgacggcccccccgccgtgagcagccagcccagatag

SEQ ID NO: 89910 - DNA, 1107 bp, Artificial Sequence; identical to SEQ ID NO: 89908
  Description of Artificial Sequence: Synthetic coding sequence

SEQ ID NO: 89911 - DNA, 1098 bp, Artificial Sequence
  Description of Artificial Sequence: Synthetic coding sequence
atgggcagaaagaagatccagatcagcagaatcctggaccagagaaacagacaggtgaccttcaccaagagaaagttcggcctgatgaagaaggcctacgagctgagcgtgctgtgcgactgcgagatcgccctgatcatcttcaacagcgccaacagactgttccagtacgccagcaccgacatggacagagtgctgctgaagtacaccgagtacagcgagccccacgagagcagaaccaacaccgacatcctggagaccctgaagagaagaggcatcggcctggacggccccgagctggagcccgacgagggccccgaggagcccggcgagaagttcagaagactggccggcgagggcggcgaccccgccctgcccagacccagactgtaccccgccgcccccgccatgcccagccccgacgtggtgtacggcgccctgcccccccccggctgcgaccccagcggcctgggcgaggccctgcccgcccagagcagacccagccccttcagacccgccgcccccaaggccggcccccccggcctggtgcaccccctgttcagccccagccacctgaccagcaagacccccccccccctgtacctgcccaccgagggcagaagaagcgacctgcccggcggcctggccggccccagaggcggcctgaacaccagcagaagcctgtacagcggcctgcagaacccctgcagcaccgccacccccggcccccccctgggcagcttccccttcctgcccggcggcccccccgtgggcgccgaggcctgggccagaagagtgccccagcccgccgccccccccagaagacccccccagagcgccagcagcctgagcgccagcctgagaccccccggcgcccccgccaccttcctgagacccagccccatcccctgcagcagccccggcccctggcagagcctgtgcggcctgggccccccctgcgccggctgcccctggcccaccgccggccccggcagaagaagccccggcggcaccagccccgagagaagccccggcaccgccagagccagaggcgaccccaccagcctgcaggccagcagcgagaagacccagcagtag

SEQ ID NO: 89912 - DNA, 1392 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggaggccctgaacaagaaggagaacaagggctgcgagagccccgaccccgacagcagctacgccctgacccccagaaccgaggagaagtacaagaagatcaacgaggagttcgacaacatgatcaagagccacaagatccccgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtgaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgcctgcaccagcacccacctgagccagagcagcaacctgagcctgcccagcacccagagcctgaacatcaagagcgagcccgtgagcccccccagagacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89913 - DNA, 1422 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgtgggccacagccccgagagcgaggacaagtacagaaagatcaacgaggacatcgacctgatgatcagcagacagagactgtgcgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtgagcgaggacgtggacctgctgctgaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgcctgcaccagcacccacctgagccagagcagcaacctgagcctgcccagcacccagagcctgaacatcaagagcgagcccgtgagcccccccagagacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89914 - DNA, 297 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagctag

SEQ ID NO: 89915 - DNA, 390 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgtgggccacagccccgagagcgaggacaagtacagaaagatcaacgaggacatcgacctgatgatcagctag

SEQ ID NO: 89916 - DNA, 264 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagacctag

SEQ ID NO: 89917 - DNA, 1422 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgtgggccacagccccgagagcgaggacaagtacagaaagatcaacgaggacatcgacctgatgatcagcagacagagactgtgcgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtggtgatccagaactacatcctgaagaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgcctgcaccagcacccacctgagccagagcagcaacctgagcctgcccagcacccagagcctgaacatcaagagcgagcccgtgagcccccccagagacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89918 - DNA, 684 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggaggccctgaacaagaaggagaacaagggctgcgagagccccgaccccgacagcagctacgccctgacccccagaaccgaggagaagtacaagaagatcaacgaggagttcgacaacatgatcaagagccacaagatccccgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagcccctag

SEQ ID NO: 89919 - DNA, 363 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggaggccctgaacaagaaggagaacaagggctgcgagagccccgaccccgacagcagctacgccctgacccccagaaccgaggagaagtacaagaagatcaacgagtag

SEQ ID NO: 89920 - DNA, 381 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgtgggccacagccccgagagcgaggacaagtacagaaagatcaacgaggacatcgacctgtag

SEQ ID NO: 89921 - DNA, 87 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgtag

SEQ ID NO: 89922 - DNA, 1398 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgtgggccacagccccgagagcgaggacaagtacagaaagatcaacgaggacatcgacctgatgatcagcagacagagactgtgcgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtgaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgcctgcaccagcacccacctgagccagagcagcaacctgagcctgcccagcacccagagcctgaacatcaagagcgagcccgtgagcccccccagagacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89923 - DNA, 729 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggaggccctgaacaagaaggagaacaagggctgcgagagccccgaccccgacagcagctacgccctgacccccagaaccgaggagaagtacaagaagatcaacgaggagttcgacaacatgatcaagagccacaagatccccgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgtag

SEQ ID NO: 89924 - DNA, 1326 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgtgggccacagccccgagagcgaggacaagtacagaaagatcaacgaggacatcgacctgatgatcagcagacagagactgtgcgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtgagcgaggacgtggacctgctgctgaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89925 - DNA, 1422 bp, Artificial Sequence; identical to SEQ ID NO: 89913
  Description of Artificial Sequence: Synthetic coding sequence

SEQ ID NO: 89926 - DNA, 1254 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggaggccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtgaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgcctgcaccagcacccacctgagccagagcagcaacctgagcctgcccagcacccagagcctgaacatcaagagcgagcccgtgagcccccccagagacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89927 - DNA, 1452 bp, Artificial Sequence
  Description of Artificial Sequence: Synthetic coding sequence
atgggcagaaagaagatccagatcaccagaatcatggacgagagaaacagacaggtgaccttcaccaagagaaagttcggcctgatgaagaaggcctacgagctgagcgtgctgtgcgactgcgagatcgccctgatcatcttcaacagcaccaacaagctgttccagtacgccagcaccgacatggacaaggtgctgctgaagtacaccgagtacaacgagccccacgagagcagaaccaacagcgacatcgtggagaccctgagaaagaagggcctgaacggctgcgacagccccgaccccgacgccgacgacagcgccctgaacaagaaggagaacaagggctgcgagagccccgaccccgacagcagctacgccctgacccccagaaccgaggagaagtacaagaagatcaacgaggagttcgacaacatgatcaagagccacaagatccccgccgtgcccccccccaacttcgagatgcccgtgagcatccccgtgagcagccacaacagcctggtgtacagcaaccccgtgagcagcctgggcaaccccaacctgctgcccctggcccaccccagcctgcagagaaacagcatgagccccggcgtgacccacagaccccccagcgccggcaacaccggcggcctgatgggcggcgacctgaccagcggcgccggcaccagcgccggcaacggctacggcaaccccagaaacagccccggcctgctggtgagccccggcaacctgaacaagaacatgcaggccaagagccccccccccatgaacctgggcatgaacaacagaaagcccgacctgagagtgctgatcccccccggcagcaagaacaccatgcccagcgtgaaccagagaatcaacaacagccagagcgcccagagcctggccacccccgtggtgagcgtggccacccccaccctgcccggccagggcatgggcggctaccccagcgccatcagcaccacctacggcaccgagtacagcctgagcagcgccgacctgagcagcctgagcggcttcaacaccgccagcgccctgcacctgggcagcgtgaccggctggcagcagcagcacctgcacaacatgccccccagcgccctgagccagctgggcgcctgcaccagcacccacctgagccagagcagcaacctgagcctgcccagcacccagagcctgaacatcaagagcgagcccgtgagcccccccagagacagaaccaccacccccagcagatacccccagcacaccagacacgaggccggcagaagccccgtggacagcctgagcagctgcagcagcagctacgacggcagcgacagagaggaccacagaaacgagttccacagccccatcggcctgaccagacccagccccgacgagagagagagccccagcgtgaagagaatgagactgagcgagggctgggccacctag

SEQ ID NO: 89928 - DNA, 1563 bp, Artificial Sequence
  Description of Artificial Sequence: Synthetic coding sequence
atgggcagaaagaagatccagatccagagaatcaccgacgagagaaacagacaggtgaccttcaccaagagaaagttcggcctgatgaagaaggcctacgagctgagcgtgctgtgcgactgcgagatcgccctgatcatcttcaaccacagcaacaagctgttccagtacgccagcaccgacatggacaaggtgctgctgaagtacaccgagtacaacgagccccacgagagcagaaccaacgccgacatcatcgaggccctgcacaagaagcacagagagtgcgagagccccgaggtggacgaggtgttcgccctgaccccccagaccgaggagaagtacaagaagatcgacgaggagttcgacaagatgatgcagagctacagactggccagcaccgtgcccgcccccaacttcgccatgcccgtgaccgtgcccgtgagcaaccagagcagcctgcagttcagcaaccccagcggcagcctggtgacccccagcctggtgaccagcagcctgaccgaccccagactgctgagcccccagcagcccgccctgcagagaaacagcgtgagccccggcctgccccagagacccgccagcgccggcgccatgctgggcggcgacctgaacagcgccaacggcgcctgccccagccccgtgggcaacggctacgtgagcgccagagccagccccggcctgctgcccgtggccaacggcaacagcctgaacaaggtgatccccgccaagagcccccccccccccacccacagcacccagctgggcgcccccagcagaaagcccgacctgagagtgatcaccagccaggccggcaagggcctgatgcaccacctgaccgaggaccacctggacctgaacaacgcccagagactgggcgtgagccagagcacccacagcctgaccacccccgtggtgagcgtggccacccccagcctgctgagccagggcctgcccttcagcagcatgcccaccgcctacaacaccgactaccagctgaccagcgccgagctgagcagcctgcccgccttcagcagccccggcggcctgagcctgggcaacgtgaccgcctggcagcagccccagcagccccagcagccccagcagccccagcccccccagcagcagcccccccagccccagcagccccagccccagcagccccagcagccccagcagcccccccagcagcagagccacctggtgcccgtgagcctgagcaacctgatccccggcagccccctgccccacgtgggcgccgccctgaccgtgaccacccacccccacatcagcatcaagagcgagcccgtgagccccagcagagagagaagccccgccccccccccccccgccgtgttccccgccgccagacccgagcccggcgacggcctgagcagccccgccggcggcagctacgagaccggcgacagagacgacggcagaggcgacttcggccccaccctgggcctgctgagacccgcccccgagcccgaggccgagggcagcgccgtgaagagaatgagactggacacctggaccctgaagtag

SEQ ID NO: 89929 - DNA, 1566 bp, Artificial Sequence
  Description of Artificial Sequence: Synthetic coding sequence
atgggcagaaagaagatccagatccagagaatcaccgacgagagaaacagacaggtgaccttcaccaagagaaagttcggcctgatgaagaaggcctacgagctgagcgtgctgtgcgactgcgagatcgccctgatcatcttcaaccacagcaacaagctgttccagtacgccagcaccgacatggacaaggtgctgctgaagtacaccgagtacaacgagccccacgagagcagaaccaacgccgacatcatcgagaccctgagaaagaagggcttcaacggctgcgacagccccgagcccgacggcgaggacagcctggagcagagccccctgctggaggacaagtacagaagagccagcgaggagctggacggcctgttcagaagatacggcagcaccgtgcccgcccccaacttcgccatgcccgtgaccgtgcccgtgagcaaccagagcagcctgcagttcagcaaccccagcggcagcctggtgacccccagcctggtgaccagcagcctgaccgaccccagactgctgagcccccagcagcccgccctgcagagaaacagcgtgagccccggcctgccccagagacccgccagcgccggcgccatgctgggcggcgacctgaacagcgccaacggcgcctgccccagccccgtgggcaacggctacgtgagcgccagagccagccccggcctgctgcccgtggccaacggcaacagcctgaacaaggtgatccccgccaagagcccccccccccccacccacagcacccagctgggcgcccccagcagaaagcccgacctgagagtgatcaccagccaggccggcaagggcctgatgcaccacctgaccgaggaccacctggacctgaacaacgcccagagactgggcgtgagccagagcacccacagcctgaccacccccgtggtgagcgtggccacccccagcctgctgagccagggcctgcccttcagcagcatgcccaccgcctacaacaccgactaccagctgaccagcgccgagctgagcagcctgcccgccttcagcagccccggcggcctgagcctgggcaacgtgaccgcctggcagcagccccagcagccccagcagccccagcagccccagcccccccagcagcagcccccccagccccagcagccccagccccagcagccccagcagccccagcagcccccccagcagcagagccacctggtgcccgtgagcctgagcaacctgatccccggcagccccctgccccacgtgggcgccgccctgaccgtgaccacccacccccacatcagcatcaagagcgagcccgtgagccccagcagagagagaagccccgccccccccccccccgccgtgttccccgccgccagacccgagcccggcgacggcctgagcagccccgccggcggcagctacgagaccggcgacagagacgacggcagaggcgacttcggccccaccctgggcctgctgagacccgcccccgagcccgaggccgagggcagcgccgtgaagagaatgagactggacacctggaccctgaagtag

SEQ ID NO: 89930 - DNA, 1428 bp, Artificial Sequence
  Description of Artificial Sequence: Synthetic coding sequence
atgggcagaaagaagatccagatccagagaatcaccgacgagagaaacagacaggtgaccttcaccaagagaaagttcggcctgatgaagaaggcctacgagctgagcgtgctgtgcgactgcgagatcgccctgatcatcttcaaccacagcaacaagctgttccagtacgccagcaccgacatggacaaggtgctgctgaagtacaccgagtacaacgagccccacgagagcagaaccaacgccgacatcatcgagagcaccgtgcccgcccccaacttcgccatgcccgtgaccgtgcccgtgagcaaccagagcagcctgcagttcagcaaccccagcggcagcctggtgacccccagcctggtgaccagcagcctgaccgaccccagactgctgagcccccagcagcccgccctgcagagaaacagcgtgagccccggcctgccccagagacccgccagcgccggcgccatgctgggcggcgacctgaacagcgccaacggcgcctgccccagccccgtgggcaacggctacgtgagcgccagagccagccccggcctgctgcccgtggccaacggcaacagcctgaacaaggtgatccccgccaagagcccccccccccccacccacagcacccagctgggcgcccccagcagaaagcccgacctgagagtgatcaccagccaggccggcaagggcctgatgcaccacctgaccgaggaccacctggacctgaacaacgcccagagactgggcgtgagccagagcacccacagcctgaccacccccgtggtgagcgtggccacccccagcctgctgagccagggcctgcccttcagcagcatgcccaccgcctacaacaccgactaccagctgaccagcgccgagctgagcagcctgcccgccttcagcagccccggcggcctgagcctgggcaacgtgaccgcctggcagcagccccagcagccccagcagccccagcagccccagcccccccagcagcagcccccccagccccagcagccccagccccagcagccccagcagccccagcagcccccccagcagcagagccacctggtgcccgtgagcctgagcaacctgatccccggcagccccctgccccacgtgggcgccgccctgaccgtgaccacccacccccacatcagcatcaagagcgagcccgtgagccccagcagagagagaagccccgccccccccccccccgccgtgttccccgccgccagacccgagcccggcgacggcctgagcagccccgccggcggcagctacgagaccggcgacagagacgacggcagaggcgacttcggccccaccctgggcctgctgagacccgcccccgagcccgaggccgagggcagcgccgtgaagagaatgagactggacacctggaccctgaagtag

SEQ ID NO: 89931 - DNA, 1545 bp, Artificial Sequence
  Description of Artificial Sequence: Synthetic coding sequence
atgggcagaaagaagatccagatccagagaatcaccgacgagagaaacagacaggtgaccttcaccaagagaaagttcggcctgatgaagaaggcctacgagctgagcgtgctgtgcgactgcgagatcgccctgatcatcttcaaccacagcaacaagctgttccagtacgccagcaccgacatggacaaggtgctgctgaagtacaccgagtacaacgagccccacgagagcagaaccaacgccgacatcatcgagaccctgagaaagaagggcttcaacggctgcgacagccccgagcccgacggcgaggacagcctggagcagagccccctgctggaggacaagtacagaagagccagcgaggagctggacggcctgttcagaagatacggcagcaccgtgcccgcccccaacttcgccatgcccgtgaccgtgcccgtgagcaaccagagcagcctgcagttcagcaaccccagcggcagcctggtgacccccagcctggtgaccagcagcctgaccgaccccagactgctgagcccccagcagcccgccctgcagagaaacagcgtgagccccggcctgccccagagacccgccagcgccggcgccatgctgggcggcgacctgaacagcgccaacggcgcctgccccagccccgtgggcaacggctacgtgagcgccagagccagccccggcctgctgcccgtggccaacggcaacagcctgaacaaggtgatccccgccaagagcccccccccccccacccacagcacccagctgggcgcccccagcagaaagcccgacctgagagtgatcaccagccaggccggcaagggcctgatgcaccacctgaacaacgcccagagactgggcgtgagccagagcacccacagcctgaccacccccgtggtgagcgtggccacccccagcctgctgagccagggcctgcccttcagcagcatgcccaccgcctacaacaccgactaccagctgaccagcgccgagctgagcagcctgcccgccttcagcagccccggcggcctgagcctgggcaacgtgaccgcctggcagcagccccagcagccccagcagccccagcagccccagcccccccagcagcagcccccccagccccagcagccccagccccagcagccccagcagccccagcagcccccccagcagcagagccacctggtgcccgtgagcctgagcaacctgatccccggcagccccctgccccacgtgggcgccgccctgaccgtgaccacccacccccacatcagcatcaagagcgagcccgtgagccccagcagagagagaagccccgccccccccccccccgccgtgttccccgccgccagacccgagcccggcgacggcctgagcagccccgccggcggcagctacgagaccggcgacagagacgacggcagaggcgacttcggccccaccctgggcctgctgagacccgcccccgagcccgaggccgagggcagcgccgtgaagagaatgagactggacacctggaccctgaagtag

SEQ ID NO: 89932 - DNA, 1545 bp, Artificial Sequence; identical to SEQ ID NO: 89931
  Description of Artificial Sequence: Synthetic coding sequence

SEQ ID NO: 89933 - DNA, 1533 bp, Artificial Sequence
  Description of Artificial Sequence: Synthetic coding sequence
atgggcagaaagaagatccagatccagagaatcaccgacgagagaaacagacaggtgaccttcaccaagagaaagttcggcctgatgaagaaggcctacgagctgagcgtgctgtgcgactgcgagatcgccctgatcatcttcaaccacagcaacaagctgttccagtacgccagcaccgacatggacaaggtgctgctgaagtacaccgagtacaacgagccccacgagagcagaaccaacgccgacatcatcgaggccctgcacaagaagcacagagagtgcgagagccccgaggtggacgaggtgttcgccctgaccccccagaccgaggagaagtacaagaagatcgacgaggagttcgacaagatgatgcagagctacagactggccagcaccgtgcccgcccccaacttcgccatgcccgtgaccgtgcccgtgagcaaccagagcagcctgcagttcagcaaccccagcggcagcctggtgacccccagcctggtgaccagcagcctgaccgaccccagactgctgagcccccagcagcccgccctgcagagaaacagcgtgagccccggcctgccccagagacccgccagcgccggcgccatgctgggcggcgacctgaacagcgccaacggcgcctgccccagccccgtgggcaacggctacgtgagcgccagagccagccccggcctgctgcccgtggccaacggcaacagcctgaacaaggtgatccccgccaagagcccccccccccccacccacagcacccagctgggcgcccccagcagaaagcccgacctgagagtgatcaccagccaggccggcaagggcctgatgcaccacctgaacaacgcccagagactgggcgtgagccagagcacccacagcctgaccacccccgtggtgagcgtggccacccccagcctgctgagccagggcctgcccttcagcagcatgcccaccgcctacaacaccgactaccagctgaccagcgccgagctgagcagcctgcccgccttcagcagccccggcggcctgagcctgggcaacgtgaccgcctggcagcagccccagcagccccagcagccccagcagccccagcccccccagcagcagcccccccagccccagcagccccagccccagcagccccagcagccccagcagcccccccagcagcagagccacctggtgcccgtgagcctgagcaacctgatccccggcagccccctgccccacgtgggcgccgccctgaccgtgaccacccacccccacatcagcatcaagagcgagcccgtgagccccagcagagagagaagccccgccccccccccccccgccgtgttccccgccgccagacccgagcccggcgacggcctgagcagccccgccggcggcagctacgagaccggcgacagagacgacggcagaggcgacttcggccccaccctgggcctgctgagacccgcccccgagcccgaggccgagggcagcgccgtgaagagaatgagactggacacctggtag

SEQ ID NO: 89934 - DNA, 420 bp, Artificial Sequence
  Description of Artificial Sequence: Synthetic coding sequence
atgggcagaaagaagatccagatccagagaatcaccgacgagagaaacagacaggtgaccttcaccaagagaaagttcggcctgatgaagaaggcctacgagctgagcgtgctgtgcgactgcgagatcgccctgatcatcttcaaccacagcaacaagctgttccagtacgccagcaccgacatggacaaggtgctgctgaagtacaccgagtacaacgagccccacgagagcagaaccaacgccgacatcatcgagaccctgagaaagaagggcttcaacggctgcgacagccccgagcccgacggcgaggacagcctggagcagagccccctgctggaggacaagtacagaagagccagcgaggagctggacggcctgttcagaagatacggcggcccctgctggggcgtgacctag

SEQ ID NO: 89935 - DNA, 1410 bp, Artificial Sequence
  Description of Artificial Sequence: Synthetic coding sequence
atggccgaggagagagagcccgagctgtacctgaagtggaagcactgcgagacccccggcgtgaagaccctgtgcaacctgaagcactgcgagacccccggcgtgaagaccctgtgcaacctgaagaagctgctgaacagactgcagaaggaccacagagaggacgtgtacctgtacatcagcggccacctgaaccccaacaagctgtaccagccccccgagaccatcctgcagcactggcccaacgcccacagacccaagggcgagagagccagcgaggtgggcgagccccccgccggcaaggtggccagaatgaaggaggccctggcccacttcaccatccacaccgccctggtgcccagcgaggcccaggacacccccctgttcagatacctgaacccccaggccagcctgagccacaccagcgaggaggacttcctgcccgtggaggccgtgagagagggcaaggaggagaagaagggcggcccccccggcagaggcccccccggctggagaagaagagaggagctgagactgcccgacctgaaggtgctgtgctaccaggaggccggcagcagaggcaccagagacagacaccactacgtgagcagctacctggccggcgccaccagcgccgacagatacagaatgttcctgagattccagaaggaggtgctggccaagcaggacctgctgaagaacgacttcaccggcagcaaggccgccgccggccacgagagaaagctgcagcaggagctgcagaagatctgcacctgcagcccccagcagttcaacagactgcacgtgttcggcaaggtgttcgaggacatctgcaacagcagcctgatcttcggcgacctgctgaagaaggtgaaggacgagtacgagctgtacatggccaccctgctggagagccagcccgccgcccagtacgaggccctgctggcccagctgaaggccctgggccagagacccgtgaagaccgccgacatggacctggccagagaggagctgagaatgctggtgaccgccaccaaggccgccctggagcagaacgacagactgagaagcgagctggagatggaggtggccctgctgcagagcgccaaggagagaagcgagagcagcgagaagcacatcatcgacgagaacagactgaccctgaccgagaaggtggagaagaagagatgcgagatcctgagcaagtgggacgagatccaggccctggagaaggagatcaagaccaccctggtgcacaccggcatcagcgacatcaccgagaacagaatcaagagcatcgagcacgaggccatccagctggagaccgagaacatgatcctgaagaagaagatcaagggccccctggagatctaccagggcatctgcaagatcagaggcaacagaagatag

SEQ ID NO: 89936 - DNA, 741 bp, Artificial Sequence
  Description of Artificial Sequence: Synthetic coding sequence
atgtaccaggtgagcggccagagacccagcggctgcgacgccccctacggcgcccccagcgccgcccccggccccgcccagaccctgagcctgctgcccggcctggaggtggtgaccggcagcacccaccccgccgaggccgcccccgaggagggcagcctggaggaggccgccacccccatgccccagggcaacggccccggcatcccccagggcctggacagcaccgacctggacgtgcccaccgaggccgtgacctgccagccccagggcaaccccctgggctgcacccccctgctgcccaacgacagcggccaccccagcgagctgggcggcaccagaagagccggcaacggcgccctgggcggccccaaggcccacagaaagctgcagacccaccccagcctggccagccagggcagcaagaagagcaagagcagcagcaagagcaccaccagccagatccccctgcaggcccaggaggactgctgcgtgcactgcatcctgagctgcctgttctgcgagttcctgaccctgtgcaacatcgtgctggactgcgccacctgcggcagctgcagcagcgaggacagctgcctgtgctgctgctgctgcggcagcggcgagtgcgccgactgcgacctgccctgcgacctggactgcggcatcctggacgcctgctgcgagagcgccgactgcctggagatctgcatggagtgctgcggcctgtgcttcagcagctag

SEQ ID NO: 89937 - DNA, 696 bp, Artificial Sequence
  Description of Artificial Sequence: Synthetic coding sequence
atgtaccaggtgagcggccagagacccagcggctgcgacgccccctacggcgcccccagcgccgcccccggccccgcccagaccctgagcctgctgcccggcctggaggtggtgaccggcagcacccaccccgccgaggccgcccccgaggagggcagcctggaggaggccgccacccccatgccccagggcaacggccccggcatcccccagggcctggacagcaccgacctggacgtgcccaccgaggccgtgacctgccagccccagggcaaccccctgggctgcacccccctgctgcccaacgacagcggccaccccagcgagctgggcggcaccagaagagccggcaacggcgccctgggcggccccaaggcccacagaaagctgcagacccaccccagcctggccagccagggcagcaagaagagcaagagcagcagcaagagcaccaccagccagatccccctgcaggcccaggaggactgctgcgtgcactgcatcctgagctgcctgttctgcgagttcctgaccctgtgcaacatcgtgctggactgcgccacctgcggcagctgcagcagcgaggacagctgcctgtgctgctgctgctgcggcagcggcgagtgcgccgactgcgacctgccctgcgacctggactgcggcatcctggacgcctgctgcgagagcgccgactag

SEQ ID NO: 89938 - DNA, 642 bp, Artificial Sequence
  Description of Artificial Sequence: Synthetic coding sequence
atgtaccaggtgagcggccagagacccagcggctgcgacgccccctacggcgcccccagcgccgcccccggccccgcccagaccctgagcctgctgcccggcctggaggtggtgaccggcagcacccaccccgccgaggccgcccccgaggagggcagcctggaggaggccgccacccccatgccccagggcaacggccccggcatcccccagggcctggacagcaccgacctggacgtgcccaccgaggccgtgacctgccagccccagggcaaccccctgggctgcacccccctgctgcccaacgacagcggccaccccagcgagctgggcggcaccagaagagccggcaacggcgccctgggcggccccaaggcccacagaaagctgcagacccaccccagcctggccagccagggcagcaagaagagcaagagcagcagcaagagcaccaccagccagatccccctgcaggcccaggaggactgctgcgtgcactgcatcctgagctgcctgttctgcgagttcctgaccctgtgcaacatcgtgctggactgcgccacctgcggcagctgcagcagcgaggacagctgcctgtgctgctgctgctgcggcagcggcgagtgcgccgactgcgactag

SEQ ID NO: 89939 - DNA, 297 bp, Artificial Sequence
  Description of Artificial Sequence: Synthetic coding sequence
atgtaccaggtgagcggccagagacccagcggctgcgacgccccctacggcgcccccagcgccgcccccggccccgcccagaccctgagcctgctgcccggcctggaggtggtgaccggcagcacccaccccgccgaggccgcccccgaggagggcagcctggaggaggccgccacccccatgccccagggcaacggccccggcatcccccagggcctggacagcaccgacctggacgtgcccaccgaggccgtgacctgccagccccagggcaaccccctgggctgcaccccctag

SEQ ID NO: 89940 - DNA, 387 bp, Artificial Sequence
  Description of Artificial Sequence: Synthetic coding sequence
atgtaccaggtgagcggccagagacccagcggctgcgacgccccctacggcgcccccagcgccgcccccggccccgcccagaccctgagcctgctgcccggcctggaggtggtgaccggcagcacccaccccgccgaggccgcccccgaggagggcagcctggaggaggccgccacccccatgccccagggcaacggccccggcatcccccagggcctggacagcaccgacctggacgtgcccaccgaggccgtgacctgccagccccagggcaaccccctgggctgcacccccctgctgcccaacgacagcggccaccccagcgagctgggcggcaccagaagagccggcaacggcgccctgggcggccccaaggcccacagatag

SEQ ID NO: 89941 - DNA, 741 bp, Artificial Sequence; identical to SEQ ID NO: 89936
  Description of Artificial Sequence: Synthetic coding sequence

SEQ ID NO: 89942 - DNA, 729 bp, Artificial Sequence
  Description of Artificial Sequence: Synthetic coding sequence
atgatgatggacctgttcgagaccggcagctacttcttctacctggacggcgagaacgtgaccctgcagcccctggaggtggccgagggcagccccctgtaccccggcagcgacggcaccctgagcccctgccaggaccagatgccccccgaggccggcagcgacagcagcggcgaggagcacgtgctggccccccccggcctgcagcccccccactgccccggccagtgcctgatctgggcctgcaagacctgcaagagaaagagcgcccccaccgacagaagaaaggccgccaccctgagagagagaagaagactgaagaagatcaacgaggccttcgaggccctgaagagaagaaccgtggccaaccccaaccagagactgcccaaggtggagatcctgagaagcgccatcagctacatcgagagactgcaggacctgctgcacagactggaccagcaggagaagatgcaggagctgggcgtggaccccttcagctacagacccaagcaggagaacctggagggcgccgacttcctgagaacctgcagcagccagtggcccagcgtgagcgaccacagcagaggcctggtgatcaccgccaaggagggcggcgccagcatcgacagcagcgccagcagcagcctgagatgcctgagcagcatcgtggacagcatcagcagcgaggagagaaagctgccctgcgtggaggaggtggtggagaagtag

SEQ ID NO: 89943 - DNA, 1527 bp, Artificial Sequence
  Description of Artificial Sequence: Synthetic coding sequence
atgacccagaccctgaagtacgccagcagagtgttccacagagtgagatgggcccccgagctgggcgccagcctgggctacagagagtaccacagcgccagaagaagcctggccgacatccccggccccagcacccccagcttcctggccgagctgttctgcaagggcggcctgagcagactgcacgagctgcaggtgcagggcgccgcccacttcggccccgtgtggctggccagcttcggcaccgtgagaaccgtgtacgtggccgcccccgccctggtggaggagctgctgagacaggagggccccagacccgagagatgcagcttcagcccctggaccgagcacagaagatgcagacagagagcctgcggcctgctgaccgccgagggcgaggagtggcagagactgagaagcctgctggcccccctgctgctgagaccccaggccgccgccagatacgccggcaccctgaacaacgtggtgtgcgacctggtgagaagactgagaagacagagaggcagaggcaccggcccccccgccctggtgagagacgtggccggcgagttctacaagttcggcctggagggcatcgccgccgtgctgctgggcagcagactgggctgcctggaggcccaggtgccccccgacaccgagaccttcatcagagccgtgggcagcgtgttcgtgagcaccctgctgaccatggccatgccccactggctgagacacctggtgcccggcccctggggcagactgtgcagagactgggaccagatgttcgccttcgcccagagacacgtggagagaagagaggccgaggccgccatgagaaacggcggccagcccgagaaggacctggagagcggcgcccacctgacccacttcctgttcagagaggagctgcccgcccagagcatcctgggcaacgtgaccgagctgctgctggccggcgtggacaccgtgagcaacaccctgagctgggccctgtacgagctgagcagacaccccgaggtgcagaccgccctgcacagcgagatcaccgccgccctgagccccggcagcagcgcctaccccagcgccaccgtgctgagccagctgcccctgctgaaggccgtggtgaaggaggtgctgagactgtaccccgtggtgcccggcaacagcagagtgcccgacaaggacatccacgtgggcgactacatcatccccaagaacaccctggtgaccctgtgccactacgccaccagcagagaccccgcccagttccccgagcccaacagcttcagacccgccagatggctgggcgagggccccaccccccaccccttcgccagcctgcccttcggcttcggcaagagaagctgcatgggcagaagactggccgagctggagctgcagatggccctggcccagatcctgacccacttcgaggtgcagcccgagcccggcgccgcccccgtgagacccaagaccagaaccgtgctggtgcccgagagaagcatcaacctgcagttcctggacagatag

SEQ ID NO: 89944 - DNA, 675 bp, Artificial Sequence
  Description of Artificial Sequence: Synthetic coding sequence
atggagctgtacgagaccagcccctacttctaccaggagcccagattctacgacggcgagaactacctgcccgtgcacctgcagggcttcgagccccccggctacgagagaaccgagctgaccctgagccccgaggcccccggccccctggaggacaagggcctgggcacccccgagcactgccccggccagtgcctgccctgggcctgcaaggtgtgcaagagaaagagcgtgagcgtggacagaagaagagccgccaccctgagagagaagagaagactgaagaaggtgaacgaggccttcgaggccctgaagagaagcaccctgctgaaccccaaccagagactgcccaaggtggagatcctgagaagcgccatccagtacatcgagagactgcaggccctgctgagcagcctgaaccaggaggagagagacctgagatacagaggcggcggcggcccccagcccggcgtgcccagcgagtgcagcagccacagcgccagctgcagccccgagtggggcagcgccctggagttcagcgccaaccccggcgaccacctgctgaccgccgaccccaccgacgcccacaacctgcacagcctgaccagcatcgtggacagcatcaccgtggaggacgtgagcgtggccttccccgacgagaccatgcccaactag

SEQ ID NO: 89945 - DNA, 465 bp, Artificial Sequence
  Description of Artificial Sequence: Synthetic coding sequence
atgggcctgagcgacggcgagtggcagctggtgctgaacgtgtggggcaaggtggaggccgacatccccggccacggccaggaggtgctgatcagactgttcaagggccaccccgagaccctggagaagttcgacaagttcaagcacctgaagagcgaggacgagatgaaggccagcgaggacctgaagaagcacggcgccaccgtgctgaccgccctgggcggcatcctgaagaagaagggccaccacgaggccgagatcaagcccctggcccagagccacgccaccaagcacaagatccccgtgaagtacctggagttcatcagcgagtgcatcatccaggtgctgcagagcaagcaccccggcgacttcggcgccgacgcccagggcgccatgaacaaggccctggagctgttcagaaaggacatggccagcaactacaaggagctgggcttccagggctag

SEQ ID NO: 89946 - DNA, 465 bp, Artificial Sequence; identical to SEQ ID NO: 89945
  Description of Artificial Sequence: Synthetic coding sequence

SEQ ID NO: 89947 - DNA, 465 bp, Artificial Sequence; identical to SEQ ID NO: 89945
  Description of Artificial Sequence: Synthetic coding sequence

SEQ ID NO: 89948 - DNA, 465 bp, Artificial Sequence; identical to SEQ ID NO: 89945
  Description of Artificial Sequence: Synthetic coding sequence

SEQ ID NO: 89949 - DNA, 234 bp, Artificial Sequence
  Description of Artificial Sequence: Synthetic coding sequence
atgggcctgagcgacggcgagtggcagctggtgctgaacgtgtggggcaaggtggaggccgacatccccggccacggccaggaggtgctgatcagactgttcaagggccaccccgagaccctggagaagttcgacaagttcaagcacctgaagagcgaggacgagatgaaggccagcgaggacctgaagaagcacggcgccaccgtgctgaccgccctgggcggcatcctgtag

SEQ ID NO: 89950 - DNA, 432 bp, Artificial Sequence
  Description of Artificial Sequence: Synthetic coding sequence
atgggcctgagcgacggcgagtggcagctggtgctgaacgtgtggggcaaggtggaggccgacatccccggccacggccaggaggtgctgatcagactgttcaagggccaccccgagaccctggagaagttcgacaagttcaagcacctgaagagcgaggacgagatgaaggccagcgaggacctgaagaagcacggcgccaccgtgctgaccgccctgggcggcatcctgaagaagaagggccaccacgaggccgagatcaagcccctggcccagagccacgccaccaagcacaagatccccgtgaagtacctggagttcatcagcgagtgcatcatccaggtgctgcagagcaagcaccccggcgacttcggcgccgacgcccagggcgccatgaacaaggccctggagctgttcagaaaggacatgtag

SEQ ID NO: 89951 - DNA, 321 bp, Artificial Sequence
  Description of Artificial Sequence: Synthetic coding sequence
atgggcctgagcgacggcgagtggcagctggtgctgaacgtgtggggcaaggtggaggccgacatccccggccacggccaggaggtgctgatcagactgttcaagggccaccccgagaccctggagaagttcgacaagttcaagcacctgaagagcgaggacgagatgaaggccagcgaggacctgaagaagcacggcgccaccgtgctgaccgccctgggcggcatcctgaagaagaagggccaccacgaggccgagatcaagcccctggcccagagccacgccaccaagcacaagatccccgtgaagtacctggagtag

SEQ ID NO: 89952 - DNA, 321 bp, Artificial Sequence; identical to SEQ ID NO: 89951
  Description of Artificial Sequence: Synthetic coding sequence

SEQ ID NO: 89953 - DNA, 411 bp, Artificial Sequence
  Description of Artificial Sequence: Synthetic coding sequence
atggccgtgggcgccgagagactgggcgaggtgctgatcagactgttcaagggccaccccgagaccctggagaagttcgacaagttcaagcacctgaagagcgaggacgagatgaaggccagcgaggacctgaagaagcacggcgccaccgtgctgaccgccctgggcggcatcctgaagaagaagggccaccacgaggccgagatcaagcccctggcccagagccacgccaccaagcacaagatccccgtgaagtacctggagttcatcagcgagtgcatcatccaggtgctgcagagcaagcaccccggcgacttcggcgccgacgcccagggcgccatgaacaaggccctggagctgttcagaaaggacatggccagcaactacaaggagctgggcttccagggctag

SEQ ID NO: 89954 - DNA, 4398 bp, Artificial Sequence
  Description of Artificial Sequence: Synthetic coding sequence
atgagcctggtgaccgtgcccttctaccagaagagacacagacacttcgaccagagctacagaaacatccagaccagatacctgctggacgagtacgccagcaagaagagagccagcacccaggccagcagccagaagagcctgagccagagaagcagcagccagagagccagcagccagaccagcctgggcggcaccatctgcagagtgtgcgccaagagagtgagcacccaggaggacgaggagcaggagaacagaagcagataccagagcctggtggccgcctacggcgaggccaagagacagagattcctgagcgagctggcccacctggaggaggacgtgcacctggccagaagccaggccagagacaagctggacaagtacgccatccagcagatgatggaggacaagctggcctgggagagacacaccttcgaggagagaatcagcagagcccccgagatcctggtgagactgagaagccacaccgtgtgggagagaatgagcgtgaagctgtgcttcaccgtgcagggcttccccacccccgtggtgcagtggtacaaggacggcagcctgatctgccaggccgccgagcccggcaagtacagaatcgagagcaactacggcgtgcacaccctggagatcaacagagccgacttcgacgacaccgccacctacagcgccgtggccaccaacgcccacggccaggtgagcaccaacgccgccgtggtggtgagaagattcagaggcgacgaggagcccttcagaagcgtgggcctgcccatcggcctgcccctgagcagcatgatcccctacacccacttcgacgtgcagttcctggagaagttcggcgtgaccttcagaagagagggcgagaccgtgaccctgaagtgcaccatgctggtgacccccgacctgaagagagtgcagcccagagccgagtggtacagagacgacgtgctgctgaaggagagcaagtggaccaagatgttcttcggcgagggccaggccagcctgagcttcagccacctgcacaaggacgacgagggcctgtacaccctgagaatcgtgagcagaggcggcgtgagcgaccacagcgccttcctgttcgtgagagacgccgaccccctggtgaccggcgcccccggcgcccccatggacctgcagtgccacgacgccaacagagactacgtgatcgtgacctggaagccccccaacaccaccaccgagagccccgtgatgggctacttcgtggacagatgcgaggtgggcaccaacaactgggtgcagtgcaacgacgcccccgtgaagatctgcaagtaccccgtgaccggcctgttcgagggcagaagctacatcttcagagtgagagccgtgaacagcgccggcatcagcagacccagcagagtgagcgacgccgtggccgccctggaccccctggacctgagaagactgcaggccgtgcacctggagggcgagaaggagatcgccatctaccaggacgacctggagggcgacgcccaggtgcccggcccccccaccggcgtgcacgccagcgagatcagcagaaactacgtggtgctgagctgggagccccccacccccagaggcaaggaccccctgatgtacttcatcgagaagagcgtggtgggcagcggcagctggcagagagtgaacgcccagaccgccgtgagaagccccagatacgccgtgttcgacctgatggagggcaagagctacgtgttcagagtgctgagcgccaacagacacggcctgagcgagcccagcgagatcaccagccccatccaggcccaggacgtgaccgtggtgcccagcgcccccggcagagtgctggccagcagaaacaccaagaccagcgtggtggtgcagtgggacagacccaagcacgaggaggacctgctgggctactacgtggactgctgcgtggccggcaccaacctgtgggagccctgcaaccacaagcccatcggctacaacagattcgtggtgcacggcctgaccaccggcgagcagtacatcttcagagtgaaggccgtgaacgccgtgggcatgagcgagaacagccaggagagcgacgtgatcaaggtgcaggccgccctgaccgtgcccagccacccctacggcatcaccctgctgaactgcgacggccacagcatgaccctgggctggaaggtgcccaagttcagcggcggcagccccatcctgggctactacctggacaagagagaggtgcaccacaagaactggcacgaggtgaacagcagccccagcaagcccaccatcctgaccgtggacggcctgaccgagggcagcctgtacgagttcaagatcgccgccgtgaacctggccggcatcggcgagcccagcgaccccagcgagcacttcaagtgcgaggcctggaccatgcccgagcccggccccgcctacgacctgaccttctgcgaggtgagagacaccagcctggtgatgctgtggaaggcccccgtgtacagcggcagcagccccgtgagcggctacttcgtggacttcagagaggaggacgccggcgagtggatcaccgtgaaccagaccaccaccgccaacagatacctgaaggtgagcgacctgcagcagggcaagacctacgtgttcagagtgagagccgtgaacgccaacggcgtgggcaagcccagcgacaccagcgagcccgtgctggtggaggccagacccggcaccaaggagatcagcgccggcgtggacgagcagggcaacatctacctgggcttcgactgccaggagatgaccgacgccagccagttcacctggtgcaagagctacgaggagatcagcgacgacgagagattcaagatcgagaccgtgggcgaccacagcaagctgtacctgaagaaccccgacaaggaggacctgggcacctacagcgtgagcgtgagcgacaccgacggcgtgagcagcagcttcgtgctggaccccgaggagctggagagactgatggccctgagcaacgagatcaagaaccccaccatccccctgaagagcgagctggcctacgagatcttcgacaagggcagagtgagattctggctgcaggccgagcacctgagccccgacgccagctacagattcatcatcaacgacagagaggtgagcgacagcgagatccacagaatcaagtgcgacaaggccaccggcatcatcgagatggtgatggacagattcagcatcgagaacgagggcacctacaccgtgcagatccacgacggcaaggccaagagccagagcagcctggtgctgatcggcgacgccttcaagaccgtgctggaggaggccgagttccagagaaaggagttcctgagaaagcagggcccccacttcgccgagtacctgcactgggacgtgaccgaggagtgcgaggtgagactggtgtgcaaggtggccaacaccaagaaggagaccgtgttcaagtggctgaaggacgacgtgctgtacgagaccgagaccctgcccaacctggagagaggcatctgcgagctgctgatccccaagctgagcaagaaggaccacggcgagtacaaggccaccctgaaggacgacagaggccaggacgtgagcatcctggagatcgccggcaaggtgtacgacgacatgatcctggccatgagcagagtgtgcggcaagagcgccagccccctgaaggtgctgtgcacccccgagggcatcagactgcagtgcttcatgaagtacttcaccgacgagatgaaggtgaactggtgccacaaggacgccaagatcagcagcagcgagcacatgagaatcggcggcagcgaggagatggcctggctgcagatctgcgagcccaccgagaaggacaagggcaagtacaccttcgagatcttcgacggcaaggacaaccaccagagaagcctggacctgagcggccaggccttcgacgaggccttcgccgagttccagcagttcaaggccgccgccttcgccgagaagaacagaggcagactgatcggcggcctgcccgacgtggtgaccatcatggagggcaagaccctgaacctgacctgcaccgtgttcggcaaccccgaccccgaggtgatctggttcaagaacgaccaggacatccagctgagcgagcacttcagcgtgaaggtggagcaggccaagtacgtgagcatgaccatcaagggcgtgaccagcgaggacagcggcaagtacagcatcaacatcaagaacaagtacggcggcgagaagatcgacgtgaccgtgagcgtgtacaagcacggcgagaagatccccgacatggcccccccccagcaggccaagcccaagctgatccccgccagcgccagcgccgccggccagtag

SEQ ID NO: 89955 - DNA, 3420 bp, Artificial Sequence
  Description of Artificial Sequence: Synthetic coding sequence
atgcccgagcccaccaagaaggaggacgaggaggaggtgagcccccccagcgccctgccccccgactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaagggcggcctgagcttctgcagactgctgctgcagggcgtgccccccaacatcatcgacagctacctgagagacctgcacagcagcaaccccgaggagtactag

SEQ ID NO: 89956 - DNA, 3522 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcagcaccagcgccaagcagagcgacgagaacggcgaggccgcctacgacctgcccgccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatctaccagggcgtgaacacccccggccagcccgtgttcctggagggccagcagcaggtgggcagccccagcgccgacagcagctgcaaggcctacctgcagacctag

SEQ ID NO: 89957 - DNA, 3384 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatctaccagggcgtgaacacccccggccagcccgtgttcctggagggccagcagcagagcctgcacaacaaggacttctag

SEQ ID NO: 89958 - DNA, 3363 bp, Artificial Sequence
  Description of Artificial Sequence: Synthetic coding sequence
atgcccgagcccaccaagaaggaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatctaccagggcgtgaacacccccggccagcccgtgttcctggagggccagcagcagagcctgcacaacaaggacttctag

SEQ ID NO: 89959 - DNA, 3399 bp, Artificial Sequence
  Description of Artificial Sequence: Synthetic coding sequence
atgcccgagcccaccaagaaggaggagaacgaggtgcccgcccccgcccccccccccgaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatctaccagggcgtgaacacccccggccagcccgtgttcctggagggccagcagcagagcctgcacaacaaggacttctag

SEQ ID NO: 89960 - DNA, 3822 bp, Artificial Sequence
  Description of Artificial Sequence: Synthetic coding sequence
atgcccgagcccggcaagaagcccgtgagcgccttcagcaagaagcccagaagcgtggaggtggccgccggcagccccgccgtgttcgaggccgagaccgagagagccggcgtgaaggtgagatggcagagaggcggcagcgacatcagcgccagcaacaagtacggcctggccaccgagggcaccagacacaccctgaccgtgagagaggtgggccccgccgaccagggcagctacgccgtgatcgccggcagcagcaaggtgaagttcgacctgaaggtgatcgaggccgagaaggccgagcccatgctggcccccgcccccgcccccgccgaggccaccggcgcccccggcgaggcccccgcccccgccgccgagctgggcgagagcgcccccagccccaagggcagcagcagcgccgccctgaacggccccacccccggcgcccccgacgaccccatcggcctgttcgtgatgagaccccaggacggcgaggtgaccgtgggcggcagcatcaccttcagcgccagagtggccggcgccagcctgctgaagccccccgtggtgaagtggttcaagggcaagtgggtggacctgagcagcaaggtgggccagcacctgcagctgcacgacagctacgacagagccagcaaggtgtacctgttcgagctgcacatcaccgacgcccagcccgccttcaccggcagctacagatgcgaggtgagcaccaaggacaagttcgactgcagcaacttcaacctgaccgtgcacgaggccatgggcaccggcgacctggacctgctgagcgccttcagaagaaccagcctggccggcggcggcagaagaatcagcgacagccacgaggacaccggcatcctggacttcagcagcctgctgaagaagagcagcagcttcagaacccccagagacagcaagctggaggcccccgccgaggaggacgtgtgggagatcctgagacaggccccccccagcgagtacgagagaatcgccttccagtacggcgtgaccgacctgagaggcatgctgaagagactgaagggcatgagaagagacgagaagaagagcaccgccttccagaagaagctggagcccgcctaccaggtgagcaagggccacaagatcagactgaccgtggagctggccgaccacgacgccgaggtgaagtggctgaagaacggccaggagatccagatgagcggcagatacatcttcgagagcatcggcgccaagagaaccctgaccatcagccagtgcagcctggccgacgacgccgcctaccagtgcgtggtgggcggcgagaagtgcagcaccgagctgttcgtgaaggagccccccgtgctgatcaccagacccctggaggaccagctggtgatggtgggccagagagtggagttcgagtgcgaggtgagcgaggagggcgcccaggtgaagtggctgaaggacggcgtggagctgaccagagaggagaccttcaagtacagattcaagaaggacggccagagacaccacctgatcatcaacgaggccatgctggaggacgccggccactacgccctgtgcaccagcggcggccaggccctggccgagctgatcgtgcaggagaagaagctggaggtgtaccagagcatcgccgacctgatggtgggcgccaaggaccaggccgtgttcaagtgcgaggtgagcgacgagaacgtgagaggcgtgtggctgaagaacggcaaggagctggtgcccgacagcagaatcaaggtgagccacatcggcagagtgcacaagctgaccatcgacgacgtgacccccgccgacgaggccgactacagcttcgtgcccgagggcttcgcctgcaacctgagcgccaagctgcacttcatggaggtgaagatcgacttcgtgcccagacaggagccccccaagatccacctggactgccccggcagaatccccgacaccatcgtggtggtggccggcaacaagctgagactggacgtgcccatcagcggcgaccccgcccccaccgtgatctggcagaaggccatcacccagggcaacaaggcccccgccagacccgcccccgacgcccccgaggacaccggcgacagcgacgagtgggtgttcgacaagaagctgctgtgcgagaccgagggcagagtgagagtggagaccaccaaggacagaagcatcttcaccgtggagggcgccgagaaggaggacgagggcgtgtacaccgtgaccgtgaagaaccccgtgggcgaggaccaggtgaacctgaccgtgaaggtgatcgacgtgcccgacgcccccgccgcccccaagatcagcaacgtgggcgaggacagctgcaccgtgcagtgggagccccccgcctacgacggcggccagcccatcctgggctacatcctggagagaaagaagaagaagagctacagatggatgagactgaacttcgacctgatccaggagctgagccacgaggccagaagaatgatcgagggcgtggtgtacgagatgagagtgtacgccgtgaacgccatcggcatgagcagacccagccccgccagccagcccttcatgcccatcggcccccccagcgagcccacccacctggccgtggaggacgtgagcgacaccaccgtgagcctgaagtggagaccccccgagagagtgggcgccggcggcctggacggctacagcgtggagtactgccccgagggctgcagcgagtgggtggccgccctgcagggcctgaccgagcacaccagcatcctggtgaaggacctgcccaccggcgccagactgctgttcagagtgagagcccacaacatggccggccccggcgcccccgtgaccaccaccgagcccgtgaccgtgcaggagatcctgcagagacccagactgcagctgcccagacacctgagacagaccatccagaagaaggtgggcgagcccgtgaacctgctgatccccttccagggcaagcccagaccccaggtgacctggaccaaggagggccagcccctggccggcgaggaggtgagcatcagaaacagccccaccgacaccatcctgttcatcagagccgccagaagagtgcacagcggcacctaccaggtgaccgtgagaatcgagaacatggaggacaaggccaccctggtgctgcaggtggtggacaagcccagccccccccaggacctgagagtgaccgacgcctggggcctgaacgtggccctggagtggaagcccccccaggacgtgggcaacaccgagctgtggggctacaccgtgcagaaggccgacaagaagaccatggagtggttcaccgtgctggagcactacagaagaacccactgcgtggtgcccgagctgatcatcggcaacggctactacttcagagtgttcagccagaacatggtgggcttcagcgacagagccgccaccaccaaggagcccgtgttcatccccagacccggcatcacctacgagccccccaactacaaggccctggacttcagcgaggcccccagcttcacccagcccctggtgaacagaagcgtgatcgccggctacaccgccatgctgtgctgcgccgtgagaggcagccccaagcccaagatcagctggttcaagaacggcctggacctgggcgaggacgccagattcagaatgttcagcaagcagggcgtgctgaccctggagatcagaaagccctgccccttcgacggcggcatctacgtgtgcagagccaccaacctgcagggcgaggccagatgcgagtgcagactggaggtgagagtgccccagtag

SEQ ID NO: 89961 - DNA, 3825 bp, Artificial Sequence
  Description of Artificial Sequence: Synthetic coding sequence
atgcccgagcccggcaagaagcccgtgagcgccttcagcaagaagcccagaagcgtggaggtggccgccggcagccccgccgtgttcgaggccgagaccgagagagccggcgtgaaggtgagatggcagagaggcggcagcgacatcagcgccagcaacaagtacggcctggccaccgagggcaccagacacaccctgaccgtgagagaggtgggccccgccgaccagggcagctacgccgtgatcgccggcagcagcaaggtgaagttcgacctgaaggtgatcgaggccgagaaggccgagcccatgctggcccccgcccccgcccccgccgaggccaccggcgcccccggcgaggcccccgcccccgccgccgagctgggcgagagcgcccccagccccaagggcagcagcagcgccgccctgaacggccccacccccggcgcccccgacgaccccatcggcctgttcgtgatgagaccccaggacggcgaggtgaccgtgggcggcagcatcaccttcagcgccagagtggccggcgccagcctgctgaagccccccgtggtgaagtggttcaagggcaagtgggtggacctgagcagcaaggtgggccagcacctgcagctgcacgacagctacgacagagccagcaaggtgtacctgttcgagctgcacatcaccgacgcccagcccgccttcaccggcagctacagatgcgaggtgagcaccaaggacaagttcgactgcagcaacttcaacctgaccgtgcacgaggccatgggcaccggcgacctggacctgctgagcgccttcagaagaaccagcctggccggcggcggcagaagaatcagcgacagccacgaggacaccggcatcctggacttcagcagcctgctgaagaagagcagcagcttcagaacccccagagacagcaagctggaggcccccgccgaggaggacgtgtgggagatcctgagacaggccccccccagcgagtacgagagaatcgccttccagtacggcgtgaccgacctgagaggcatgctgaagagactgaagggcatgagaagagacgagaagaagagcaccgccttccagaagaagctggagcccgcctaccaggtgagcaagggccacaagatcagactgaccgtggagctggccgaccacgacgccgaggtgaagtggctgaagaacggccaggagatccagatgagcggcagcaagtacatcttcgagagcatcggcgccaagagaaccctgaccatcagccagtgcagcctggccgacgacgccgcctaccagtgcgtggtgggcggcgagaagtgcagcaccgagctgttcgtgaaggagccccccgtgctgatcaccagacccctggaggaccagctggtgatggtgggccagagagtggagttcgagtgcgaggtgagcgaggagggcgcccaggtgaagtggctgaaggacggcgtggagctgaccagagaggagaccttcaagtacagattcaagaaggacggccagagacaccacctgatcatcaacgaggccatgctggaggacgccggccactacgccctgtgcaccagcggcggccaggccctggccgagctgatcgtgcaggagaagaagctggaggtgtaccagagcatcgccgacctgatggtgggcgccaaggaccaggccgtgttcaagtgcgaggtgagcgacgagaacgtgagaggcgtgtggctgaagaacggcaaggagctggtgcccgacagcagaatcaaggtgagccacatcggcagagtgcacaagctgaccatcgacgacgtgacccccgccgacgaggccgactacagcttcgtgcccgagggcttcgcctgcaacctgagcgccaagctgcacttcatggaggtgaagatcgacttcgtgcccagacaggagccccccaagatccacctggactgccccggcagaatccccgacaccatcgtggtggtggccggcaacaagctgagactggacgtgcccatcagcggcgaccccgcccccaccgtgatctggcagaaggccatcacccagggcaacaaggcccccgccagacccgcccccgacgcccccgaggacaccggcgacagcgacgagtgggtgttcgacaagaagctgctgtgcgagaccgagggcagagtgagagtggagaccaccaaggacagaagcatcttcaccgtggagggcgccgagaaggaggacgagggcgtgtacaccgtgaccgtgaagaaccccgtgggcgaggaccaggtgaacctgaccgtgaaggtgatcgacgtgcccgacgcccccgccgcccccaagatcagcaacgtgggcgaggacagctgcaccgtgcagtgggagccccccgcctacgacggcggccagcccatcctgggctacatcctggagagaaagaagaagaagagctacagatggatgagactgaacttcgacctgatccaggagctgagccacgaggccagaagaatgatcgagggcgtggtgtacgagatgagagtgtacgccgtgaacgccatcggcatgagcagacccagccccgccagccagcccttcatgcccatcggcccccccagcgagcccacccacctggccgtggaggacgtgagcgacaccaccgtgagcctgaagtggagaccccccgagagagtgggcgccggcggcctggacggctacagcgtggagtactgccccgagggctgcagcgagtgggtggccgccctgcagggcctgaccgagcacaccagcatcctggtgaaggacctgcccaccggcgccagactgctgttcagagtgagagcccacaacatggccggccccggcgcccccgtgaccaccaccgagcccgtgaccgtgcaggagatcctgcagagacccagactgcagctgcccagacacctgagacagaccatccagaagaaggtgggcgagcccgtgaacctgctgatccccttccagggcaagcccagaccccaggtgacctggaccaaggagggccagcccctggccggcgaggaggtgagcatcagaaacagccccaccgacaccatcctgttcatcagagccgccagaagagtgcacagcggcacctaccaggtgaccgtgagaatcgagaacatggaggacaaggccaccctggtgctgcaggtggtggacaagcccagccccccccaggacctgagagtgaccgacgcctggggcctgaacgtggccctggagtggaagcccccccaggacgtgggcaacaccgagctgtggggctacaccgtgcagaaggccgacaagaagaccatggagtggttcaccgtgctggagcactacagaagaacccactgcgtggtgcccgagctgatcatcggcaacggctactacttcagagtgttcagccagaacatggtgggcttcagcgacagagccgccaccaccaaggagcccgtgttcatccccagacccggcatcacctacgagccccccaactacaaggccctggacttcagcgaggcccccagcttcacccagcccctggtgaacagaagcgtgatcgccggctacaccgccatgctgtgctgcgccgtgagaggcagccccaagcccaagatcagctggttcaagaacggcctggacctgggcgaggacgccagattcagaatgttcagcaagcagggcgtgctgaccctggagatcagaaagccctgccccttcgacggcggcatctacgtgtgcagagccaccaacctgcagggcgaggccagatgcgagtgcagactggaggtgagagtgccccagtag

SEQ ID NO: 89962 - DNA, 3825 bp, Artificial Sequence
  Description of Artificial Sequence: Synthetic coding sequence
atgcccgagcccggcaagaagcccgtgagcgccttcagcaagaagcccagaagcgtggaggtggccgccggcagccccgccgtgttcgaggccgagaccgagagagccggcgtgaaggtgagatggcagagaggcggcagcgacatcagcgccagcaacaagtacggcctggccaccgagggcaccagacacaccctgaccgtgagagaggtgggccccgccgaccagggcagctacgccgtgatcgccggcagcagcaaggtgaagttcgacctgaaggtgatcgaggccgagaaggccgagcccatgctggcccccgcccccgcccccgccgaggccaccggcgcccccggcgaggcccccgcccccgccgccgagctgggcgagagcgcccccagccccaagggcagcagcagcgccgccctgaacggccccacccccggcgcccccgacgaccccatcggcctgttcgtgatgagaccccaggacggcgaggtgaccgtgggcggcagcatcaccttcagcgccagagtggccggcgccagcctgctgaagccccccgtggtgaagtggttcaagggcaagtgggtggacctgagcagcaaggtgggccagcacctgcagctgcacgacagctacgacagagccagcaaggtgtacctgttcgagctgcacatcaccgacgcccagcccgccttcaccggcagctacagatgcgaggtgagcaccaaggacaagttcgactgcagcaacttcaacctgaccgtgcacgaggccatgggcaccggcgacctggacctgctgagcgccttcagaagaaccagcctggccggcggcggcagaagaatcagcgacagccacgaggacaccggcatcctggacttcagcagcctgctgaagaagagagacagcttcagaacccccagagacagcaagctggaggcccccgccgaggaggacgtgtgggagatcctgagacaggccccccccagcgagtacgagagaatcgccttccagtacggcgtgaccgacctgagaggcatgctgaagagactgaagggcatgagaagagacgagaagaagagcaccgccttccagaagaagctggagcccgcctaccaggtgagcaagggccacaagatcagactgaccgtggagctggccgaccacgacgccgaggtgaagtggctgaagaacggccaggagatccagatgagcggcagcaagtacatcttcgagagcatcggcgccaagagaaccctgaccatcagccagtgcagcctggccgacgacgccgcctaccagtgcgtggtgggcggcgagaagtgcagcaccgagctgttcgtgaaggagccccccgtgctgatcaccagacccctggaggaccagctggtgatggtgggccagagagtggagttcgagtgcgaggtgagcgaggagggcgcccaggtgaagtggctgaaggacggcgtggagctgaccagagaggagaccttcaagtacagattcaagaaggacggccagagacaccacctgatcatcaacgaggccatgctggaggacgccggccactacgccctgtgcaccagcggcggccaggccctggccgagctgatcgtgcaggagaagaagctggaggtgtaccagagcatcgccgacctgatggtgggcgccaaggaccaggccgtgttcaagtgcgaggtgagcgacgagaacgtgagaggcgtgtggctgaagaacggcaaggagctggtgcccgacagcagaatcaaggtgagccacatcggcagagtgcacaagctgaccatcgacgacgtgacccccgccgacgaggccgactacagcttcgtgcccgagggcttcgcctgcaacctgagcgccaagctgcacttcatggaggtgaagatcgacttcgtgcccagacaggagccccccaagatccacctggactgccccggcagaatccccgacaccatcgtggtggtggccggcaacaagctgagactggacgtgcccatcagcggcgaccccgcccccaccgtgatctggcagaaggccatcacccagggcaacaaggcccccgccagacccgcccccgacgcccccgaggacaccggcgacagcgacgagtgggtgttcgacaagaagctgctgtgcgagaccgagggcagagtgagagtggagaccaccaaggacagaagcatcttcaccgtggagggcgccgagaaggaggacgagggcgtgtacaccgtgaccgtgaagaaccccgtgggcgaggaccaggtgaacctgaccgtgaaggtgatcgacgtgcccgacgcccccgccgcccccaagatcagcaacgtgggcgaggacagctgcaccgtgcagtgggagccccccgcctacgacggcggccagcccatcctgggctacatcctggagagaaagaagaagaagagctacagatggatgagactgaacttcgacctgatccaggagctgagccacgaggccagaagaatgatcgagggcgtggtgtacgagatgagagtgtacgccgtgaacgccatcggcatgagcagacccagccccgccagccagcccttcatgcccatcggcccccccagcgagcccacccacctggccgtggaggacgtgagcgacaccaccgtgagcctgaagtggagaccccccgagagagtgggcgccggcggcctggacggctacagcgtggagtactgccccgagggctgcagcgagtgggtggccgccctgcagggcctgaccgagcacaccagcatcctggtgaaggacctgcccaccggcgccagactgctgttcagagtgagagcccacaacatggccggccccggcgcccccgtgaccaccaccgagcccgtgaccgtgcaggagatcctgcagagacccagactgcagctgcccagacacctgagacagaccatccagaagaaggtgggcgagcccgtgaacctgctgatccccttccagggcaagcccagaccccaggtgacctggaccaaggagggccagcccctggccggcgaggaggtgagcatcagaaacagccccaccgacaccatcctgttcatcagagccgccagaagagtgcacagcggcacctaccaggtgaccgtgagaatcgagaacatggaggacaaggccaccctggtgctgcaggtggtggacaagcccagccccccccaggacctgagagtgaccgacgcctggggcctgaacgtggccctggagtggaagcccccccaggacgtgggcaacaccgagctgtggggctacaccgtgcagaaggccgacaagaagaccatggagtggttcaccgtgctggagcactacagaagaacccactgcgtggtgcccgagctgatcatcggcaacggctactacttcagagtgttcagccagaacatggtgggcttcagcgacagagccgccaccaccaaggagcccgtgttcatccccagacccggcatcacctacgagccccccaactacaaggccctggacttcagcgaggcccccagcttcacccagcccctggtgaacagaagcgtgatcgccggctacaccgccatgctgtgctgcgccgtgagaggcagccccaagcccaagatcagctggttcaagaacggcctggacctgggcgaggacgccagattcagaatgttcagcaagcagggcgtgctgaccctggagatcagaaagccctgccccttcgacggcggcatctacgtgtgcagagccaccaacctgcagggcgaggccagatgcgagtgcagactggaggtgagagtgccccagtag

SEQ ID NO: 89963 - DNA, 3426 bp, Artificial Sequence
  Description of Artificial Sequence: Synthetic coding sequence
atgcccgaggccaagcccgccgccaagaaggcccccaagggcaaggacgcccccaagggcgcccccaaggaggccccccccaaggaggcccccgccgaggcccccaaggaggccccccccgaggaccagagccccaccgccgaggagcccaccggcgtgttcctgaagaagcccgacagcgtgagcgtggagaccggcaaggacgccgtggtggtggccaaggtgaacggcaaggagctgcccgacaagcccaccatcaagtggttcaagggcaagtggctggagctgggcagcaagagcggcgccagattcagcttcaaggagagccacaacagcgccagcaacgtgtacaccgtggagctgcacatcggcaaggtggtgctgggcgacagaggctactacagactggaggtgaaggccaaggacacctgcgacagctgcggcttcaacatcgacgtggaggcccccagacaggacgccagcggccagagcctggagagcttcaagagaaccagcgagaagaagagcgacaccgccggcgagctggacttcagcggcctgctgaagaagagagaggtggtggaggaggagaagaagaagaagaagaaggacgacgacgacctgggcatcccccccgagatctgggagctgctgaagggcgccaagaagagcgagtacgagaagatcgccttccagtacggcatcaccgacctgagaggcatgctgaagagactgaagaaggccaaggtggaggtgaagaagagcgccgccttcaccaagaagctggaccccgcctaccaggtggacagaggcaacaagatcaagctgatggtggagatcagcgaccccgacctgaccctgaagtggttcaagaacggccaggagatcaagcccagcagcaagtacgtgttcgagaacgtgggcaagaagagaatcctgaccatcaacaagtgcaccctggccgacgacgccgcctacgaggtggccgtgaaggacgagaagtgcttcaccgagctgttcgtgaaggagccccccgtgctgatcgtgacccccctggaggaccagcaggtgttcgtgggcgacagagtggagatggccgtggaggtgagcgaggagggcgcccaggtgatgtggatgaaggacggcgtggagctgaccagagaggacagcttcaaggccagatacagattcaagaaggacggcaagagacacatcctgatcttcagcgacgtggtgcaggaggacagaggcagataccaggtgatcaccaacggcggccagtgcgaggccgagctgatcgtggaggagaagcagctggaggtgctgcaggacatcgccgacctgaccgtgaaggccagcgagcaggccgtgttcaagtgcgaggtgagcgacgagaaggtgaccggcaagtggtacaagaacggcgtggaggtgagacccagcaagagaatcaccatcagccacgtgggcagattccacaagctggtgatcgacgacgtgagacccgaggacgagggcgactacaccttcgtgcccgacggctacgccctgagcctgagcgccaagctgaacttcctggagatcaaggtggagtacgtgcccaagcaggagccccccaagatccacctggactgcagcggcaagaccagcgagaacgccatcgtggtggtggccggcaacaagctgagactggacgtgagcatcaccggcgagcccccccccgtggccacctggctgaagggcgacgaggtgttcaccaccaccgagggcagaaccagaatcgagaagagagtggactgcagcagcttcgtgatcgagagcgcccagagagaggacgagggcagatacaccatcaaggtgaccaaccccgtgggcgaggacgtggccagcatcttcctgcaggtggtggacgtgcccgacccccccgaggccgtgagaatcaccagcgtgggcgaggactgggccatcctggtgtgggagccccccatgtacgacggcggcaagcccgtgaccggctacctggtggagagaaagaagaagggcagccagagatggatgaagctgaacttcgaggtgttcaccgagaccacctacgagagcaccaagatgatcgagggcatcctgtacgagatgagagtgttcgccgtgaacgccatcggcgtgagccagcccagcatgaacaccaagcccttcatgcccatcgcccccaccagcgagcccctgcacctgatcgtggaggacgtgaccgacaccaccaccaccctgaagtggagaccccccaacagaatcggcgccggcggcatcgacggctacctggtggagtactgcctggagggcagcgaggagtgggtgcccgccaacaccgagcccgtggagagatgcggcttcaccgtgaagaacctgcccaccggcgccagaatcctgttcagagtggtgggcgtgaacatcgccggcagaagcgagcccgccaccctggcccagcccgtgaccatcagagagatcgccgagccccccaagatcagactgcccagacacctgagacagacctacatcagaaaggtgggcgagcagctgaacctggtggtgcccttccagggcaagcccagaccccaggtggtgtggaccaagggcggcgcccccctggacaccagcagagtgcacgtgagaaccagcgacttcgacaccgtgttcttcgtgagacaggccgccagaagcgacagcggcgagtacgagctgagcgtgcagatcgagaacatgaaggacaccgccaccatcagaatcagagtggtggagaaggccggcccccccatcaacgtgatggtgaaggaggtgtggggcaccaacgccctggtggagtggcaggcccccaaggacgacggcaacagcgagatcatgggctacttcgtgcagaaggccgacaagaagaccatggagtggttcaacgtgtacgagagaaacagacacaccagctgcaccgtgagcgacctgatcgtgggcaacgagtactacttcagagtgtacaccgagaacatctgcggcctgagcgacagccccggcgtgagcaagaacaccgccagaatcctgaagaccggcatcaccttcaagcccttcgagtacaaggagcacgacttcagaatggcccccaagttcctgacccccctgatcgacagagtggtggtggccggctacagcgccgccctgaactgcgccgtgagaggccaccccaagcccaaggtggtgtggatgaagaacaagatggagatcagagaggaccccaagttcctgatcaccaactaccagggcgtgctgaccctgaacatcagaagacccagccccttcgacgccggcacctacacctgcagagccgtgaacgagctgggcgaggccctggccgagtgcaagctggaggtgagagtgccccagtag

SEQ ID NO: 89964 - DNA, 3426 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcagcaccagcgccaagcagagcgacgagaacggcgaggccgcctacgacctgcccgccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatcgcccagtag

SEQ ID NO: 89965 - DNA, 3516 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggacgaggaggaggtgagcccccccagcgccctgccccccggcctgggcagcagagccctggagagaaaggacagcgactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatctaccagggcgtgaacacccccggccagcccgtgttcctggagggccagcagcagagcctgcacaacaaggacttctag

SEQ ID NO: 89966 - DNA, 3447 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggacgaggaggaggtgagcccccccagcgccctgccccccggcctgggcagcagagccctggagagaaaggacagcgactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatcgcccagtag

SEQ ID NO: 89967 - DNA, 3495 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcagcaccagcgccaagcagagcgacgagaacggcgaggccgcctacgacctgcccgccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatctaccagggcgtgaacacccccggccagcccgtgttcctggagggccagcagcagagcctgcacaacaaggacttctag

SEQ ID NO: 89968 - DNA, 2349 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggacgaggaggaggtgagcccccccagcgccctgccccccggcctgggcagcagagccctggagagaaaggacagcgactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagacccagaccccactggtgcagcagattcagatggctgtgcgccagagtgctgctgtag

SEQ ID NO: 89969 - DNA, 3426 bp, Artificial Sequence; identical to SEQ ID NO: 89964
  Description of Artificial Sequence: Synthetic coding sequence

SEQ ID NO: 89970 - DNA, 3372 bp, Artificial Sequence
  Description of Artificial Sequence: Synthetic coding sequence
atgcccgagcccaccaagaaggaggagaacgaggtgcccgcccccgcccccccccccgaggagcccagcaaggagaaggaggccggcaccacccccgccaaggactggaccctggtggagaccccccccggcgaggagcaggccaagcagaacgccaacagccagctgagcatcctgttcatcgagaagccccagggcggcaccgtgaaggtgggcgaggacatcaccttcatcgccaaggtgaaggccgaggacctgctgagaaagcccaccatcaagtggttcaagggcaagtggatggacctggccagcaaggccggcaagcacctgcagctgaaggagaccttcgagagacacagcagagtgtacaccttcgagatgcagatcatcaaggccaaggacaacttcgccggcaactacagatgcgaggtgacctacaaggacaagttcgacagctgcagcttcgacctggaggtgcacgagagcaccggcaccacccccaacatcgacatcagaagcgccttcaagagaagcggcgagggccaggaggacgccggcgagctggacttcagcggcctgctgaagagaagagaggtgaagcagcaggaggaggagccccaggtggacgtgtgggagctgctgaagaacgccaagcccagcgagtacgagaagatcgccttccagtacggcatcaccgacctgagaggcatgctgaagagactgaagagaatgagaagagaggagaagaagagcgccgccttcgccaagatcctggaccccgcctaccaggtggacaagggcggcagagtgagattcgtggtggagctggccgaccccaagctggaggtgaagtggtacaagaacggccaggagatcagacccagcaccaagtacatcttcgagcacaagggctgccagagaatcctgttcatcaacaactgccagatgaccgacgacagcgagtactacgtgaccgccggcgacgagaagtgcagcaccgagctgttcgtgagagagccccccatcatggtgaccaagcagctggaggacaccaccgcctactgcggcgagagagtggagctggagtgcgaggtgagcgaggacgacgccaacgtgaagtggttcaagaacggcgaggagatcatccccggccccaagagcagatacagaatcagagtggagggcaagaagcacatcctgatcatcgagggcgccaccaaggccgacgccgccgagtacagcgtgatgaccaccggcggccagagcagcgccaagctgagcgtggacctgaagcccctgaagatcctgacccccctgaccgaccagaccgtgaacctgggcaaggagatctgcctgaagtgcgagatcagcgagaacatccccggcaagtggaccaagaacggcctgcccgtgcaggagagcgacagactgaaggtggtgcacaagggcagaatccacaagctggtgatcgccaacgccctgaccgaggacgagggcgactacgtgttcgcccccgacgcctacaacgtgaccctgcccgccaaggtgcacgtgatcgacccccccaagatcatcctggacggcctggacgccgacaacaccgtgaccgtgatcgccggcaacaagctgagactggagatccccatcagcggcgagcccccccccaaggccatgtggagcagaggcgacaaggccatcatggagggcagcggcagaatcagaaccgagagctaccccgacagcagcaccctggtgatcgacatcgccgagagagacgacagcggcgtgtaccacatcaacctgaagaacgaggccggcgaggcccacgccagcatcaaggtgaaggtggtggacttccccgacccccccgtggcccccaccgtgaccgaggtgggcgacgactggtgcatcatgaactgggagccccccgcctacgacggcggcagccccatcctgggctacttcatcgagagaaagaagaagcagagcagcagatggatgagactgaacttcgacctgtgcaaggagaccaccttcgagcccaagaagatgatcgagggcgtggcctacgaggtgagaatcttcgccgtgaacgccatcggcatcagcaagcccagcatgcccagcagacccttcgtgcccctggccgtgaccagcccccccaccctgctgaccgtggacagcgtgaccgacaccaccgtgaccatgagatggagaccccccgaccacatcggcgccgccggcctggacggctacgtgctggagtactgcttcgagggcaccgaggactggatcgtggccaacaaggacctgatcgacaagaccaagttcaccatcaccggcctgcccaccgacgccaagatcttcgtgagagtgaaggccgtgaacgccgccggcgccagcgagcccaagtactacagccagcccatcctggtgaaggagatcatcgagccccccaagatcagaatccccagacacctgaagcagacctacatcagaagagtgggcgaggccgtgaacctggtgatccccttccagggcaagcccagacccgagctgacctggaagaaggacggcgccgagatcgacaagaaccagatcaacatcagaaacagcgagaccgacaccatcatcttcatcagaaaggccgagagaagccacagcggcaagtacgacctgcaggtgaaggtggacaagttcgtggagaccgccagcatcgacatccagatcatcgacagacccggccccccccagatcgtgaagatcgaggacgtgtggggcgagaacgtggccctgacctggaccccccccaaggacgacggcaacgccgccatcaccggctacaccatccagaaggccgacaagaagagcatggagtggttcaccgtgatcgagcactaccacagaaccagcgccaccatcaccgagctggtgatcggcaacgagtactacttcagagtgttcagcgagaacatgtgcggcctgagcgaggacgccaccatgaccaaggagagcgccgtgatcgccagagacggcaagatctacaagaaccccgtgtacgaggacttcgacttcagcgaggcccccatgttcacccagcccctggtgaacacctacgccatcgccggctacaacgccaccctgaactgcagcgtgagaggcaaccccaagcccaagatcacctggatgaagaacaaggtggccatcgtggacgaccccagatacagaatgttcagcaaccagggcgtgtgcaccctggagatcagaaagcccagcccctacgacggcggcacctactgctgcaaggccgtgaacgacctgggcaccgtggagatcgagtgcaagctggaggtgaaggtgatcgcccagtag

SEQ ID NO: 89971 - DNA, 1434 bp, Artificial Sequence
  Description of Artificial Sequence: Synthetic coding sequence
atgatggagaagaacaccagcgagggccccgcctgcagccccgaggagaccgccagcgagagcgccaaggtgcccaccgccgagccccccggcgaggtggccgtgagcgagagcaccagagaggagcaggtgcccaagccccaggcccccgccccccaggcccccaccgccagcaccgccaccaagcccgccccccccagcgaggacgtgcccagcgcccccctgctgctgaccctggacgacgtgagcagcagcagcgtgaccgtgagctgggagccccccgagagactgggcagactgggcctgcagggctacgtgctggagctgtgcagagagggcgccagcgagtgggtgcccgtgagcgccagacccatgatggtgacccagcagaccgtgagaaacctggccctgggcgacaagttcctgctgagagtgagcgccgtgagcagcgccggcgccggcccccccgccatgctggaccagcccatccacatcagagagaacatcgaggcccccaagatcagagtgcccagacacctgagacagacctacatcagacaggtgggcgagaccgtgaacctgcagatccccttccagggcaagcccaagccccaggccacctggacccacaacggccacgccctggacagccagagagtgagcatgagaaccggcgaccaggacagcatcctgttcatcagaagcgcccagagaagcgacagcggcagatacgagctgaccgtgagagtggaggacctggaggccaaggccgtgatcgacatcctggtgatcgagaagcccggcccccccagcagcatcagactgctggacgtgtggggctgcaacgccgccctgcagtggacccccccccaggacaccggcaacaccgagctgctgggctacatggtgcagaaggccgacaagaagaccggccagtggttcaccgtgctggagagataccaccccaccacctgcaccatcagcgacctgatcatcggcaacagctacagcttcagagtgttcagcgagaacctgtgcggcctgagcaccagcgccaccgtgaccaaggagctggcccacatccagaaggccgacatcgccgccaagcccaagggcttcatcgagagagacttcagcgaggcccccagcttcacccagcccctggccgaccacaccagcacccccggctacagcacccagctgttctgcagcgtgagagccagccccaagcccaagatcatctggatgaagaacaagatggagatccagggcaaccccaagtacagagccctgagcgagcagggcgtgtgcaccctggagatcagaaagcccagccccttcgacagcggcgtgtacacctgcaaggccatcaacgtgctgggcgaggccagcgtggactgcagactggaggtgaaggccagcgccgcccactag

SEQ ID NO: 89972 - DNA, 5817 bp, Artificial Sequence
  Description of Artificial Sequence: Synthetic coding sequence
atgagcagcgacgccgagatggccatcttcggcgaggccgccccctacctgagaaagcccgagaaggagagaatcgaggcccagaacagacccttcgacagcaagaaggcctgcttcgtggccgacaacaaggagatgtacgtgaagggcatgatccagaccagagagaacgacaaggtgatcgtgaagaccctggacgacagaatgctgaccctgaacaacgaccaggtgttccccatgaacccccccaagttcgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaagcccgaggtggtggccgcctacagaggcaagaagagacaggaggcccccccccacatcttcagcatcagcgacaacgcctaccagttcatgctgaccgacagagacaaccagagcatcctgatcaccggcgagagcggcgccggcaagaccgtgaacaccaagagagtgatccagtacttcgccaccatcgccgtgaccggcgacaagaagaaggagacccagcccggcaagatgcagggcaccctggaggaccagatcatccaggccaaccccctgctggaggccttcggcaacgccaagaccgtgagaaacgacaacagcagcagattcggcaagttcatcagaatccacttcggcgccaccggcaagctggccagcgccgacatcgagacctacctgctggagaagagcagagtgaccttccagctgagcagcgagagaagctaccacatcttctaccagatcatgagcaacaagaagcccgagctgatcgacctgctgctgatcagcaccaaccccttcgacttccccttcgtgagccagggcgaggtgaccgtggccagcatcgacgacagcgaggagctgctggccaccgacaacgccatcgacatcctgggcttcagcagcgaggagaaggtgggcatctacaagctgaccggcgccgtgatgcactacggcaacatgaagttcaagcagaagcagagagaggagcaggccgagcccgacggcaccgaggtggccgacaaggccggctacctgatgggcctgaacagcgccgagatgctgaagggcctgtgctgccccagagtgaaggtgggcaacgagtacgtgaccaagggccagaacgtgcagcaggtgaccaacagcgtgggcgccctggccaaggccgtgtacgagaagatgttcctgtggatggtgaccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtgggagttcatcgacttcggcatggacctggccgcctgcatcgagctgatcgagaagcccatgggcatcttcagcatcctggaggaggagtgcatgttccccaaggccaccgacaccagcttcaagaacaagctgtacgaccagcacctgggcaagagcaacaacttccagaagcccaagcccgccaagggcaaggccgaggcccacttcagcctggtgcactacgccggcaccgtggactacaacatcgccggctggctggacaagaacaaggaccccctgaacgagaccgtggtgggcctgtaccagaagagcagcctgaagctgctgagcttcctgttcagcaactacgccggcgccgagaccggcgacagcggcggcagcaagaagggcggcaagaagaagggcagcagcttccagaccgtgagcgccgtgttcagagagaacctgaacaagctgatgaccaacctgagaagcacccacccccacttcgtgagatgcctgatccccaacgagaccaagacccccggcgtgatggaccactacctggtgatgcaccagctgagatgcaacggcgtgctggagggcatcagaatctgcagaaagggcttccccagcagaatcctgtacgccgacttcaagcagagatacagaatcctgaacgccagcgccatccccgagggccagttcatcgacagcaagaacgccagcgagaagctgctgaacagcatcgacgtggacagagagcagttcagattcggcaacaccaaggtgttcttcaaggccggcctgctgggcctgctggaggagatgagagacgagaagctggtgaccctgatgaccagcacccaggccgtgtgcagaggctacctgatgagagtggagttcaagaagatgatggagagaagagacagcatcttctgcatccagtacaacatcagaagcttcatgaacgtgaagcactggccctggatgaacctgttcttcaagatcaagcccctgctgaagagcgccgaggccgagaaggagatggccaccatgaaggaggacttcgagagaaccaaggaggagctggccagaagcgaggccagaagaaaggagctggaggagaagatggtgagcctgctgcaggagaagaacgacctgcagctgcaggtgcagagcgagaccgagaacctgatggacgccgaggagagatgcgagggcctgatcaagagcaagatcctgctggaggccaaggtgaaggagctgaccgagagactggaggaggaggaggagatgaacagcgagctggtggccaagaagagaaacctggaggacaagtgcagcagcctgaagagagacatcgacgacctggagctgaccctgaccaaggtggagaaggagaagcacgccaccgagaacaaggtgaagaacctgagcgaggagatgaccgccctggaggagaacatcagcaagctgaccaaggagaagaagagcctgcaggaggcccaccagcagaccctggacgacctgcaggtggaggaggacaaggtgaacggcctgatcaagatcaacgccaagctggagcagcagaccgacgacctggagggcagcctggagcaggagaagaagctgagagccgacctggagagagccaagagaaagctggagggcgacctgaagatgagccaggagagcatcatggacctggagaacgacaagcagcagatcgaggagaagctgaagaagaaggagttcgagctgagccagctgcaggccaagatcgacgacgagcaggtgcacagcctgcagttccagaagaagatcaaggagctgcaggccagaatcgaggagctggaggaggagatcgaggccgagcacaccctgagagccaagatcgagaagcagagaagcgacctggccagagagctggaggagatcagcgagagactggaggaggccagcggcgccaccagcgcccagatcgagatgaacaagaagagagaggccgagttccagaagatgagaagagacctggaggaggccaccctgcagcacgaggccaccgccgccaccctgagaaagaagcaggccgacagcgtggccgagctgggcgagcagatcgacaacctgcagagagtgaagcagaagctggagaaggagaagagcgagctgaagatggagatcgacgacatggccagcaacatcgaggccctgagcaagagcaagagcaacatcgagagaacctgcagaaccgtggaggaccagttcagcgagatcaaggccaaggacgagcagcagacccagctgatccacgacctgaacatgcagaaggccagactgcagacccagaacggcgagctgagccacagagtggaggagaaggagagcctgatcagccagctgaccaagagcaagcaggccctgacccagcagctggaggagctgaagagacagatggaggaggagaccaaggccaagaacgccatggcccacgccctgcagagcagcagacacgactgcgacctgctgagagagcagtacgaggaggagcaggaggccaaggccgagctgcagagagccctgagcaaggccaacagcgaggtggcccagtggagaaccaagtacgagaccgacgccatccagagaaccgaggagctggaggaggccaagaagaagctggcccagagactgcaggaggccgaggagaacaccgagaccgccaacagcaagtgcgccagcctggagaagaccaagcagagactgcagggcgaggtggaggacctgatgagagacctggagagaagccacaccgcctgcgccaccctggacaagaagcagagaaacttcgacaaggtgctggccgagtggaagcagaagctggacgagagccaggccgagctggaggccgcccagaaggagagcagaagcctgagcaccgagctgttcaagatgagaaacgcctacgaggaggtggtggaccagctggagaccctgagaagagagaacaagaacctgcaggaggagatcagcgacctgaccgagcagatcgccgagaccggcaagaacctgcaggaggccgagaagaccaagaagctggtggagcaggagaagagcgacctgcaggtggccctggaggaggtggagggcagcctggagcacgaggagagcaagatcctgagagtgcagctggagctgagccaggtgaagagcgagctggacagaaaggtgatcgagaaggacgaggagatcgagcagctgaagagaaacagccagagagccgccgaggccctgcagagcgtgctggacgccgagatcagaagcagaaacgacgccctgagactgaagaagaagatggagggcgacctgaacgagatggagatccagctgggccacagcaacagacagatggccgagacccagaagcacctgagaaccgtgcagggccagctgaaggacagccagctgcacctggacgacgccctgagaagcaacgaggacctgaaggagcagctggccatcgtggagagaagaaacggcctgctgctggaggagctggaggagatgaaggtggccctggagcagaccgagagaaccagaagactgagcgagcaggagctgctggacgccagcgacagagtgcagctgctgcacagccagaacaccagcctgatcaacaccaagaagaagctggaggccgacatcgcccagtgccaggccgaggtggagaacagcatccaggagagcagaaacgccgaggagaaggccaagaaggccatcaccgacgccgccatgatggccgaggagctgaagaaggagcaggacaccagcgcccacctggagagaatgaagaagaacctggagcagaccgtgaaggacctgcagcacagactggacgaggccgagcagctggccctgaagggcggcaagaagcagatccagaagctggagaacagagtgagagagctggagaacgagctggacgtggagcagaagagaggcgccgaggccctgaagggcgcccacaagtacgagagaaaggtgaaggagatgacctaccaggccgaggaggaccacaagaacatcctgagactgcaggacctggtggacaagctgcaggccaaggtgaagagctacaagagacaggccgaggaggccgaggagcaggccaacacccagctgagcagatgcagaagagtgcagcacgagctggaggaggccgccgagagagccgacatcgccgagagccaggtgaacaagctgagagccaagagcagagacgtgggcagccagaagatggaggagtag

SEQ ID NO: 89973 - DNA, 6111 bp, Artificial Sequence
  Description of Artificial Sequence: Synthetic coding sequence
atggccgccgtgaccatgagcgtgcccggcagaaaggccccccccagacccggccccgtgcccgaggccgcccagcccttcctgttcacccccagaggccccagcgccggcggcggccccggcagcggcaccagcccccaggtggagtggaccgccagaagactggtgtgggtgcccagcgagctgcacggcttcgaggccgccgccctgagagacgagggcgaggaggaggccgaggtggagctggccgagagcggcagaagactgagactgcccagagaccagatccagagaatgaacccccccaagttcagcaaggccgaggacatggccgagctgacctgcctgaacgaggccagcgtgctgcacaacctgagagagagatactacagcggcctgatctacacctacagcggcctgttctgcgtggtgatcaacccctacaagcagctgcccatctacaccgaggccatcgtggagatgtacagaggcaagaagagacacgaggtgcccccccacgtgtacgccgtgaccgagggcgcctacagaagcatgctgcaggacagagaggaccagagcatcctgtgcaccggcgagagcggcgccggcaagaccgagaacaccaagaaggtgatccagtacctggcccacgtggccagcagccccaagggcagaaaggagcccggcgtgcccgccagcgtgagcaccgtgagctacggcgagctggagagacagctgctgcaggccaaccccatcctggaggccttcggcaacgccaagaccgtgaagaacgacaacagcagcagattcggcaagttcatcagaatcaacttcgacgtggccggctacatcgtgggcgccaacatcgagacctacctgctggagaagagcagagccatcagacaggccaaggacgagtgcagcttccacatcttctaccagctgctgggcggcgccggcgagcagctgaaggccgacctgctgctggagccctgcagccactacagattcctgaccaacggccccagcagcagccccggccaggagagagagctgttccaggagaccctggagagcctgagagtgctgggcttcagccacgaggagatcatcagcatgctgagaatggtgagcgccgtgctgcagttcggcaacatcgccctgaagagagagagaaacaccgaccaggccaccatgcccgacaacaccgccgcccagaagctgtgcagactgctgggcctgggcgtgaccgacttcagcagagccctgctgacccccagaatcaaggtgggcagagactacgtgcagaaggcccagaccaaggagcaggccgacttcgccctggaggccctggccaaggccacctacgagagactgttcagatggctggtgctgagactgaacagagccctggacagaagccccagacagggcgccagcttcctgggcatcctggacatcgccggcttcgagatcttccagctgaacagcttcgagcagctgtgcatcaactacaccaacgagaagctgcagcagctgttcaaccacaccatgttcgtgctggagcaggaggagtaccagagagagggcatcccctggaccttcctggacttcggcctggacctgcagccctgcatcgacctgatcgagagacccgccaacccccccggcctgctggccctgctggacgaggagtgctggttccccaaggccaccgacaagagcttcgtggagaaggtggcccaggagcagggcggccaccccaagttccagagacccagacacctgagagaccaggccgacttcagcgtgctgcactacgccggcaaggtggactacaaggccaacgagtggctgatgaagaacatggaccccctgaacgacaacgtggccgccctgctgcaccagagcaccgacagactgaccgccgagatctggaaggacgagcacggcggcttccagcagttcagcttcctgggcagcttcccccccagcccccccggcagcgccgagagatgcagcagcgccatcagcccccccggcgtggagggcatcgtgggcctggagcaggtgagcagcctgggcgacggcccccccggcggcagacccagaagaggcatgttcagaaccgtgggccagctgtacaaggagagcctgagcagactgatggccaccctgagcaacaccaaccccagcttcgtgagatgcatcgtgcccaaccacgagaagagagccggcaagctggagcccagactggtgctggaccagctgagatgcaacggcgtgctggagggcatcagaatctgcagacagggcttccccaacagaatcctgttccaggagttcagacagagatacgagatcctgacccccaacgccatccccaagggcttcatggacggcaagcaggcctgcgagaagatgatccaggccctggagctggaccccaacctgtacagagtgggccagagcaagatcttcttcagagccggcgtgctggcccagctggaggaggagagagacctgaaggtgaccgacatcatcgtgagcttccaggccgccgccagaggctacctggccagaagagccttccagaagagacagcagcagcagagcgccctgagagtgatgcagagaaactgcgccgcctacctgaagctgagacactggcagtggtggagactgttcaccaaggtgaagcccctgctgcaggtgaccagacaggacgaggtgctgcaggccagagcccaggagctgcagaaggtgcaggagctgcagcagcagagcgccagagaggtgggcgagctgcagggcagagtggcccagctggaggaggagagagccagactggccgagcagctgagagccgaggccgagctgtgcgccgaggccgaggagaccagaggcagactggccgccagaaagcaggagctggagctggtggtgagcgagctggaggccagagtgggcgaggaggaggagtgcagcagacagatgcagaccgagaagaagagactgcagcagcacatccaggagctggaggcccacctggaggccgaggagggcgccagacagaagctgcagctggagaaggtgaccaccgaggccaagatgaagaagttcgaggaggacctgctgctgctggaggaccagaacagcaagctgagcaaggagagaaagctgctggaggacagactggccgagttcagcagccaggccgccgaggaggaggagaaggtgaagagcctgaacaagctgagactgaagtacgaggccaccatcgccgacatggaggacagactgagaaaggaggagaagggcagacaggagctggagaagctgaagagaagactggacggcgagagcagcgagctgcaggagcagatggtggagcagcagcagagagccgaggagctgagagcccagctgggcagaaaggaggaggagctgcaggccgccctggccagagccgaggacgagggcggcgccagagcccagctgctgaagagcctgagagaggcccaggccgccctggccgaggcccaggaggacctggagagcgagagagtggccagaaccaaggccgagaagcagagaagagacctgggcgaggagctggaggccctgagaggcgagctggaggacaccctggacagcaccaacgcccagcaggagctgagaagcaagagagagcaggaggtgaccgagctgaagaagaccctggaggaggagaccagaatccacgaggccgccgtgcaggagctgagacagagacacggccaggccctgggcgagctggccgagcagctggagcaggccagaagaggcaagggcgcctgggagaagaccagactggccctggaggccgaggtgagcgagctgagagccgagctgagcagcctgcagaccgccagacaggagggcgagcagagaagaagaagactggagctgcagctgcaggaggtgcagggcagagccggcgacggcgagagagccagagccgaggccgccgagaagctgcagagagcccaggccgagctggagaacgtgagcggcgccctgaacgaggccgagagcaagaccatcagactgagcaaggagctgagcagcaccgaggcccagctgcacgacgcccaggagctgctgcaggaggagaccagagccaagctggccctgggcagcagagtgagagccatggaggccgaggccgccggcctgagagagcagctggaggaggaggccgccgccagagagagagccggcagagagctgcagaccgcccaggcccagctgagcgagtggagaagaagacaggaggaggaggccggcgccctggaggccggcgaggaggccagaagaagagccgccagagaggccgaggccctgacccagagactggccgagaagaccgagaccgtggacagactggagagaggcagaagaagactgcagcaggagctggacgacgccaccatggacctggagcagcagagacagctggtgagcaccctggagaagaagcagagaaagttcgaccagctgctggccgaggagaaggccgccgtgctgagagccgtggaggagagagagagagccgaggccgagggcagagagagagaggccagagccctgagcctgaccagagccctggaggaggagcaggaggccagagaggagctggagagacagaacagagccctgagagccgagctggaggccctgctgagcagcaaggacgacgtgggcaagagcgtgcacgagctggagagagcctgcagagtggccgagcaggccgccaacgacctgagagcccaggtgaccgagctggaggacgagctgaccgccgccgaggacgccaagctgagactggaggtgaccgtgcaggccctgaagacccagcacgagagagacctgcagggcagagacgaggccggcgaggagagaagaagacagctggccaagcagctgagagacgccgaggtggagagagacgaggagagaaagcagagaaccctggccgtggccgccagaaagaagctggagggcgagctggaggagctgaaggcccagatggccagcgccggccagggcaaggaggaggccgtgaagcagctgagaaagatgcaggcccagatgaaggagctgtggagagaggtggaggagaccagaaccagcagagaggagatcttcagccagaacagagagagcgagaagagactgaagggcctggaggccgaggtgctgagactgcaggaggagctggccgccagcgacagagccagaagacaggcccagcaggacagagacgagatggccgacgaggtggccaacggcaacctgagcaaggccgccatcctggaggagaagagacagctggagggcagactgggccagctggaggaggagctggaggaggagcagagcaacagcgagctgctgaacgacagatacagaaagctgctgctgcaggtggagagcctgaccaccgagctgagcgccgagagaagcttcagcgccaaggccgagagcggcagacagcagctggagagacagatccaggagctgagaggcagactgggcgaggaggacgccggcgccagagccagacacaagatgaccatcgccgccctggagagcaagctggcccaggccgaggagcagctggagcaggagaccagagagagaatcctgagcggcaagctggtgagaagagccgagaagagactgaaggaggtggtgctgcaggtggaggaggagagaagagtggccgaccagctgagagaccagctggagaagggcaacctgagagtgaagcagctgaagagacagctggaggaggccgaggaggaggccagcagagcccaggccggcagaagaagactgcagagagagctggaggacgtgaccgagagcgccgagagcatgaacagagaggtgaccaccctgagaaacagactgagaagaggccccctgaccttcaccaccagaaccgtgagacaggtgttcagactggaggagggcgtggccagcgacgaggaggccgaggaggcccagcccggcagcggccccagccccgagcccgagggcagcccccccgcccacccccagtag

SEQ ID NO: 89974 - DNA, 5823 bp, Artificial Sequence
  Description of Artificial Sequence: Synthetic coding sequence
atgagcagcgacaccgagatggaggtgttcggcatcgccgcccccttcctgagaaagagcgagaaggagagaatcgaggcccagaaccagcccttcgacgccaagacctactgcttcgtggtggacagcaaggaggagtacgccaagggcaagatcaagagcagccaggacggcaaggtgaccgtggagaccgaggacaacagaaccctggtggtgaagcccgaggacgtgtacgccatgaacccccccaagttcgacagaatcgaggacatggccatgctgacccacctgaacgagcccgccgtgctgtacaacctgaaggacagatacaccagctggatgatctacacctacagcggcctgttctgcgtgaccgtgaacccctacaagtggctgcccgtgtacaaccccgaggtggtggagggctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgccaccggcgacctggccaagaagaaggacagcaagatgaagggcaccctggaggaccagatcatcagcgccaaccccctgctggaggccttcggcaacgccaagaccgtgagaaacgacaacagcagcagattcggcaagttcatcagaatccacttcggcaccaccggcaagctggccagcgccgacatcgagacctacctgctggagaagagcagagtgaccttccagctgaaggccgagagaagctaccacatcttctaccagatcctgagcaacaagaagcccgagctgatcgagctgctgctgatcaccaccaacccctacgactaccccttcatcagccagggcgagatcctggtggccagcatcgacgacgccgaggagctgctggccaccgacagcgccatcgacatcctgggcttcacccccgaggagaagagcggcctgtacaagctgaccggcgccgtgatgcactacggcaacatgaagttcaagcagaagcagagagaggagcaggccgagcccgacggcaccgaggtggccgacaagaccgcctacctgatgggcctgaacagcagcgacctgctgaaggccctgtgcttccccagagtgaaggtgggcaacgagtacgtgaccaagggccagaccgtggaccaggtgcaccacgccgtgaacgccctgagcaagagcgtgtacgagaagctgttcctgtggatggtgaccagaatcaaccagcagctggacaccaagctgcccagacagcacttcatcggcgtgctggacatcgccggcttcgagatcttcgagtacaacagcctggagcagctgtgcatcaacttcaccaacgagaagctgcagcagttcttcaaccaccacatgttcgtgctggagcaggaggagtacaagaaggagggcatcgagtggaccttcatcgacttcggcatggacctggccgcctgcatcgagctgatcgagaagcccatgggcatcttcagcatcctggaggaggagtgcatgttccccaaggccaccgacaccagcttcaagaacaagctgtacgaccagcacctgggcaagagcaacaacttccagaagcccaaggtggtgaagggcagagccgaggcccacttcagcctgatccactacgccggcaccgtggactacagcgtgagcggctggctggagaagaacaaggaccccctgaacgagaccgtggtgggcctgtaccagaagagcagcaacagactgctggcccacctgtacgccaccttcgccaccgccgacgccgacagcggcaagaagaaggtggccaagaagaagggcagcagcttccagaccgtgagcgccctgttcagagagaacctgaacaagctgatgagcaacctgagaaccacccacccccacttcgtgagatgcatcatccccaacgagaccaagacccccggcgccatggagcacagcctggtgctgcaccagctgagatgcaacggcgtgctggagggcatcagaatctgcagaaagggcttccccaacagaatcctgtacggcgacttcaagcagagatacagagtgctgaacgccagcgccatccccgagggccagttcatcgacagcaagaaggcctgcgagaagctgctggccagcatcgacatcgaccacacccagtacaagttcggccacaccaaggtgttcttcaaggccggcctgctgggcaccctggaggagatgagagacgacagactggccaagctgatcaccagaacccaggccgtgtgcagaggcttcctgatgagagtggagttccagaagatggtgcagagaagagagagcatcttctgcatccagtacaacatcagaagcttcatgaacgtgaagcactggccctggatgaagctgttcttcaagatcaagcccctgctgaagagcgccgagaccgagaaggagatggccaccatgaaggaggagttccagaagaccaaggacgagctggccaagagcgaggccaagagaaaggagctggaggagaagctggtgaccctggtgcaggagaagaacgacctgcagctgcaggtgcaggccgagagcgagaacctgctggacgccgaggagagatgcgaccagctgatcaaggccaagttccagctggaggccaagatcaaggaggtgaccgagagagccgaggacgaggaggagatcaacgccgagctgaccgccaagaagagaaagctggaggacgagtgcagcgagctgaagaaggacatcgacgacctggagctgaccctggccaaggtggagaaggagaagcacgccaccgagaacaaggtgaagaacctgaccgaggagctgagcggcctggacgagaccatcgccaagctgaccagagagaagaaggccctgcaggaggcccaccagcaggccctggacgacctgcaggccgaggaggacaaggtgaacagcctgaacaagaccaagagcaagctggagcagcaggtggaggacctggagagcagcctggagcaggagaagaagctgagagtggacctggagagaaacaagagaaagctggagggcgacctgaagctggcccaggagagcatcctggacctggagaacgacaagcagcagctggacgagagactgaagaagaaggacttcgagtactgccagctgcagagcaaggtggaggacgagcagaccctgggcctgcagttccagaagaagatcaaggagctgcaggccagaatcgaggagctggaggaggagatcgaggccgagagagccaccagagccaagaccgagaagcagagaagcgactacgccagagagctggaggagctgagcgagagactggaggaggccggcggcgtgaccagcacccagatcgagctgaacaagaagagagaggccgagttcctgaagctgagaagagacctggaggaggccaccctgcagcacgaggccatggtggccgccctgagaaagaagcacgccgacagcgtggccgagctgggcgagcagatcgacaacctgcagagagtgaagcagaagctggagaaggagaagagcgagttcaagctggagatcgacgacctgagcagcagcatggagagcgtgagcaagagcaaggccaacctggagaagatctgcagaaccctggaggaccagctgagcgaggccagaggcaagaacgaggagatccagagaagcctgagcgagctgaccacccagaagagcagactgcagaccgaggccggcgagctgagcagacagctggaggagaaggagagcatcgtgagccagctgagcagaagcaagcaggccttcacccagcagaccgaggagctgaagagacagctggaggaggagaacaaggccaagaacgccctggcccacgccctgcagagcagcagacacgactgcgacctgctgagagagcagtacgaggaggagcaggagggcaaggccgagctgcagagagccctgagcaaggccaacagcgaggtggcccagtggagaaccaagtacgagaccgacgccatccagagaaccgaggagctggaggaggccaagaagaagctggcccagagactgcaggacagcgaggagcaggtggaggccgtgaacgccaagtgcgccagcctggagaagaccaagcagagactgcagggcgaggtggaggacctgatggtggacgtggagagagccaacagcctggccgccgccctggacaagaagcagagaaacttcgacaaggtgctggccgagtggaagaccaagtgcgaggagagccaggccgagctggaggccagcctgaaggagagcagaagcctgagcaccgagctgttcaagctgaagaacgcctacgaggaggccctggaccagctggagaccgtgaagagagagaacaagaacctggagcaggagatcgccgacctgaccgagcagatcgccgagaacggcaagaccatccacgagctggagaagagcagaaagcagatcgagctggagaaggccgacatccagctggccctggaggaggccgaggccgccctggagcacgaggaggccaagatcctgagaatccagctggagctgacccaggtgaagagcgagatcgacagaaagatcgccgagaaggacgaggagatcgagcagctgaagagaaactaccagagaaccgtggagaccatgcagagcgccctggacgccgaggtgagaagcagaaacgaggccatcagactgaagaagaagatggagggcgacctgaacgagatcgagatccagctgagccacgccaacagacaggccgccgagaccctgaagcacctgagaagcgtgcagggccagctgaaggacacccagctgcacctggacgacgccctgagaggccaggaggacctgaaggagcagctggccatcgtggagagaagagccaacctgctgcaggccgaggtggaggagctgagagccaccctggagcagaccgagagagccagaaagctggccgagcaggagctgctggacagcaacgagagagtgcagctgctgcacacccagaacaccagcctgatccacaccaagaagaagctggagaccgacctgatgcagctgcagagcgaggtggaggacgccagcagagacgccagaaacgccgaggagaaggccaagaaggccatcaccgacgccgccatgatggccgaggagctgaagaaggagcaggacaccagcgcccacctggagagaatgaagaagaacctggagcagaccgtgaaggacctgcagcacagactggacgaggccgagcagctggccctgaagggcggcaagaagcagatccagaagctggagaccagaatcagagagctggagttcgagctggagggcgagcagaagaagaacaccgagagcgtgaagggcctgagaaagtacgagagaagagtgaaggagctgacctaccagagcgaggaggacagaaagaacgtgctgagactgcaggacctggtggacaagctgcaggtgaaggtgaagagctacaagagacaggccgaggaggccgacgagcaggccaacgcccacctgaccaagttcagaaaggcccagcacgagctggaggaggccgaggagagagccgacatcgccgagagccaggtgaacaagctgagagccaagaccagagacttcaccagcagcagaatggtggtgcacgagagcgaggagtag

SEQ ID NO: 89975 - DNA, 3132 bp, Artificial Sequence
  Description of Artificial Sequence: Synthetic coding sequence
atgcccctgctggagggcagcgtgggcgtggaggacctggtgctgctggagcccctggtggaggagagcctgctgaagaacctgcagctgagatacgagaacaaggagatctacacctacatcggcaacgtggtgatcagcgtgaacccctaccagcagctgcccatctacggccccgagttcatcgccaagtaccaggactacaccttctacgagctgaagccccacatctacgccctggccaacgtggcctaccagagcctgagagacagagacagagaccagtgcatcctgatcaccggcgagagcggcagcggcaagaccgaggccagcaagctggtgatgagctacgtggccgccgtgtgcggcaagggcgagcaggtgaacagcgtgaaggagcagctgctgcagagcaaccccgtgctggaggccttcggcaacgccaagaccatcagaaacaacaacagcagcagattcggcaagtacatggacatcgagttcgacttcaagggcagccccctgggcggcgtgatcaccaactacctgctggagaagagcagactggtgaagcagctgaagggcgagagaaacttccacatcttctaccagctgctggccggcgccgacgagcagctgctgaaggccctgaagctggagagagacaccaccggctacgcctacctgaaccacgaggtgagcagagtggacggcatggacgacgccagcagcttcagagccgtgcagagcgccatggccgtgatcggcttcagcgaggaggagatcagacaggtgctggaggtgaccagcatggtgctgaagctgggcaacgtgctggtggccgacgagttccaggccagcggcatccccgccagcggcatcagagacggcagaggcgtgagagagatcggcgagatggtgggcctgaacagcgaggaggtggagagagccctgtgcagcagaaccatggagaccgccaaggagaaggtggtgaccgccctgaacgtgatgcaggcccagtacgccagagacgccctggccaagaacatctacagcagactgttcgactggatcgtgaacagaatcaacgagagcatcaaggtgggcatcggcgagaagaagaaggtgatgggcgtgctggacatctacggcttcgagatcctggaggacaacagcttcgagcagttcgtgatcaactactgcaacgagaagctgcagcaggtgttcatcgagatgaccctgaaggaggagcaggaggagtacaagagagagggcatcccctggaccaaggtggactacttcgacaacggcatcatctgcaagctgatcgagcacaaccagagaggcatcctggccatgctggacgaggagtgcctgagacccggcgtggtgagcgacagcaccttcctggccaagctgaaccagctgttcagcaagcacggccactacgagagcaaggtgacccagaacgcccagagacagtacgaccacaccatgggcctgagctgcttcagaatctgccactacgccggcaaggtgacctacaacgtgaccagcttcatcgacaagaacaacgacctgctgttcagagacctgctgcaggccatgtggaaggcccagcaccccctgctgagaagcctgttccccgagggcaaccccaagcaggccagcctgaagagaccccccaccgccggcgcccagttcaagagcagcgtggccatcctgatgaagaacctgtacagcaagagccccaactacatcagatgcatcaagcccaacgagcaccagcagagaggccagttcagcagcgacctggtggccacccaggccagatacctgggcctgctggagaacgtgagagtgagaagagccggctacgcccacagacagggctacggccccttcctggagagatacagactgctgagcagaagcacctggccccactggaacggcggcgacagagagggcgtggagaaggtgctgggcgagctgagcatgagcagcggcgagctggccttcggcaagaccaagatcttcatcagaagccccaagaccctgttctacctggaggagcagagaagactgagactgcagcagctggccaccctgatccagaagatctacagaggctggagatgcagaacccactaccagctgatgagaaagagccagatcctgatcagcagctggttcagaggcaacatgcagaagaagtgctacggcaagatcaaggccagcgtgctgctgatccaggccttcgtgagaggctggaaggccagaaagaactacagaaagtacttcagaagcgaggccgccctgaccctggccgacttcatctacaagagcatggtgcagaagttcctgctgggcctgaagaacaacctgcccagcaccaacgtgctggacaagacctggcccgccgccccctacaagtgcctgagcaccgccaaccaggagctgcagcagctgttctaccagtggaagtgcaagagattcagagaccagctgagccccaagcaggtggagatcctgagagagaagctgtgcgccagcgagctgttcaagggcaagaaggccagctacccccagagcgtgcccatccccttctgcggcgactacatcggcctgcagggcaaccccaagctgcagaagctgaagggcggcgaggagggccccgtgctgatggccgaggccgtgaagaaggtgaacagaggcaacggcaagaccagcagcagaatcctgctgctgaccaagggccacgtgatcctgaccgacaccaagaagagccaggccaagatcgtgatcggcctggacaacgtggccggcgtgagcgtgaccagcctgaaggacggcctgttcagcctgcacctgagcgagatgagcagcgtgggcagcaagggcgacttcctgctggtgagcgagcacgtgatcgagctgctgaccaagatgtacagagccgtgctggacgccacccagagacagctgaccgtgaccgtgaccgagaagttcagcgtgagattcaaggagaacagcgtggccgtgaaggtggtgcagggccccgccggcggcgacaacagcaagctgagatacaagaagaagggcagccactgcctggaggtgaccgtgcagtag

SEQ ID NO: 89976 - DNA, 291 bp, Artificial Sequence
  Description of Artificial Sequence: Synthetic coding sequence
atgcccctgctggagggcagcgtgggcgtggaggacctggtgctgctggagcccctggtggaggagagcctgctgaagaacctgcagctgagatacgagaacaaggagatctacacctacatcggcaacgtggtgatcagcgtgaacccctaccagcagctgcccatctacggccccgagttcatcgccaagtaccaggactacaccttctacgagctgaagccccacatctacgccctggccaacgtggcctaccagagcctgagagacagagacagagaccagtgctag

SEQ ID NO: 89977 - DNA, 3132 bp, Artificial Sequence; identical to SEQ ID NO: 89975
  Description of Artificial Sequence: Synthetic coding sequence

SEQ ID NO: 89978 - DNA, 2646 bp, Artificial Sequence
  Description of Artificial Sequence: Synthetic coding sequence
atggacatcgagttcgacttcaagggcagccccctgggcggcgtgatcaccaactacctgctggagaagagcagactggtgaagcagctgaagggcgagagaaacttccacatcttctaccagctgctggccggcgccgacgagcagctgctgaaggccctgaagctggagagagacaccaccggctacgcctacctgaaccacgaggtgagcagagtggacggcatggacgacgccagcagcttcagagccgtgcagagcgccatggccgtgatcggcttcagcgaggaggagatcagacaggtgctggaggtgaccagcatggtgctgaagctgggcaacgtgctggtggccgacgagttccaggccagcggcatccccgccagcggcatcagagacggcagaggcgtgagagagatcggcgagatggtgggcctgaacagcgaggaggtggagagagccctgtgcagcagaaccatggagaccgccaaggagaaggtggtgaccgccctgaacgtgatgcaggcccagtacgccagagacgccctggccaagaacatctacagcagactgttcgactggatcgtgaacagaatcaacgagagcatcaaggtgggcatcggcgagaagaagaaggtgatgggcgtgctggacatctacggcttcgagatcctggaggacaacagcttcgagcagttcgtgatcaactactgcaacgagaagctgcagcaggtgttcatcgagatgaccctgaaggaggagcaggaggagtacaagagagagggcatcccctggaccaaggtggactacttcgacaacggcatcatctgcaagctgatcgagcacaaccagagaggcatcctggccatgctggacgaggagtgcctgagacccggcgtggtgagcgacagcaccttcctggccaagctgaaccagctgttcagcaagcacggccactacgagagcaaggtgacccagaacgcccagagacagtacgaccacaccatgggcctgagctgcttcagaatctgccactacgccggcaaggtgacctacaacgtgaccagcttcatcgacaagaacaacgacctgctgttcagagacctgctgcaggccatgtggaaggcccagcaccccctgctgagaagcctgttccccgagggcaaccccaagcaggccagcctgaagagaccccccaccgccggcgcccagttcaagagcagcgtggccatcctgatgaagaacctgtacagcaagagccccaactacatcagatgcatcaagcccaacgagcaccagcagagaggccagttcagcagcgacctggtggccacccaggccagatacctgggcctgctggagaacgtgagagtgagaagagccggctacgcccacagacagggctacggccccttcctggagagatacagactgctgagcagaagcacctggccccactggaacggcggcgacagagagggcgtggagaaggtgctgggcgagctgagcatgagcagcggcgagctggccttcggcaagaccaagatcttcatcagaagccccaagaccctgttctacctggaggagcagagaagactgagactgcagcagctggccaccctgatccagaagatctacagaggctggagatgcagaacccactaccagctgatgagaaagagccagatcctgatcagcagctggttcagaggcaacatgcagaagaagtgctacggcaagatcaaggccagcgtgctgctgatccaggccttcgtgagaggctggaaggccagaaagaactacagaaagtacttcagaagcgaggccgccctgaccctggccgacttcatctacaagagcatggtgcagaagttcctgctgggcctgaagaacaacctgcccagcaccaacgtgctggacaagacctggcccgccgccccctacaagtgcctgagcaccgccaaccaggagctgcagcagctgttctaccagtggaagtgcaagagattcagagaccagctgagccccaagcaggtggagatcctgagagagaagctgtgcgccagcgagctgttcaagggcaagaaggccagctacccccagagcgtgcccatccccttctgcggcgactacatcggcctgcagggcaaccccaagctgcagaagctgaagggcggcgaggagggccccgtgctgatggccgaggccgtgaagaaggtgaacagaggcaacggcaagaccagcagcagaatcctgctgctgaccaagggccacgtgatcctgaccgacaccaagaagagccaggccaagatcgtgatcggcctggacaacgtggccggcgtgagcgtgaccagcctgaaggacggcctgttcagcctgcacctgagcgagatgagcagcgtgggcagcaagggcgacttcctgctggtgagcgagcacgtgatcgagctgctgaccaagatgtacagagccgtgctggacgccacccagagacagctgaccgtgaccgtgaccgagaagttcagcgtgagattcaaggagaacagcgtggccgtgaaggtggtgcagggccccgccggcggcgacaacagcaagctgagatacaagaagaagggcagccactgcctggaggtgaccgtgcagtag

SEQ ID NO: 89979 - DNA, 3411 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctggaggccttcggcaacgccaagaccgtgagaaacgacaacagcagcagattcggcaagtacatggacatcgagttcgacttcaagggcgaccccctgggcggcgtgatcagcaactacctgctggagaagagcagagtggtgaagcagcccagaggcgagagaaacttccacgtgttctaccagctgctgagcggcgccagcgaggagctgctgaacaagctgaagctggagagagacttcagcagatacaactacctgagcctggacagcgccaaggtgaacggcgtggacgacgccgccaacttcagaaccgtgagaaacgccatgcagatcgtgggcttcatggaccacgaggccgagagcgtgctggccgtggtggccgccgtgctgaagctgggcaacatcgagttcaagcccgagagcagagtgaacggcctggacgagagcaagatcaaggacaagaacgagctgaaggagatctgcgagctgaccggcatcgaccagagcgtgctggagagagccttcagcttcagaaccgtggaggccaagcaggagaaggtgagcaccaccctgaacgtggcccaggcctactacgccagagacgccctggccaagaacctgtacagcagactgttcagctggctggtgaacagaatcaacgagagcatcaaggcccagaccaaggtgagaaagaaggtgatgggcgtgctggacatctacggcttcgagatcttcgaggacaacagcttcgagcagttcatcatcaactactgcaacgagaagctgcagcagatcttcatcgagctgaccctgaaggaggagcaggaggagtacatcagagaggacatcgagtggacccacatcgactacttcaacaacgccatcatctgcgacctgatcgagaacaacaccaacggcatcctggccatgctggacgaggagtgcctgagacccggcaccgtgaccgacgagaccttcctggagaagctgaaccaggtgtgcgccacccaccagcacttcgagagcagaatgagcaagtgcagcagattcctgaacgacaccagcctgccccacagctgcttcagaatccagcactacgccggcaaggtgctgtaccaggtggagggcttcgtggacaagaacaacgacctgctgtacagagacctgagccaggccatgtggaaggccagccacgccctgatcaagagcctgttccccgagggcaaccccgccaagatcaacctgaagagaccccccaccgccggcagccagttcaaggccagcgtggccaccctgatgaagaacctgcagaccaagaaccccaactacatcagatgcatcaagcccaacgacaagaaggccgcccacatcttcaacgaggccctggtgtgccaccagatcagatacctgggcctgctggagaacgtgagagtgagaagagccggctacgccttcagacaggcctacgagccctgcctggagagatacaagatgctgtgcaagcagacctggccccactggaagggccccgccagaagcggcgtggaggtgctgttcaacgagctggagatccccgtggaggagtacagcttcggcagaagcaagatcttcatcagaaaccccagaaccctgttcaagctggaggacctgagaaagcagagactggaggacctggccaccctgatccagaagatctacagaggctggaagtgcagaacccacttcctgctgatgaagaagagccagatcgtgatcgccgcctggtacagaagatacgcccagcagaagagataccagcagaccaagagcagcgccctggtgatccagagctacatcagaggctggaaggccagaaagatcctgagagagctgaagcaccagaagagatgcaaggaggccgtgaccaccatcgccgcctactggcacggcacccaggccagaagagagctgagaagactgaaggaggaggccagaaacaagcacgccatcgccgtgatctgggcctactggctgggcagcaaggccagaagagagctgaagagactgaaggaggaggccagaagaaagcacgccgtggccgtgatctgggcctactggctgggcctgaaggtgagaagagagtacagaaagttcttcagagccaacgccggcaagaagatctacgagttcaccctgcagagaatcgtgcagaagtacttcctggagatgaagaacaagatgcccagcctgagccccatcgacaagaactggcccagcagaccctacctgttcctggacagcacccacaaggagctgaagagaatcttccacctgtggagatgcaagaagtacagagaccagttcaccgaccagcagaagctgatctacgaggagaagctggaggccagcgagctgttcaaggacaagaaggccctgtaccccagcagcgtgggccagcccttccagggcgcctacctggagatcaacaagaaccccaagtacaagaagctgaaggacgccatcgaggagaagatcatcatcgccgaggtggtgaacaagatcaacagagccaacggcaagagcaccagcagaatcttcctgctgaccaacaacaacctgctgctggccgaccagaagagcggccagatcaagagcgaggtgcccctggtggacgtgaccaaggtgagcatgagcagccagaacgacggcttcttcgccgtgcacctgaaggagggcagcgaggccgccagcaagggcgacttcctgttcagcagcgaccacctgatcgagatggccaccaagctgtacagaaccaccctgagccagaccaagcagaagctgaacatcgagatcagcgacgagttcctggtgcagttcagacaggacaaggtgtgcgtgaagttcatccagggcaaccagaagaacggcagcgtgcccacctgcaagagaaagaacaacagactgctggaggtggccgtgccctag

SEQ ID NO: 89980 - DNA, 3237 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctggaggccttcggcaacgccaagaccgtgagaaacgacaacagcagcagattcggcaagtacatggacatcgagttcgacttcaagggcgaccccctgggcggcgtgatcagcaactacctgctggagaagagcagagtggtgaagcagcccagaggcgagagaaacttccacgtgttctaccagctgctgagcggcgccagcgaggagctgctgaacaagctgaagctggagagagacttcagcagatacaactacctgagcctggacagcgccaaggtgaacggcgtggacgacgccgccaacttcagaaccgtgagaaacgccatgcagatcgtgggcttcatggaccacgaggccgagagcgtgctggccgtggtggccgccgtgctgaagctgggcaacatcgagttcaagcccgagagcagagtgaacggcctggacgagagcaagatcaaggacaagaacgagctgaaggagatctgcgagctgaccggcatcgaccagagcgtgctggagagagccttcagcttcagaaccgtggaggccaagcaggagaaggtgagcaccaccctgaacgtggcccaggcctactacgccagagacgccctggccaagaacctgtacagcagactgttcagctggctggtgaacagaatcaacgagagcatcaaggcccagaccaaggtgagaaagaaggtgatgggcgtgctggacatctacggcttcgagatcttcgaggacaacagcttcgagcagttcatcatcaactactgcaacgagaagctgcagcagatcttcatcgagctgaccctgaaggaggagcaggaggagtacatcagagaggacatcgagtggacccacatcgactacttcaacaacgccatcatctgcgacctgatcgagaacaacaccaacggcatcctggccatgctggacgaggagtgcctgagacccggcaccgtgaccgacgagaccttcctggagaagctgaaccaggtgtgcgccacccaccagcacttcgagagcagaatgagcaagtgcagcagattcctgaacgacaccagcctgccccacagctgcttcagaatccagcactacgccggcaaggtgctgtaccaggtggagggcttcgtggacaagaacaacgacctgctgtacagagacctgagccaggccatgtggaaggccagccacgccctgatcaagagcctgttccccgagggcaaccccgccaagatcaacctgaagagaccccccaccgccggcagccagttcaaggccagcgtggccaccctgatgaagaacctgcagaccaagaaccccaactacatcagatgcatcaagcccaacgacaagaaggccgcccacatcttcaacgaggccctggtgtgccaccagatcagatacctgggcctgctggagaacgtgagagtgagaagagccggctacgccttcagacaggcctacgagccctgcctggagagatacaagatgctgtgcaagcagacctggccccactggaagggccccgccagaagcggcgtggaggtgctgttcaacgagctggagatccccgtggaggagtacagcttcggcagaagcaagatcttcatcagaaaccccagaaccctgttcaagctggaggacctgagaaagcagagactggaggacctggccaccctgatccagaagatctacagaggctggaagtgcagaacccacttcctgctgatgaagaagagccagatcgtgatcgccgcctggtacagaagatacgcccagcagaagagataccagcagaccaagagcagcgccctggtgatccagagctacatcagaggctggaaggccagaaagatcctgagagagctgaagcaccagaagagatgcaaggaggccgtgaccaccatcgccgcctactggcacggcacccaggtgagaagagagtacagaaagttcttcagagccaacgccggcaagaagatctacgagttcaccctgcagagaatcgtgcagaagtacttcctggagatgaagaacaagatgcccagcctgagccccatcgacaagaactggcccagcagaccctacctgttcctggacagcacccacaaggagctgaagagaatcttccacctgtggagatgcaagaagtacagagaccagttcaccgaccagcagaagctgatctacgaggagaagctggaggccagcgagctgttcaaggacaagaaggccctgtaccccagcagcgtgggccagcccttccagggcgcctacctggagatcaacaagaaccccaagtacaagaagctgaaggacgccatcgaggagaagatcatcatcgccgaggtggtgaacaagatcaacagagccaacggcaagagcaccagcagaatcttcctgctgaccaacaacaacctgctgctggccgaccagaagagcggccagatcaagagcgaggtgcccctggtggacgtgaccaaggtgagcatgagcagccagaacgacggcttcttcgccgtgcacctgaaggagggcagcgaggccgccagcaagggcgacttcctgttcagcagcgaccacctgatcgagatggccaccaagctgtacagaaccaccctgagccagaccaagcagaagctgaacatcgagatcagcgacgagttcctggtgcagttcagacaggacaaggtgtgcgtgaagttcatccagggcaaccagaagaacggcagcgtgcccacctgcaagagaaagaacaacagactgctggaggtggccgtgccctag

SEQ ID NO: 89981 - DNA, 3324 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctggaggccttcggcaacgccaagaccgtgagaaacgacaacagcagcagattcggcaagtacatggacatcgagttcgacttcaagggcgaccccctgggcggcgtgatcagcaactacctgctggagaagagcagagtggtgaagcagcccagaggcgagagaaacttccacgtgttctaccagctgctgagcggcgccagcgaggagctgctgaacaagctgaagctggagagagacttcagcagatacaactacctgagcctggacagcgccaaggtgaacggcgtggacgacgccgccaacttcagaaccgtgagaaacgccatgcagatcgtgggcttcatggaccacgaggccgagagcgtgctggccgtggtggccgccgtgctgaagctgggcaacatcgagttcaagcccgagagcagagtgaacggcctggacgagagcaagatcaaggacaagaacgagctgaaggagatctgcgagctgaccggcatcgaccagagcgtgctggagagagccttcagcttcagaaccgtggaggccaagcaggagaaggtgagcaccaccctgaacgtggcccaggcctactacgccagagacgccctggccaagaacctgtacagcagactgttcagctggctggtgaacagaatcaacgagagcatcaaggcccagaccaaggtgagaaagaaggtgatgggcgtgctggacatctacggcttcgagatcttcgaggacaacagcttcgagcagttcatcatcaactactgcaacgagaagctgcagcagatcttcatcgagctgaccctgaaggaggagcaggaggagtacatcagagaggacatcgagtggacccacatcgactacttcaacaacgccatcatctgcgacctgatcgagaacaacaccaacggcatcctggccatgctggacgaggagtgcctgagacccggcaccgtgaccgacgagaccttcctggagaagctgaaccaggtgtgcgccacccaccagcacttcgagagcagaatgagcaagtgcagcagattcctgaacgacaccagcctgccccacagctgcttcagaatccagcactacgccggcaaggtgctgtaccaggtggagggcttcgtggacaagaacaacgacctgctgtacagagacctgagccaggccatgtggaaggccagccacgccctgatcaagagcctgttccccgagggcaaccccgccaagatcaacctgaagagaccccccaccgccggcagccagttcaaggccagcgtggccaccctgatgaagaacctgcagaccaagaaccccaactacatcagatgcatcaagcccaacgacaagaaggccgcccacatcttcaacgaggccctggtgtgccaccagatcagatacctgggcctgctggagaacgtgagagtgagaagagccggctacgccttcagacaggcctacgagccctgcctggagagatacaagatgctgtgcaagcagacctggccccactggaagggccccgccagaagcggcgtggaggtgctgttcaacgagctggagatccccgtggaggagtacagcttcggcagaagcaagatcttcatcagaaaccccagaaccctgttcaagctggaggacctgagaaagcagagactggaggacctggccaccctgatccagaagatctacagaggctggaagtgcagaacccacttcctgctgatgaagaagagccagatcgtgatcgccgcctggtacagaagatacgcccagcagaagagataccagcagaccaagagcagcgccctggtgatccagagctacatcagaggctggaaggccagaaagatcctgagagagctgaagcaccagaagagatgcaaggaggccgtgaccaccatcgccgcctactggcacggcacccaggccagaagagagctgaagagactgaaggaggaggccagaagaaagcacgccgtggccgtgatctgggcctactggctgggcctgaaggtgagaagagagtacagaaagttcttcagagccaacgccggcaagaagatctacgagttcaccctgcagagaatcgtgcagaagtacttcctggagatgaagaacaagatgcccagcctgagccccatcgacaagaactggcccagcagaccctacctgttcctggacagcacccacaaggagctgaagagaatcttccacctgtggagatgcaagaagtacagagaccagttcaccgaccagcagaagctgatctacgaggagaagctggaggccagcgagctgttcaaggacaagaaggccctgtaccccagcagcgtgggccagcccttccagggcgcctacctggagatcaacaagaaccccaagtacaagaagctgaaggacgccatcgaggagaagatcatcatcgccgaggtggtgaacaagatcaacagagccaacggcaagagcaccagcagaatcttcctgctgaccaacaacaacctgctgctggccgaccagaagagcggccagatcaagagcgaggtgcccctggtggacgtgaccaaggtgagcatgagcagccagaacgacggcttcttcgccgtgcacctgaaggagggcagcgaggccgccagcaagggcgacttcctgttcagcagcgaccacctgatcgagatggccaccaagctgtacagaaccaccctgagccagaccaagcagaagctgaacatcgagatcagcgacgagttcctggtgcagttcagacaggacaaggtgtgcgtgaagttcatccagggcaaccagaagaacggcagcgtgcccacctgcaagagaaagaacaacagactgctggaggtggccgtgccctag

SEQ ID NO: 89982 - DNA, 3411 bp, Artificial Sequence; identical to SEQ ID NO: 89979
  Description of Artificial Sequence: Synthetic coding sequence

SEQ ID NO: 89983 - DNA, 492 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctggaggccttcggcaacgccaagaccgtgagaaacgacaacagctag

SEQ ID NO: 89984 - DNA, 252 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccactag

SEQ ID NO: 89985 - DNA, 450 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctgtag

SEQ ID NO: 89986 - DNA, 1146 bp, Artificial Sequence
  Description of Artificial Sequence: Synthetic coding sequence
atgaagaagagccagatcgtgatcgccgcctggtacagaagatacgcccagcagaagagataccagcagaccaagagcagcgccctggtgatccagagctacatcagaggctggaaggccagaaagatcctgagagagctgaagcaccagaagagatgcaaggaggccgtgaccaccatcgccgcctactggcacggcacccaggccagaagagagctgaagagactgaaggaggaggccagaagaaagcacgccgtggccgtgatctgggcctactggctgggcctgaaggtgagaagagagtacagaaagttcttcagagccaacgccggcaagaagatctacgagttcaccctgcagagaatcgtgcagaagtacttcctggagatgaagaacaagatgcccagcctgagccccatcgacaagaactggcccagcagaccctacctgttcctggacagcacccacaaggagctgaagagaatcttccacctgtggagatgcaagaagtacagagaccagttcaccgaccagcagaagctgatctacgaggagaagctggaggccagcgagctgttcaaggacaagaaggccctgtaccccagcagcgtgggccagcccttccagggcgcctacctggagatcaacaagaaccccaagtacaagaagctgaaggacgccatcgaggagaagatcatcatcgccgaggtggtgaacaagatcaacagagccaacggcaagagcaccagcagaatcttcctgctgaccaacaacaacctgctgctggccgaccagaagagcggccagatcaagagcgaggtgcccctggtggacgtgaccaaggtgagcatgagcagccagaacgacggcttcttcgccgtgcacctgaaggagggcagcgaggccgccagcaagggcgacttcctgttcagcagcgaccacctgatcgagatggccaccaagctgtacagaaccaccctgagccagaccaagcagaagctgaacatcgagatcagcgacgagttcctggtgcagttcagacaggacaaggtgtgcgtgaagttcatccagggcaaccagaagaacggcagcgtgcccacctgcaagagaaagaacaacagactgctggaggtggccgtgccctag

SEQ ID NO: 89987 - DNA, 924 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctggaggccttcggcaacgccaagaccgtgagaaacgacaacagcagcagattcggcaagtacatggacatcgagttcgacttcaagggcgaccccctgggcggcgtgatcagcaactacctgctggagaagagcagagtggtgaagcagcccagaggcgagagaaacttccacgtgttctaccagctgctgagcggcgccagcgaggagctgctgaacaagctgaagctggagagagacttcagcagatacaactacctgagcctggacagcgccaaggtgaacggcgtggacgacgccgccaacttcagaaccgtgagaaacgccatgcagatcgtgggcttcatggaccacgaggccgagagcgtgctggccgtggtggccgccgtgctgaagctgggcaacatcgagttcaagcccgagagcagagtgaacggcctggacgagagcaagatcaaggacaagaacgagagcaagtag

SEQ ID NO: 89988 - DNA, 912 bp, Artificial Sequence
  Description of Artificial Sequence: Synthetic coding sequence
atggccaagatggaggtgaagaccagcctgctggacaacatgatcggcgtgggcgacatggtgctgctggagcccctgaacgaggagaccttcatcaacaacctgaagaagagattcgaccacagcgagatctacacctacatcggcagcgtggtgatcagcgtgaacccctacagaagcctgcccatctacagccccgagaaggtggaggagtacagaaacagaaacttctacgagctgagcccccacatcttcgccctgagcgacgaggcctacagaagcctgagagaccaggacaaggaccagtgcatcctgatcaccggcgagagcggcgccggcaagaccgaggccagcaagctggtgatgagctacgtggccgccgtgtgcggcaagggcgccgaggtgaaccaggtgaaggagcagctgctgcagagcaaccccgtgctggaggccttcggcaacgccaagaccgtgagaaacgacaacagcagcagattcggcaagtacatggacatcgagttcgacttcaagggcgaccccctgggcggcgtgatcagcaactacctgctggagaagagcagagtggtgaagcagcccagaggcgagagaaacttccacgtgttctaccagctgctgagcggcgccagcgaggagctgctgaacaagctgaagctggagagagacttcagcagatacaactacctgagcctggacagcgccaaggtgaacggcgtggacgacgccgccaacttcagaaccgtgagaaacgccatgcagatcgtgggcttcatggaccacgaggccgagagcgtgctggccgtggtggccgccgtgctgaagctgggcaacatcgagttcaagcccgagagcagagtgaacggcctggacgagagcaagatcaaggacaagtag

SEQ ID NO: 89989 - DNA, 3192 bp, Artificial Sequence
  Description of Artificial Sequence: Synthetic coding sequence
atggccctgcaggtggagctggtgcccaccggcgagatcatcagagtggtgcacccccacagaccctgcaagctggccctgggcagcgacggcgtgagagtgaccatggagagcgccctgaccgccagagacagagtgggcgtgcaggacttcgtgctgctggagaacttcaccagcgaggccgccttcatcgagaacctgagaagaagattcagagagaacctgatctacacctacatcggccccgtgctggtgagcgtgaacccctacagagacctgcagatctacagcagacagcacatggagagatacagaggcgtgagcttctacgaggtgcccccccacctgttcgccgtggccgacaccgtgtacagagccctgagaaccgagagaagagaccaggccgtgatgatcagcggcgagagcggcgccggcaagaccgaggccaccaagagactgctgcagttctacgccgagacctgccccgcccccgagagaggcggcgccgtgagagacagactgctgcagagcaaccccgtgctggaggccttcggcaacgccaagaccctgagaaacgacaacagcagcagattcggcaagtacatggacgtgcagttcgacttcaagggcgcccccgtgggcggccacatcctgagctacctgctggagaagagcagagtggtgcaccagaaccacggcgagagaaacttccacatcttctaccagctgctggagggcggcgaggaggagaccctgagaagactgggcctggagagaaacccccagagctacctgtacctggtgaagggccagtgcgccaaggtgagcagcatcaacgacaagagcgactggaaggtggtgagaaaggccctgaccgtgatcgacttcaccgaggacgaggtggaggacctgctgagcatcgtggccagcgtgctgcacctgggcaacatccacttcgccgccaacgaggagagcaacgcccaggtgaccaccgagaaccagctgaagtacctgaccagactgctgagcgtggagggcagcaccctgagagaggccctgacccacagaaagatcatcgccaagggcgaggagctgctgagccccctgaacctggagcaggccgcctacgccagagacgccctggccaaggccgtgtacagcagaaccttcacctggctggtgggcaagatcaacagaagcctggccagcaaggacgtggagagccccagctggagaagcaccaccgtgctgggcctgctggacatctacggcttcgaggtgttccagcacaacagcttcgagcagttctgcatcaactactgcaacgagaagctgcagcagctgttcatcgagctgaccctgaagagcgagcaggaggagtacgaggccgagggcatcgcctgggagcccgtgcagtacttcaacaacaagatcatctgcgacctggtggaggagaagttcaagggcatcatcagcatcctggacgaggagtgcctgagacccggcgaggccaccgacctgaccttcctggagaagctggaggacaccgtgaagcaccacccccacttcctgacccacaagctggccgaccagagaaccagaaagagcctgggcagaggcgagttcagactgctgcactacgccggcgaggtgacctacagcgtgaccggcttcctggacaagaacaacgacctgctgttcagaaacctgaaggagaccatgtgcagcagcaagaaccccatcatgagccagtgcttcgacagaagcgagctgagcgacaagaagagacccgagaccgtggccacccagttcaagatgagcctgctgcagctggtggagatcctgcagagcaaggagcccgcctacgtgagatgcatcaagcccaacgacgccaagcagcccggcagattcgacgaggtgctgatcagacaccaggtgaagtacctgggcctgctggagaacctgagagtgagaagagccggcttcgcctacagaagaaagtacgaggccttcctgcagagatacaagagcctgtgccccgagacctggcccacctgggccggcagaccccaggacggcgtggccgtgctggtgagacacctgggctacaagcccgaggagtacaagatgggcagaaccaagatcttcatcagattccccaagaccctgttcgccaccgaggacgccctggaggtgagaagacagagcctggccaccaagatccaggccgcctggagaggcttccactggagacagaagttcctgagagtgaagagaagcgccatctgcatccagagctggtggagaggcaccctgggcagaagaaaggccgccaagagaaagtgggccgcccagaccatcagaagactgatcagaggcttcgtgctgagacacgcccccagatgccccgagaacgccttcttcctggaccacgtgagaaccagcttcctgctgaacctgagaagacagctgccccagaacgtgctggacaccagctggcccacccccccccccgccctgagagaggccagcgagctgctgagagagctgtgcatcaagaacatggtgtggaagtactgcagaagcatcagccccgagtggaagcagcagctgcagcagaaggccgtggccagcgagatcttcaagggcaagaaggacaactacccccagagcgtgcccagactgttcatcagcaccagactgggcaccgacgagatcagccccagagtgctgcaggccctgggcagcgagcccatccagtacgccgtgcccgtggtgaagtacgacagaaagggctacaagcccagaagcagacagctgctgctgacccccaacgccgtggtgatcgtggaggacgccaaggtgaagcagagaatcgactacgccaacctgaccggcatcagcgtgagcagcctgagcgacagcctgttcgtgctgcacgtgcagagagccgacaacaagcagaagggcgacgtggtgctgcagagcgaccacgtgatcgagaccctgaccaagaccgccctgagcgccaacagagtgaacagcatcaacatcaaccagggcagcatcaccttcgccggcggccccggcagagacggcaccatcgacttcacccccggcagcgagctgctgatcaccaaggccaagaacggccacctggccgtggtggcccccagactgaacagcagatag

SEQ ID NO: 89990 - DNA, 3087 bp, Artificial Sequence
  Description of Artificial Sequence: Synthetic coding sequence
atggagagcgccctgaccgccagagacagagtgggcgtgcaggacttcgtgctgctggagaacttcaccagcgaggccgccttcatcgagaacctgagaagaagattcagagagaacctgatctacacctacatcggccccgtgctggtgagcgtgaacccctacagagacctgcagatctacagcagacagcacatggagagatacagaggcgtgagcttctacgaggtgcccccccacctgttcgccgtggccgacaccgtgtacagagccctgagaaccgagagaagagaccaggccgtgatgatcagcggcgagagcggcgccggcaagaccgaggccaccaagagactgctgcagttctacgccgagacctgccccgcccccgagagaggcggcgccgtgagagacagactgctgcagagcaaccccgtgctggaggccttcggcaacgccaagaccctgagaaacgacaacagcagcagattcggcaagtacatggacgtgcagttcgacttcaagggcgcccccgtgggcggccacatcctgagctacctgctggagaagagcagagtggtgcaccagaaccacggcgagagaaacttccacatcttctaccagctgctggagggcggcgaggaggagaccctgagaagactgggcctggagagaaacccccagagctacctgtacctggtgaagggccagtgcgccaaggtgagcagcatcaacgacaagagcgactggaaggtggtgagaaaggccctgaccgtgatcgacttcaccgaggacgaggtggaggacctgctgagcatcgtggccagcgtgctgcacctgggcaacatccacttcgccgccaacgaggagagcaacgcccaggtgaccaccgagaaccagctgaagtacctgaccagactgctgagcgtggagggcagcaccctgagagaggccctgacccacagaaagatcatcgccaagggcgaggagctgctgagccccctgaacctggagcaggccgcctacgccagagacgccctggccaaggccgtgtacagcagaaccttcacctggctggtgggcaagatcaacagaagcctggccagcaaggacgtggagagccccagctggagaagcaccaccgtgctgggcctgctggacatctacggcttcgaggtgttccagcacaacagcttcgagcagttctgcatcaactactgcaacgagaagctgcagcagctgttcatcgagctgaccctgaagagcgagcaggaggagtacgaggccgagggcatcgcctgggagcccgtgcagtacttcaacaacaagatcatctgcgacctggtggaggagaagttcaagggcatcatcagcatcctggacgaggagtgcctgagacccggcgaggccaccgacctgaccttcctggagaagctggaggacaccgtgaagcaccacccccacttcctgacccacaagctggccgaccagagaaccagaaagagcctgggcagaggcgagttcagactgctgcactacgccggcgaggtgacctacagcgtgaccggcttcctggacaagaacaacgacctgctgttcagaaacctgaaggagaccatgtgcagcagcaagaaccccatcatgagccagtgcttcgacagaagcgagctgagcgacaagaagagacccgagaccgtggccacccagttcaagatgagcctgctgcagctggtggagatcctgcagagcaaggagcccgcctacgtgagatgcatcaagcccaacgacgccaagcagcccggcagattcgacgaggtgctgatcagacaccaggtgaagtacctgggcctgctggagaacctgagagtgagaagagccggcttcgcctacagaagaaagtacgaggccttcctgcagagatacaagagcctgtgccccgagacctggcccacctgggccggcagaccccaggacggcgtggccgtgctggtgagacacctgggctacaagcccgaggagtacaagatgggcagaaccaagatcttcatcagattccccaagaccctgttcgccaccgaggacgccctggaggtgagaagacagagcctggccaccaagatccaggccgcctggagaggcttccactggagacagaagttcctgagagtgaagagaagcgccatctgcatccagagctggtggagaggcaccctgggcagaagaaaggccgccaagagaaagtgggccgcccagaccatcagaagactgatcagaggcttcgtgctgagacacgcccccagatgccccgagaacgccttcttcctggaccacgtgagaaccagcttcctgctgaacctgagaagacagctgccccagaacgtgctggacaccagctggcccacccccccccccgccctgagagaggccagcgagctgctgagagagctgtgcatcaagaacatggtgtggaagtactgcagaagcatcagccccgagtggaagcagcagctgcagcagaaggccgtggccagcgagatcttcaagggcaagaaggacaactacccccagagcgtgcccagactgttcatcagcaccagactgggcaccgacgagatcagccccagagtgctgcaggccctgggcagcgagcccatccagtacgccgtgcccgtggtgaagtacgacagaaagggctacaagcccagaagcagacagctgctgctgacccccaacgccgtggtgatcgtggaggacgccaaggtgaagcagagaatcgactacgccaacctgaccggcatcagcgtgagcagcctgagcgacagcctgttcgtgctgcacgtgcagagagccgacaacaagcagaagggcgacgtggtgctgcagagcgaccacgtgatcgagaccctgaccaagaccgccctgagcgccaacagagtgaacagcatcaacatcaaccagggcagcatcaccttcgccggcggccccggcagagacggcaccatcgacttcacccccggcagcgagctgctgatcaccaaggccaagaacggccacctggccgtggtggcccccagactgaacagcagatag

SEQ ID NO: 89991 - DNA, 3135 bp, Artificial Sequence
  Description of Artificial Sequence: Synthetic coding sequence
atgagatacagagccagcgccctgggcagcgacggcgtgagagtgaccatggagagcgccctgaccgccagagacagagtgggcgtgcaggacttcgtgctgctggagaacttcaccagcgaggccgccttcatcgagaacctgagaagaagattcagagagaacctgatctacacctacatcggccccgtgctggtgagcgtgaacccctacagagacctgcagatctacagcagacagcacatggagagatacagaggcgtgagcttctacgaggtgcccccccacctgttcgccgtggccgacaccgtgtacagagccctgagaaccgagagaagagaccaggccgtgatgatcagcggcgagagcggcgccggcaagaccgaggccaccaagagactgctgcagttctacgccgagacctgccccgcccccgagagaggcggcgccgtgagagacagactgctgcagagcaaccccgtgctggaggccttcggcaacgccaagaccctgagaaacgacaacagcagcagattcggcaagtacatggacgtgcagttcgacttcaagggcgcccccgtgggcggccacatcctgagctacctgctggagaagagcagagtggtgcaccagaaccacggcgagagaaacttccacatcttctaccagctgctggagggcggcgaggaggagaccctgagaagactgggcctggagagaaacccccagagctacctgtacctggtgaagggccagtgcgccaaggtgagcagcatcaacgacaagagcgactggaaggtggtgagaaaggccctgaccgtgatcgacttcaccgaggacgaggtggaggacctgctgagcatcgtggccagcgtgctgcacctgggcaacatccacttcgccgccaacgaggagagcaacgcccaggtgaccaccgagaaccagctgaagtacctgaccagactgctgagcgtggagggcagcaccctgagagaggccctgacccacagaaagatcatcgccaagggcgaggagctgctgagccccctgaacctggagcaggccgcctacgccagagacgccctggccaaggccgtgtacagcagaaccttcacctggctggtgggcaagatcaacagaagcctggccagcaaggacgtggagagccccagctggagaagcaccaccgtgctgggcctgctggacatctacggcttcgaggtgttccagcacaacagcttcgagcagttctgcatcaactactgcaacgagaagctgcagcagctgttcatcgagctgaccctgaagagcgagcaggaggagtacgaggccgagggcatcgcctgggagcccgtgcagtacttcaacaacaagatcatctgcgacctggtggaggagaagttcaagggcatcatcagcatcctggacgaggagtgcctgagacccggcgaggccaccgacctgaccttcctggagaagctggaggacaccgtgaagcaccacccccacttcctgacccacaagctggccgaccagagaaccagaaagagcctgggcagaggcgagttcagactgctgcactacgccggcgaggtgacctacagcgtgaccggcttcctggacaagaacaacgacctgctgttcagaaacctgaaggagaccatgtgcagcagcaagaaccccatcatgagccagtgcttcgacagaagcgagctgagcgacaagaagagacccgagaccgtggccacccagttcaagatgagcctgctgcagctggtggagatcctgcagagcaaggagcccgcctacgtgagatgcatcaagcccaacgacgccaagcagcccggcagattcgacgaggtgctgatcagacaccaggtgaagtacctgggcctgctggagaacctgagagtgagaagagccggcttcgcctacagaagaaagtacgaggccttcctgcagagatacaagagcctgtgccccgagacctggcccacctgggccggcagaccccaggacggcgtggccgtgctggtgagacacctgggctacaagcccgaggagtacaagatgggcagaaccaagatcttcatcagattccccaagaccctgttcgccaccgaggacgccctggaggtgagaagacagagcctggccaccaagatccaggccgcctggagaggcttccactggagacagaagttcctgagagtgaagagaagcgccatctgcatccagagctggtggagaggcaccctgggcagaagaaaggccgccaagagaaagtgggccgcccagaccatcagaagactgatcagaggcttcgtgctgagacacgcccccagatgccccgagaacgccttcttcctggaccacgtgagaaccagcttcctgctgaacctgagaagacagctgccccagaacgtgctggacaccagctggcccacccccccccccgccctgagagaggccagcgagctgctgagagagctgtgcatcaagaacatggtgtggaagtactgcagaagcatcagccccgagtggaagcagcagctgcagcagaaggccgtggccagcgagatcttcaagggcaagaaggacaactacccccagagcgtgcccagactgttcatcagcaccagactgggcaccgacgagatcagccccagagtgctgcaggccctgggcagcgagcccatccagtacgccgtgcccgtggtgaagtacgacagaaagggctacaagcccagaagcagacagctgctgctgacccccaacgccgtggtgatcgtggaggacgccaaggtgaagcagagaatcgactacgccaacctgaccggcatcagcgtgagcagcctgagcgacagcctgttcgtgctgcacgtgcagagagccgacaacaagcagaagggcgacgtggtgctgcagagcgaccacgtgatcgagaccctgaccaagaccgccctgagcgccaacagagtgaacagcatcaacatcaaccagggcagcatcaccttcgccggcggccccggcagagacggcaccatcgacttcacccccggcagcgagctgctgatcaccaaggccaagaacggccacctggccgtggtggcccccagactgaacagcagatag

SEQ ID NO: 89992 - DNA, 2418 bp, Artificial Sequence
  Description of Artificial Sequence: Synthetic coding sequence
atggagagcgccctgaccgccagagacagagtgggcgtgcaggacttcgtgctgctggagaacttcaccagcgaggccgccttcatcgagaacctgagaagaagattcagagagaacctgatctacacctacatcggccccgtgctggtgagcgtgaacccctacagagacctgcagatctacagcagacagcacatggagagatacagaggcgtgagcttctacgaggtgcccccccacctgttcgccgtggccgacaccgtgtacagagccctgagaaccgagagaagagaccaggccgtgatgatcagcggcgagagcggcgccggcaagaccgaggccaccaagagactgctgcagttctacgccgagacctgccccgcccccgagagaggcggcgccgtgagagacagactgctgcagagcaaccccgtgctggaggccttcggcaacgccaagaccctgagaaacgacaacagcagcagattcggcaagtacatggacgtgcagttcgacttcaagggcgcccccgtgggcggccacatcctgagctacctgctggagaagagcagagtggtgcaccagaaccacggcgagagaaacttccacatcttctaccagctgctggagggcggcgaggaggagaccctgagaagactgggcctggagagaaacccccagagctacctgtacctggtgaagggccagtgcgccaaggtgagcagcatcaacgacaagagcgactggaaggtggtgagaaaggccctgaccgtgatcgacttcaccgaggacgaggtggaggacctgctgagcatcgtggccagcgtgctgcacctgggcaacatccacttcgccgccaacgaggagagcaacgcccaggtgaccaccgagaaccagctgaagtacctgaccagactgctgagcgtggagggcagcaccctgagagaggccctgacccacagaaagatcatcgccaagggcgaggagctgctgagccccctgaacctggagcaggccgcctacgccagagacgccctggccaaggccgtgtacagcagaaccttcacctggctggtgggcaagatcaacagaagcctggccagcaaggacgtggagagccccagctggagaagcaccaccgtgctgggcctgctggacatctacggcttcgaggtgttccagcacaacagcttcgagcagttctgcatcaactactgcaacgagaagctgcagcagctgttcatcgagctgaccctgaagagcgagcaggaggagtacgaggccgagggcatcgcctgggagcccgtgcagtacttcaacaacaagatcatctgcgacctggtggaggagaagttcaagggcatcatcagcatcctggacgaggagtgcctgagacccggcgaggccaccgacctgaccttcctggagaagctggaggacaccgtgaagcaccacccccacttcctgacccacaagctggccgaccagagaaccagaaagagcctgggcagaggcgagttcagactgctgcactacgccggcgaggtgacctacagcgtgaccggcttcctggacaagaacaacgacctgctgttcagaaacctgaaggagaccatgtgcagcagcaagaaccccatcatgagccagtgcttcgacagaagcgagctgagcgacaagaagagacccgagaccgtggccacccagttcaagatgagcctgctgcagctggtggagatcctgcagagcaaggagcccgcctacgtgagatgcatcaagcccaacgacgccaagcagcccggcagattcgacgaggtgctgatcagacaccaggtgaagtacctgggcctgctggagaacctgagagtgagaagagccggcttcgcctacagaagaaagtacgaggccttcctgcagagatacaagagcctgtgccccgagacctggcccacctgggccggcagaccccaggacggcgtggccgtgctggtgagacacctgggctacaagcccgaggagtacaagatgggcagaaccaagatcttcatcagattccccaagaccctgttcgccaccgaggacgccctggaggtgagaagacagagcctggccaccaagatccaggccgcctggagaggcttccactggagacagaagttcctgagagtgaagagaagcgccatctgcatccagagctggtggagaggcaccctgggcagaagaaaggccgccaaggaggtgggcggcaccgaccaccccgccgcccaccccagactgagacccgcccccagaccccccctgcccagagagagactgctgcccggcccctgcgcccacctgttcttcgccaagcccgaggccgccgccgcccccgagtgccccggccacctggtggcccacgcccccacctgccccgcctag

SEQ ID NO: 89993 - DNA, 3135 bp, Artificial Sequence
  Description of Artificial Sequence: Synthetic coding sequence
atgagaggcagagccagcgccctgggcagcgacggcgtgagagtgaccatggagagcgccctgaccgccagagacagagtgggcgtgcaggacttcgtgctgctggagaacttcaccagcgaggccgccttcatcgagaacctgagaagaagattcagagagaacctgatctacacctacatcggccccgtgctggtgagcgtgaacccctacagagacctgcagatctacagcagacagcacatggagagatacagaggcgtgagcttctacgaggtgcccccccacctgttcgccgtggccgacaccgtgtacagagccctgagaaccgagagaagagaccaggccgtgatgatcagcggcgagagcggcgccggcaagaccgaggccaccaagagactgctgcagttctacgccgagacctgccccgcccccgagagaggcggcgccgtgagagacagactgctgcagagcaaccccgtgctggaggccttcggcaacgccaagaccctgagaaacgacaacagcagcagattcggcaagtacatggacgtgcagttcgacttcaagggcgcccccgtgggcggccacatcctgagctacctgctggagaagagcagagtggtgcaccagaaccacggcgagagaaacttccacatcttctaccagctgctggagggcggcgaggaggagaccctgagaagactgggcctggagagaaacccccagagctacctgtacctggtgaagggccagtgcgccaaggtgagcagcatcaacgacaagagcgactggaaggtggtgagaaaggccctgaccgtgatcgacttcaccgaggacgaggtggaggacctgctgagcatcgtggccagcgtgctgcacctgggcaacatccacttcgccgccaacgaggagagcaacgcccaggtgaccaccgagaaccagctgaagtacctgaccagactgctgagcgtggagggcagcaccctgagagaggccctgacccacagaaagatcatcgccaagggcgaggagctgctgagccccctgaacctggagcaggccgcctacgccagagacgccctggccaaggccgtgtacagcagaaccttcacctggctggtgggcaagatcaacagaagcctggccagcaaggacgtggagagccccagctggagaagcaccaccgtgctgggcctgctggacatctacggcttcgaggtgttccagcacaacagcttcgagcagttctgcatcaactactgcaacgagaagctgcagcagctgttcatcgagctgaccctgaagagcgagcaggaggagtacgaggccgagggcatcgcctgggagcccgtgcagtacttcaacaacaagatcatctgcgacctggtggaggagaagttcaagggcatcatcagcatcctggacgaggagtgcctgagacccggcgaggccaccgacctgaccttcctggagaagctggaggacaccgtgaagcaccacccccacttcctgacccacaagctggccgaccagagaaccagaaagagcctgggcagaggcgagttcagactgctgcactacgccggcgaggtgacctacagcgtgaccggcttcctggacaagaacaacgacctgctgttcagaaacctgaaggagaccatgtgcagcagcaagaaccccatcatgagccagtgcttcgacagaagcgagctgagcgacaagaagagacccgagaccgtggccacccagttcaagatgagcctgctgcagctggtggagatcctgcagagcaaggagcccgcctacgtgagatgcatcaagcccaacgacgccaagcagcccggcagattcgacgaggtgctgatcagacaccaggtgaagtacctgggcctgctggagaacctgagagtgagaagagccggcttcgcctacagaagaaagtacgaggccttcctgcagagatacaagagcctgtgccccgagacctggcccacctgggccggcagaccccaggacggcgtggccgtgctggtgagacacctgggctacaagcccgaggagtacaagatgggcagaaccaagatcttcatcagattccccaagaccctgttcgccaccgaggacgccctggaggtgagaagacagagcctggccaccaagatccaggccgcctggagaggcttccactggagacagaagttcctgagagtgaagagaagcgccatctgcatccagagctggtggagaggcaccctgggcagaagaaaggccgccaagagaaagtgggccgcccagaccatcagaagactgatcagaggcttcgtgctgagacacgcccccagatgccccgagaacgccttcttcctggaccacgtgagaaccagcttcctgctgaacctgagaagacagctgccccagaacgtgctggacaccagctggcccacccccccccccgccctgagagaggccagcgagctgctgagagagctgtgcatcaagaacatggtgtggaagtactgcagaagcatcagccccgagtggaagcagcagctgcagcagaaggccgtggccagcgagatcttcaagggcaagaaggacaactacccccagagcgtgcccagactgttcatcagcaccagactgggcaccgacgagatcagccccagagtgctgcaggccctgggcagcgagcccatccagtacgccgtgcccgtggtgaagtacgacagaaagggctacaagcccagaagcagacagctgctgctgacccccaacgccgtggtgatcgtggaggacgccaaggtgaagcagagaatcgactacgccaacctgaccggcatcagcgtgagcagcctgagcgacagcctgttcgtgctgcacgtgcagagagccgacaacaagcagaagggcgacgtggtgctgcagagcgaccacgtgatcgagaccctgaccaagaccgccctgagcgccaacagagtgaacagcatcaacatcaaccagggcagcatcaccttcgccggcggccccggcagagacggcaccatcgacttcacccccggcagcgagctgctgatcaccaaggccaagaacggccacctggccgtggtggcccccagactgaacagcagatag

SEQ ID NO: 89994 - DNA, 3120 bp, Artificial Sequence
  Description of Artificial Sequence: Synthetic coding sequence
atggccctgggcagcgacggcgtgagagtgaccatggagagcgccctgaccgccagagacagagtgggcgtgcaggacttcgtgctgctggagaacttcaccagcgaggccgccttcatcgagaacctgagaagaagattcagagagaacctgatctacacctacatcggccccgtgctggtgagcgtgaacccctacagagacctgcagatctacagcagacagcacatggagagatacagaggcgtgagcttctacgaggtgcccccccacctgttcgccgtggccgacaccgtgtacagagccctgagaaccgagagaagagaccaggccgtgatgatcagcggcgagagcggcgccggcaagaccgaggccaccaagagactgctgcagttctacgccgagacctgccccgcccccgagagaggcggcgccgtgagagacagactgctgcagagcaaccccgtgctggaggccttcggcaacgccaagaccctgagaaacgacaacagcagcagattcggcaagtacatggacgtgcagttcgacttcaagggcgcccccgtgggcggccacatcctgagctacctgctggagaagagcagagtggtgcaccagaaccacggcgagagaaacttccacatcttctaccagctgctggagggcggcgaggaggagaccctgagaagactgggcctggagagaaacccccagagctacctgtacctggtgaagggccagtgcgccaaggtgagcagcatcaacgacaagagcgactggaaggtggtgagaaaggccctgaccgtgatcgacttcaccgaggacgaggtggaggacctgctgagcatcgtggccagcgtgctgcacctgggcaacatccacttcgccgccaacgaggagagcaacgcccaggtgaccaccgagaaccagctgaagtacctgaccagactgctgagcgtggagggcagcaccctgagagaggccctgacccacagaaagatcatcgccaagggcgaggagctgctgagccccctgaacctggagcaggccgcctacgccagagacgccctggccaaggccgtgtacagcagaaccttcacctggctggtgggcaagatcaacagaagcctggccagcaaggacgtggagagccccagctggagaagcaccaccgtgctgggcctgctggacatctacggcttcgaggtgttccagcacaacagcttcgagcagttctgcatcaactactgcaacgagaagctgcagcagctgttcatcgagctgaccctgaagagcgagcaggaggagtacgaggccgagggcatcgcctgggagcccgtgcagtacttcaacaacaagatcatctgcgacctggtggaggagaagttcaagggcatcatcagcatcctggacgaggagtgcctgagacccggcgaggccaccgacctgaccttcctggagaagctggaggacaccgtgaagcaccacccccacttcctgacccacaagctggccgaccagagaaccagaaagagcctgggcagaggcgagttcagactgctgcactacgccggcgaggtgacctacagcgtgaccggcttcctggacaagaacaacgacctgctgttcagaaacctgaaggagaccatgtgcagcagcaagaaccccatcatgagccagtgcttcgacagaagcgagctgagcgacaagaagagacccgagaccgtggccacccagttcaagatgagcctgctgcagctggtggagatcctgcagagcaaggagcccgcctacgtgagatgcatcaagcccaacgacgccaagcagcccggcagattcgacgaggtgctgatcagacaccaggtgaagtacctgggcctgctggagaacctgagagtgagaagagccggcttcgcctacagaagaaagtacgaggccttcctgcagagatacaagagcctgtgccccgagacctggcccacctgggccggcagaccccaggacggcgtggccgtgctggtgagacacctgggctacaagcccgaggagtacaagatgggcagaaccaagatcttcatcagattccccaagaccctgttcgccaccgaggacgccctggaggtgagaagacagagcctggccaccaagatccaggccgcctggagaggcttccactggagacagaagttcctgagagtgaagagaagcgccatctgcatccagagctggtggagaggcaccctgggcagaagaaaggccgccaagagaaagtgggccgcccagaccatcagaagactgatcagaggcttcgtgctgagacacgcccccagatgccccgagaacgccttcttcctggaccacgtgagaaccagcttcctgctgaacctgagaagacagctgccccagaacgtgctggacaccagctggcccacccccccccccgccctgagagaggccagcgagctgctgagagagctgtgcatcaagaacatggtgtggaagtactgcagaagcatcagccccgagtggaagcagcagctgcagcagaaggccgtggccagcgagatcttcaagggcaagaaggacaactacccccagagcgtgcccagactgttcatcagcaccagactgggcaccgacgagatcagccccagagtgctgcaggccctgggcagcgagcccatccagtacgccgtgcccgtggtgaagtacgacagaaagggctacaagcccagaagcagacagctgctgctgacccccaacgccgtggtgatcgtggaggacgccaaggtgaagcagagaatcgactacgccaacctgaccggcatcagcgtgagcagcctgagcgacagcctgttcgtgctgcacgtgcagagagccgacaacaagcagaagggcgacgtggtgctgcagagcgaccacgtgatcgagaccctgaccaagaccgccctgagcgccaacagagtgaacagcatcaacatcaaccagggcagcatcaccttcgccggcggccccggcagagacggcaccatcgacttcacccccggcagcgagctgctgatcaccaaggccaagaacggccacctggccgtggtggcccccagactgaacagcagatag

SEQ ID NO: 89995 - DNA, 3021 bp, Artificial Sequence
  Description of Artificial Sequence: Synthetic coding sequence
atggccgagcaggagagcctggagttcggcaaggccgacttcgtgctgatggacaccgtgagcatgcccgagttcatggccaacctgagactgagattcgagaagggcagaatctacaccttcatcggcgaggtggtggtgagcgtgaacccctacaagctgctgaacatctacggcagagacaccatcgagcagtacaagggcagagagctgtacgagagacccccccacctgttcgccatcgccgacgccgcctacaaggccatgaagagaagaagcaaggacacctgcatcgtgatcagcggcgagagcggcgccggcaagaccgaggccagcaagtacatcatgcagtacatcgccgccatcaccaaccccagccagagagccgaggtggagagagtgaagaacatgctgctgaagagcaactgcgtgctggaggccttcggcaacgccaagaccaacagaaacgacaacagcagcagattcggcaagtacatggacatcaacttcgacttcaagggcgaccccatcggcggccacatcaacaactacctgctggagaagagcagagtgatcgtgcagcagcccggcgagagaagcttccacagcttctaccagctgctgcagggcggcagcgagcagatgctgagaagcctgcacctgcagaagagcctgagcagctacaactacatccacgtgggcgcccagctgaagagcagcatcaacgacgccgccgagttcagagtggtggccgacgccatgaaggtgatcggcttcaagcccgaggagatccagaccgtgtacaagatcctggccgccatcctgcacctgggcaacctgaagttcgtggtggacggcgacacccccctgatcgagaacggcaaggtggtgagcatcatcgccgagctgctgagcaccaagaccgacatggtggagaaggccctgctgtacagaaccgtggccaccggcagagacatcatcgacaagcagcacaccgagcaggaggccagctacggcagagacgccttcgccaaggccatctacgagagactgttctgctggatcgtgaccagaatcaacgacatcatcgaggtgaagaactacgacaccaccatccacggcaagaacaccgtgatcggcgtgctggacatctacggcttcgagatcttcgacaacaacagcttcgagcagttctgcatcaactactgcaacgagaagctgcagcagctgttcatccagctggtgctgaagcaggagcaggaggagtaccagagagagggcatcccctggaagcacatcgactacttcaacaaccagatcatcgtggacctggtggagcagcagcacaagggcatcatcgccatcctggacgacgcctgcatgaacgtgggcaaggtgaccgacgagatgttcctggaggccctgaacagcaagctgggcaagcacgcccacttcagcagcagaaagctgtgcgccagcgacaagatcctggagttcgacagagacttcagaatcagacactacgccggcgacgtggtgtacagcgtgatcggcttcatcgacaagaacaaggacaccctgttccaggacttcaagagactgatgtacaacagcagcaaccccgtgctgaagaacatgtggcccgagggcaagctgagcatcaccgaggtgaccaagagacccctgaccgccgccaccctgttcaagaacagcatgatcgccctggtggacaacctggccagcaaggagccctactacgtgagatgcatcaagcccaacgacaagaagagcccccagatcttcgacgacgagagatgcagacaccaggtggagtacctgggcctgctggagaacgtgagagtgagaagagccggcttcgccttcagacagacctacgagaagttcctgcacagatacaagatgatcagcgagttcacctggcccaaccacgacctgcccagcgacaaggaggccgtgaagaagctgatcgagagatgcggcttccaggacgacgtggcctacggcaagaccaagatcttcatcagaacccccagaaccctgttcaccctggaggagctgagagcccagatgctgatcagaatcgtgctgttcctgcagaaggtgtggagaggcaccctggccagaatgagatacaagagaaccaaggccgccctgaccatcatcagatactacagaagatacaaggtgaagagctacatccacgaggtggccagaagattccacggcgtgaagaccatgagagactacggcaagcacgtgaagtggcccagcccccccaaggtgctgagaagattcgaggaggccctgcagaccatcttcaacagatggagagccagccagctgatcaagagcatccccgccagcgacctgccccaggtgagagccaaggtggccgccgtggagatgctgaagggccagagagccgacctgggcctgcagagagcctgggagggcaactacctggccagcaagcccgacaccccccagaccagcggcaccttcgtgcccgtggccaacgagctgaagagaaaggacaagtacatgaacgtgctgttcagctgccacgtgagaaaggtgaacagattcagcaaggtggaggacagagccatcttcgtgaccgacagacacctgtacaagatggaccccaccaagcagtacaaggtgatgaagaccatccccctgtacaacctgaccggcctgagcgtgagcaacggcaaggaccagctggtggtgttccacaccaaggacaacaaggacctgatcgtgtgcctgttcagcaagcagcccacccacgagagcagaatcggcgagctggtgggcgtgctggtgaaccacttcaagagcgagaagagacacctgcaggtgaacgtgaccaaccccgtgcagtgcagcctgcacggcaagaagtgcaccgtgagcgtggagaccagactgaaccagccccagcccgacttcaccaagaacagaagcggcttcatcctgagcgtgcccggcaactag

SEQ ID NO: 89996 - DNA, 597 bp, Artificial Sequence
  Description of Artificial Sequence: Synthetic coding sequence
atgctgaagggccagagagccgacctgggcctgcagagagcctgggagggcaactacctggccagcaagcccgacaccccccagaccagcggcaccttcgtgcccgtggccaacgagctgaagagaaaggacaagtacatgaacgtgctgttcagctgccacgtgagaaaggtgaacagattcagcaaggtggaggacagagccatcttcgtgaccgacagacacctgtacaagatggaccccaccaagcagtacaaggtgatgaagaccatccccctgtacaacctgaccggcctgagcgtgagcaacggcaaggaccagctggtggtgttccacaccaaggacaacaaggacctgatcgtgtgcctgttcagcaagcagcccacccacgagagcagaatcggcgagctggtgggcgtgctggtgaaccacttcaagagcgagaagagacacctgcaggtgaacgtgaccaaccccgtgcagtgcagcctgcacggcaagaagtgcaccgtgagcgtggagaccagactgaaccagccccagcccgacttcaccaagaacagaagcggcttcatcctgagcgtgcccggcaactag

SEQ ID NO: 89997 - DNA, 3327 bp, Artificial Sequence
  Description of Artificial Sequence: Synthetic coding sequence
atgggcagcaagggcgtgtaccagtaccactggcagagccacaacgtgaagcacagcggcgtggacgacatggtgctgctgagcaagatcaccgagaacagcatcgtggagaacctgaagaagagatacatggacgactacatcttcacctacatcggcagcgtgctgatcagcgtgaaccccttcaagcagatgccctacttcggcgagaaggagatcgagatgtaccagggcgccgcccagtacgagaaccccccccacatctacgccctggccgacaacatgtacagaaacatgatcatcgacagagagaaccagtgcgtgatcatcagcggcgagagcggcgccggcaagaccgtggccgccaagtacatcatgagctacatcagcagagtgagcggcggcggcaccaaggtgcagcacgtgaaggacatcatcctgcagagcaaccccctgctggaggccttcggcaacgccaagaccgtgagaaacaacaacagcagcagattcggcaagtacttcgagatccagttcagccccggcggcgagcccgacggcggcaagatcagcaacttcctgctggagaagagcagagtggtgatgagaaaccccggcgagagaagcttccacatcttctaccagctgatcgagggcgccagcgccgagcagaagcacagcctgggcatcaccagcatggactactactactacctgagcctgagcggcagctacaaggtggacgacatcgacgacagaagagagttccaggagaccctgcacgccatgaacgtgatcggcatcttcgccgaggagcagaccctggtgctgcagatcgtggccggcatcctgcacctgggcaacatcagcttcaaggaggtgggcaactacgccgccgtggagagcgaggagttcctggccttccccgcctacctgctgggcatcaaccaggacagactgaaggagaagctgaccagcagacagatggacagcaagtggggcggcaagagcgagagcatccacgtgaccctgaacgtggagcaggcctgctacaccagagacgccctggccaaggccctgcacgccagagtgttcgacttcctggtggacagcatcaacaaggccatggagaaggaccacgaggagtacaacatcggcgtgctggacatctacggcttcgagatcttccagaagaacggcttcgagcagttctgcatcaacttcgtgaacgagaagctgcagcagatcttcatcgagctgaccctgaaggccgagcaggaggagtacgtgcaggagggcatcagatggacccccatcgagtacttcaacaacaagatcgtgtgcgacctgatcgagaacaaggtgaacccccccggcatcatgagcatcctggacgacgtgtgcgccaccatgcacgccgtgggcgagggcgccgaccagaccctgctgcagaagctgcagatgcagatcggcagccacgagcacttcaacagctggaaccagggcttcatcatccaccactacgccggcaaggtgagctacgacatggacggcttctgcgagagaaacagagacgtgctgttcatggacctgatcgagctgatgcagagcagcgagctgcccttcatcaagagcctgttccccgagaacctgcaggccgacaagaagggcagacccaccaccgccggcagcaagatcaagaagcaggccaacgacctggtgagcaccctgatgaagtgcaccccccactacatcagatgcatcaagcccaacgagaccaagaagcccagagactgggaggagagcagagtgaagcaccaggtggagtacctgggcctgaaggagaacatcagagtgagaagagccggctacgcctacagaagaatcttccagaagttcctgcagagatacgccatcctgaccaaggccacctggcccagctggcagggcgaggagaagcagggcgtgctgcacctgctgcagagcgtgaacatggacagcgaccagttccagctgggcagaagcaaggtgttcatcaaggcccccgagagcctgttcctgctggaggagatgagagagagaaagtacgacggctacgccagagtgatccagaagagctggagaaagttcgtggccagaaagaagtacgtgcagatgagagaggaggccagcgacctgctgctgaacaagaaggagagaagaagaaacagcatcaacagaaacttcatcggcgactacatcggcatggaggagcaccccgagctgcagcagttcgtgggcaagagagagaagatcgacttcgccgacaccgtgaccaagtacgacagaagattcaagggcgtgaagagagacctgctgctgacccccaagtgcctgtacctgatcggcagagagaaggtgaagcagggccccgacaagggcctggtgaaggaggtgctgaagagaaagatcgagatcgagagaatcctgagcgtgagcctgagcaccatgcaggacgacatcttcatcctgcacgagcaggagtacgacagcctgctggagagcgtgttcaagaccgagttcctgagcctgctggccaagagatacgaggagaagacccagaagcagctgcccctgaagttcagcaacaccctggagctgaagctgaagaaggagaactggggcccctggagcgccggcggcagcagacaggtgcagttccaccagggcttcggcgacctggccgtgctgaagcccagcaacaaggtgctgcaggtgagcatcggccccggcctgcccaagaacagcagacccaccagaagaaacaccacccagaacaccggctacagcagcggcacccagaacgccaactaccccgtgagagccgccccccccccccccggctaccaccagaacggcgtgatcagaaaccagtacgtgccctacccccacgcccccggcagccagagaagcaaccagaagagcctgtacaccagcatggccagaccccccctgcccagacagcagagcaccagcagcgacagagtgagccagacccccgagagcctggacttcctgaaggtgcccgaccagggcgccgccggcgtgagaagacagaccaccagcagacccccccccgccggcggcagacccaagccccagcccaagcccaagccccaggtgccccagtgcaaggccctgtacgcctacgacgcccaggacaccgacgagctgagcttcaacgccaacgacatcatcgacatcatcaaggaggaccccagcggctggtggaccggcagactgagaggcaagcagggcctgttccccaacaactacgtgaccaagatctag

SEQ ID NO: 89998 - DNA, 3312 bp, Artificial Sequence
  Description of Artificial Sequence: Synthetic coding sequence
ggcaccaaggccggcagccccgtgaacggccagaagcagggccacgcccaggccacccccaagatccccctgaacctgcacctgcaccacgaccccttcagaagcctgcaggagcccagacaccagccccccaccatgggcagcaaggagagattccactggcagagccacaacgtgaagcagagcggcgtggacgacatggtgctgctgccccagatcaccgaggacgccatcgccgccaacctgagaaagagattcatggacgactacatcttcacctacatcggcagcgtgctgatcagcgtgaaccccttcaagcagatgccctacttcaccgacagagagatcgacctgtaccagggcgccgcccagtacgagaaccccccccacatctacgccctgaccgacaacatgtacagaaacatgctgatcgactgcgagaaccagtgcgtgatcatcagcggcgagagcggcgccggcaagaccgtggccgccaagtacatcatgggctacatcagcaaggtgagcggcggcggcgagaaggtgcagcacgtgaaggacatcatcctgcagagcaaccccctgctggaggccttcggcaacgccaagaccgtgagaaacaacaacagcagcagattcggcaagtacttcgagatccagttcagcagaggcggcgagcccgacggcggcaagatcagcaacttcctgctggagaagagcagagtggtgatgcagaacgagaacgagagaaacttccacatctactaccagctgctggagggcgccagccaggagcagagacagaacctgggcctgatgacccccgactactactactacctgaaccagagcgacacctaccaggtggacggcaccgacgacagaagcgacttcggcgagaccctgagcgccatgcaggtgatcggcatcccccccagcatccagcagctggtgctgcagctggtggccggcatcctgcacctgggcaacatcagcttctgcgaggacggcaactacgccagagtggagagcgtggacctgctggccttccccgcctacctgctgggcatcgacagcggcagactgcaggagaagctgaccagcagaaagatggacagcagatggggcggcagaagcgagagcatcaacgtgaccctgaacgtggagcaggccgcctacaccagagacgccctggccaagggcctgtacgccagactgttcgacttcctggtggaggccatcaacagagccatgcagaagccccaggaggagtacagcatcggcgtgctggacatctacggcttcgagatcttccagaagaacggcttcgagcagttctgcatcaacttcgtgaacgagaagctgcagcagatcttcatcgagctgaccctgaaggccgagcaggaggagtacgtgcaggagggcatcagatggacccccatccagtacttcaacaacaaggtggtgtgcgacctgatcgagaacaagctgagcccccccggcatcatgagcgtgctggacgacgtgtgcgccaccatgcacgccaccggcggcggcgccgaccagaccctgctgcagaagctgcaggccgccgtgggcacccacgagcacttcaacagctggagcgccggcttcgtgatccaccactacgccggcaaggtgagctacgacgtgagcggcttctgcgagagaaacagagacgtgctgttcagcgacctgatcgagctgatgcagaccagcgagcaggccttcctgagaatgctgttccccgagaagctggacggcgacaagaagggcagacccagcaccgccggcagcaagatcaagaagcaggccaacgacctggtggccaccctgatgagatgcaccccccactacatcagatgcatcaagcccaacgagaccaagagacccagagactgggaggagaacagagtgaagcaccaggtggagtacctgggcctgaaggagaacatcagagtgagaagagccggcttcgcctacagaagacagttcgccaagttcctgcagagatacgccatcctgacccccgagacctggcccagatggagaggcgacgagagacagggcgtgcagcacctgctgagagccgtgaacatggagcccgaccagtaccagatgggcagcaccaaggtgttcgtgaagaaccccgagagcctgttcctgctggaggaggtgagagagagaaagttcgacggcttcgccagaaccatccagaaggcctggagaagacacgtggccgtgagaaagtacgaggagatgagagaggaggccagcaacatcctgctgaacaagaaggagagaagaagaaacagcatcaacagaaacttcgtgggcgactacctgggcctggaggagagacccgagctgagacagttcctgggcaagagagagagagtggacttcgccgacagcgtgaccaagtacgacagaagattcaagcccatcaagagagacctgatcctgacccccaagtgcgtgtacgtgatcggcagagagaaggtgaagaagggccccgagaagggccaggtgtgcgaggtgctgaagaagaaggtggacatccaggccctgagaggcgtgagcctgagcaccagacaggacgacttcttcatcctgcaggaggacgccgccgacagcttcctggagagcgtgttcaagaccgagttcgtgagcctgctgtgcaagagattcgaggaggccaccagaagacccctgcccctgaccttcagcgacaccctgcagttcagagtgaagaaggagggctggggcggcggcggcaccagaagcgtgaccttcagcagaggcttcggcgacctggccgtgctgaaggtgggcggcagaaccctgaccgtgagcgtgggcgacggcctgcccaagagcagcaagcccaccagaaagggcatggccaagggcaagcccagaagaagcagccaggcccccaccagagccgcccccgccccccccagaggcatggacagaaacggcgtgccccccagcgccagaggcggccccctgcccggcgaccacgtgtggagaggccacccccaggccagccccggcctgagaccccacccctgggagcccgccgacgaccccggccacgtgagaccccagagcaccacccagaacagcagcacctgcctgaccagagcctggcccgcctgcagaggcagcgccgcctggggcaacggccagtgcctggtgtgggccgaccccagccccagcctgggccacatggtgcccggcgccggcccctacaccagcacctgggccaagatgtggaccagctag

SEQ ID NO: 89999 - DNA, 3297 bp, Artificial Sequence
  Description of Artificial Sequence: Synthetic coding sequence
atgggcagcaaggagagattccactggcagagccacaacgtgaagcagagcggcgtggacgacatggtgctgctgccccagatcaccgaggacgccatcgccgccaacctgagaaagagattcatggacgactacatcttcacctacatcggcagcgtgctgatcagcgtgaaccccttcaagcagatgccctacttcaccgacagagagatcgacctgtaccagggcgccgcccagtacgagaaccccccccacatctacgccctgaccgacaacatgtacagaaacatgctgatcgactgcgagaaccagtgcgtgatcatcagcggcgagagcggcgccggcaagaccgtggccgccaagtacatcatgggctacatcagcaaggtgagcggcggcggcgagaaggtgcagcacgtgaaggacatcatcctgcagagcaaccccctgctggaggccttcggcaacgccaagaccgtgagaaacaacaacagcagcagattcggcaagtacttcgagatccagttcagcagaggcggcgagcccgacggcggcaagatcagcaacttcctgctggagaagagcagagtggtgatgcagaacgagaacgagagaaacttccacatctactaccagctgctggagggcgccagccaggagcagagacagaacctgggcctgatgacccccgactactactactacctgaaccagagcgacacctaccaggtggacggcaccgacgacagaagcgacttcggcgagaccctgagcgccatgcaggtgatcggcatcccccccagcatccagcagctggtgctgcagctggtggccggcatcctgcacctgggcaacatcagcttctgcgaggacggcaactacgccagagtggagagcgtggacctgctggccttccccgcctacctgctgggcatcgacagcggcagactgcaggagaagctgaccagcagaaagatggacagcagatggggcggcagaagcgagagcatcaacgtgaccctgaacgtggagcaggccgcctacaccagagacgccctggccaagggcctgtacgccagactgttcgacttcctggtggaggccatcaacagagccatgcagaagccccaggaggagtacagcatcggcgtgctggacatctacggcttcgagatcttccagaagaacggcttcgagcagttctgcatcaacttcgtgaacgagaagctgcagcagatcttcatcgagctgaccctgaaggccgagcaggaggagtacgtgcaggagggcatcagatggacccccatccagtacttcaacaacaaggtggtgtgcgacctgatcgagaacaagctgagcccccccggcatcatgagcgtgctggacgacgtgtgcgccaccatgcacgccaccggcggcggcgccgaccagaccctgctgcagaagctgcaggccgccgtgggcacccacgagcacttcaacagctggagcgccggcttcgtgatccaccactacgccggcaaggtgagctacgacgtgagcggcttctgcgagagaaacagagacgtgctgttcagcgacctgatcgagctgatgcagaccagcgagcaggccttcctgagaatgctgttccccgagaagctggacggcgacaagaagggcagacccagcaccgccggcagcaagatcaagaagcaggccaacgacctggtggccaccctgatgagatgcaccccccactacatcagatgcatcaagcccaacgagaccaagagacccagagactgggaggagaacagagtgaagcaccaggtggagtacctgggcctgaaggagaacatcagagtgagaagagccggcttcgcctacagaagacagttcgccaagttcctgcagagatacgccatcctgacccccgagacctggcccagatggagaggcgacgagagacagggcgtgcagcacctgctgagagccgtgaacatggagcccgaccagtaccagatgggcagcaccaaggtgttcgtgaagaaccccgagagcctgttcctgctggaggaggtgagagagagaaagttcgacggcttcgccagaaccatccagaaggcctggagaagacacgtggccgtgagaaagtacgaggagatgagagaggaggccagcaacatcctgctgaacaagaaggagagaagaagaaacagcatcaacagaaacttcgtgggcgactacctgggcctggaggagagacccgagctgagacagttcctgggcaagagagagagagtggacttcgccgacagcgtgaccaagtacgacagaagattcaagcccatcaagagagacctgatcctgacccccaagtgcgtgtacgtgatcggcagagagaaggtgaagaagggccccgagaagggccaggtgtgcgaggtgctgaagaagaaggtggacatccaggccctgagaggcgtgagcctgagcaccagacaggacgacttcttcatcctgcaggaggacgccgccgacagcttcctggagagcgtgttcaagaccgagttcgtgagcctgctgtgcaagagattcgaggaggccaccagaagacccctgcccctgaccttcagcgacaccctgcagttcagagtgaagaaggagggctggggcggcggcggcaccagaagcgtgaccttcagcagaggcttcggcgacctggccgtgctgaaggtgggcggcagaaccctgaccgtgagcgtgggcgacggcctgcccaagagcagcaagcccaccagaaagggcatggccaagggcaagcccagaagaagcagccaggcccccaccagagccgcccccgccccccccagaggcatggacagaaacggcgtgccccccagcgccagaggcggccccctgcccctggagatcatgagcggcggcggcacccacagaccccccagaggcccccccagcaccagcctgggcgccagcagaagacccagagccagaccccccagcgagcacaacaccgagttcctgaacgtgcccgaccagggcatggccggcatgcagagaaagagaagcgtgggccagagacccgtgcccggcgtgggcagacccaagccccagcccagaacccacggccccagatgcagagccctgtaccagtacgtgggccaggacgtggacgagctgagcttcaacgtgaacgaggtgatcgagatcctgatggaggaccccagcggctggtggaagggcagactgcacggccaggagggcctgttccccggcaactacgtggagaagatctag

SEQ ID NO: 90000 - DNA, 3057 bp, Artificial Sequence
  Description of Artificial Sequence: Synthetic coding sequence
atggaggacgaggagggccccgagtacggcaagcccgacttcgtgctgctggaccaggtgaccatggaggacttcatgagaaacctgcagctgagattcgagaagggcagaatctacacctacatcggcgaggtgctggtgagcgtgaacccctaccaggagctgcccctgtacggccccgaggccatcgccagataccagggcagagagctgtacgagagacccccccacctgtacgccgtggccaacgccgcctacaaggccatgaagcacagaagcagagacacctgcatcgtgatcagcggcgagagcggcgccggcaagaccgaggccagcaagcacatcatgcagtacatcgccgccgtgaccaaccccagccagagagccgaggtggagagagtgaaggacgtgctgctgaagagcacctgcgtgctggaggccttcggcaacgccagaaccaacagaaaccacaacagcagcagattcggcaagtacatggacatcaacttcgacttcaagggcgaccccatcggcggccacatccacagctacctgctggagaagagcagagtgctgaagcagcacgtgggcgagagaaacttccacgccttctaccagctgctgagaggcagcgaggacaagcagctgcacgagctgcacctggagagaaaccccgccgtgtacaacttcacccaccagggcgccggcctgaacatgaccgtgcacagcgccctggacagcgacgagcagagccaccaggccgtgaccgaggccatgagagtgatcggcttcagccccgaggaggtggagagcgtgcacagaatcctggccgccatcctgcacctgggcaacatcgagttcgtggagaccgaggagggcggcctgcagaaggagggcctggccgtggccgaggaggccctggtggaccacgtggccgagctgaccgccacccccagagacctggtgctgagaagcctgctggccagaaccgtggccagcggcggcagagagctgatcgagaagggccacaccgccgccgaggccagctacgccagagacgcctgcgccaaggccgtgtaccagagactgttcgagtgggtggtgaacagaatcaacagcgtgatggagcccagaggcagagaccccagaagagacggcaaggacaccgtgatcggcgtgctggacatctacggcttcgaggtgttccccgtgaacagcttcgagcagttctgcatcaactactgcaacgagaagctgcagcagctgttcatccagctgatcctgaagcaggagcaggaggagtacgagagagagggcatcacctggcagagcgtggagtacttcaacaacgccaccatcgtggacctggtggagagaccccacagaggcatcctggccgtgctggacgaggcctgcagcagcgccggcaccatcaccgacagaatcttcctgcagaccctggacatgcaccacagacaccacctgcactacaccagcagacagctgtgccccaccgacaagaccatggagttcggcagagacttcagaatcaagcactacgccggcgacgtgacctacagcgtggagggcttcatcgacaagaacagagacttcctgttccaggacttcaagagactgctgtacaacagcaccgaccccaccctgagagccatgtggcccgacggccagcaggacatcaccgaggtgaccaagagacccctgaccgccggcaccctgttcaagaacagcatggtggccctggtggagaacctggccagcaaggagcccttctacgtgagatgcatcaagcccaacgaggacaaggtggccggcaagctggacgagaaccactgcagacaccaggtggcctacctgggcctgctggagaacgtgagagtgagaagagccggcttcgccagcagacagccctacagcagattcctgctgagatacaagatgacctgcgagtacacctggcccaaccacctgctgggcagcgacaaggccgccgtgagcgccctgctggagcagcacggcctgcagggcgacgtggccttcggccacagcaagctgttcatcagaagccccagaaccctggtgaccctggagcagagcagagccagactgatccccatcatcgtgctgctgctgcagaaggcctggagaggcaccctggccagatggagatgcagaagactgagagccatctacaccatcatgagatggttcagaagacacaaggtgagagcccacctggccgagctgcagagaagattccaggccgccagacagccccccctgtacggcagagacctggtgtggcccctgccccccgccgtgctgcagcccttccaggacacctgccacgccctgttctgcagatggagagccagacagctggtgaagaacatcccccccagcgacatgccccagatcaaggccaaggtggccgccatgggcgccctgcagggcctgagacaggactggggctgcagaagagcctgggccagagactacctgagcagcgccaccgacaaccccaccgccagcagcctgttcgcccagagactgaagaccctgcaggacaaggacggcttcggcgccgtgctgttcagcagccacgtgagaaaggtgaacagattccacaagatcagaaacagagccctgctgctgaccgaccagcacctgtacaagctggaccccgacagacagtacagagtgatgagagccgtgcccctggaggccgtgaccggcctgagcgtgaccagcggcggcgaccagctggtggtgctgcacgccagaggccaggacgacctggtggtgtgcctgcacagaagcagaccccccctggacaacagagtgggcgagctggtgggcgtgctggccgcccactgccagggcgagggcagaaccctggaggtgagagtgagcgactgcatccccctgagccacagaggcgtgagaagactgatcagcgtggagcccagacccgagcagcccgagcccgacttcagatgcgccagaggcagcttcaccctgctgtggcccagcagatag

SEQ ID NO: 90001 - DNA, 4851 bp, Artificial Sequence
  Description of Artificial Sequence: Synthetic coding sequence
atgttccccctgatcggcaagaccatcatcttcgacaacttccccgaccccagcgacacctgggagatcaccgagaccatcggcaagggcacctacggcaaggtgttcaaggtgctgaacaagaagaacggccagaaggccgccgtgaagatcctggaccccatccacgacatcgacgaggagatcgaggccgagtacaacatcctgaaggccctgagcgaccaccccaacgtggtgagattctacggcatctacttcaagaaggacaaggtgaacggcgacaagctgtggctggtgctggagctgtgcagcggcggcagcgtgaccgacctggtgaagggcttcctgaagagaggcgagagaatgagcgagcccctgatcgcctacatcctgcacgaggccctgatgggcctgcagcacctgcacaacaacaagaccatccacagagacgtgaagggcaacaacatcctgctgaccaccgagggcggcgtgaagctggtggacttcggcgtgagcgcccagctgaccagcaccagacacagaagaaacaccagcgtgggcacccccttctggatggcccccgaggtgatcgcctgcgagcagcagctggacaccacctacgacgccagatgcgacacctggagcctgggcatcaccgccatcgagctgggcgacggcgacccccccctggccgacctgcaccccatgagagccctgttcaagatccccagaaaccccccccccaagctgagacagcccgagctgtggagcgccgagttcaacgacttcatcagcaagtgcctgaccaaggactacgagaagagacccaccgtgagcgagctgctgcagcacaagttcatcacccagatcgagggcaaggacgtgatgctgcagaagcagctgaccgagttcatcggcatccaccagtgcatgggcggcaccgagaaggccagaagagagagaatccacaccaagaagggcaacttcaacagacccctgatcagcaacctgaaggacgtggacgacctggccaccctggagatcctggacgagaacaccgtgagcgagcagctggagaagtgctacagcagagaccagatctacgtgtacgtgggcgacatcctgatcgccctgaaccccttccagagcctgggcctgtacagcaccaagcacagcaagctgtacatcggcagcaagagaaccgccagccccccccacatcttcgccatggccgacctgggctaccagagcatgatcacctacaacagcgaccagtgcatcgtgatcagcggcgagagcggcgccggcaagaccgagaacgcccacctgctggtgcagcagctgaccgtgctgggcaaggccaacaacagaaccctgcaggagaagatcctgcaggtgaacaacctggtggaggccttcggcaacgcctgcaccatcatcaacgacaacagcagcagattcggcaagtacctggagatgaagttcaccagcagcggcgccgtggtgggcgcccagatcagcgagtacctgctggagaagagcagagtgatccaccaggccatcggcgagaagaacttccacatcttctactacatctacgccggcctggccgagaagaagaagctggcccactacaagctgcccgagaacaagccccccagatacctgcagaacgaccacctgagaaccgtgcaggacatcatgaacaacagcttctacaagagccagtacgagctgatcgagcagtgcttcaaggtgatcggcttcaccatggagcagctgggcagcatctacagcatcctggccgccatcctgaacgtgggcaacatcgagttcagcagcgtggccaccgagcaccagatcgacaagagccacatcagcaaccacaccgccctggagaactgcgccagcctgctgtgcatcagagccgacgagctgcaggaggccctgaccagccactgcgtggtgaccagaggcgagaccatcatcagacccaacaccgtggagaaggccaccgacgtgagagacgccatggccaagaccctgtacggcagactgttcagctggatcgtgaactgcatcaacagcctgctgaagcacgacagcagccccagcggcaacggcgacgagctgagcatcggcatcctggacatcttcggcttcgagaacttcaagaagaacagcttcgagcagctgtgcatcaacatcgccaacgagcagatccagtactactacaaccagcacgtgttcgcctgggagcagaacgagtacctgaacgaggacgtggacgccagagtgatcgagtacgaggacaactggcccctgctggacatgttcctgcagaagcccatgggcctgctgagcctgctggacgaggagagcagattccccaaggccaccgaccagaccctggtggagaagttcgagggcaacctgaagagccagtacttctggagacccaagagaatggagctgagcttcggcatccaccactacgccggcaaggtgctgtacaacgccagcggcttcctggccaagaacagagacaccctgcccaccgacatcgtgctgctgctgagaagcagcgacaacagcgtgatcagacagctggtgaaccaccccctgaccaagaccggcaacctgccccacagcaagaccaagaacgtgatcaactaccagatgagaaccagcgagaagctgatcaacctggccaagggcgacaccggcgaggccaccagacacgccagagagaccaccaacatgaagacccagaccgtggccagctacttcagatacagcctgatggacctgctgagcaagatggtggtgggccagccccacttcgtgagatgcatcaagcccaacagcgagagacaggccagaaagtacgacaaggagaaggtgctgctgcagctgagatacaccggcatcctggagaccgccagaatcagaagactgggcttcagccacagaatcctgttcgccaacttcatcaagagatactacctgctgtgctacaagagcagcgaggagcccagaatgagccccgacacctgcgccaccatcctggagaaggccggcctggacaactgggccctgggcaagaccaaggtgttcctgaagtactaccacgtggagcagctgaacctgatgagaaaggaggccatcgacaagctgatcctgatccaggcctgcgtgagagccttcctgtgcagcagaagataccagaagatccaggagaagagaaaggagagcgccatcatcatccagagcgccgccagaggccacctggtgagaaagcagagaaaggagatcgtggacatgaagaacaccgccgtgaccaccatccagaccagcgaccaggagttcgactacaagaagaacttcgagaacaccagagagagcttcgtgaagaagcaggccgagaacgccatcagcgccaacgagagattcatcagcgcccccaacaacaagggcagcgtgagcgtggtgaagaccagcaccttcaagcccgaggaggagaccaccaacgccgtggagagcaacaacagagtgtaccagacccccaagaagatgaacaacgtgtacgaggaggaggtgaagcaggagttctacctggtgggccccgaggtgagccccaagcagaagagcgtgaaggacctggaggagaacagcaacctgagaaaggtggagaaggaggaggccatgatccagagctactaccagagatacaccgaggagagaaactgcgaggagagcaaggccgcctacctggagagaaaggccatcagcgagagacccagctaccccgtgccctggctggccgagaacgagaccagcttcaagaagaccctggagcccaccctgagccagagaagcatctaccagaacgccaacagcatggagaaggagaagaagaccagcgtggtgacccagagagcccccatctgcagccaggaggagggcagaggcagactgagacacgagaccgtgaaggagagacaggtggagcccgtgacccaggcccaggaggaggaggacaaggccgccgtgttcatccagagcaagtacagaggctacaagagaagacagcagctgagaaaggacaagatgagcagcttcaagcaccagagaatcgtgaccacccccaccgaggtggccagaaacacccacaacctgtacagctaccccaccaagcacgaggagatcaacaacatcaagaagaaggacaacaaggacagcaaggccaccagcgagagagaggcctgcggcctggccatcttcagcaagcagatcagcaagctgagcgaggagtacttcatcctgcagaagaagctgaacgagatgatcctgagccagcagctgaagagcctgtacctgggcgtgagccaccacaagcccatcaacagaagagtgagcagccagcagtgcctgagcggcgtgtgcaagggcgaggagcccaagatcctgagaccccccagaagacccagaaagcccaagaccctgaacaaccccgaggacagcacctactactacctgctgcacaagagcatccaggaggagaagagaagacccagaaaggacagccagggcaagctgctggacctggaggacttctactacaaggagttcctgcccagcagaagcggccccaaggagcacagccccagcctgagagagagaagaccccagcaggagctgcagaaccagtgcatcaaggccaacgagagatgctgggccgccgagagccccgagaaggaggaggagagagagcccgccgccaacccctacgacttcagaagactgctgagaaagaccagccagagaagaagactggtgcagcagagctag

SEQ ID NO: 90002 - DNA, 594 bp, Artificial Sequence
  Description of Artificial Sequence: Synthetic coding sequence
atgttccccctgatcggcaagaccatcatcttcgacaacttccccgaccccagcgacacctgggagatcaccgagaccatcggcaagggcacctacggcaaggtgttcaaggtgctgaacaagaagaacggccagaaggccgccgtgaagatcctggaccccatccacgacatcgacgaggagatcgaggccgagtacaacatcctgaaggccctgagcgaccaccccaacgtggtgagattctacggcatctacttcaagaaggacaaggtgaacggcgacaagctgtggctggtgctggagctgtgcagcggcggcagcgtgaccgacctggtgaagggcttcctgaagagaggcgagagaatgagcgagcccctgatcgcctacatcctgcacgaggccctgatgggcctgcagcacctgcacaacaacaagaccatccacagagacgtgaagggcaacaacatcctgctgaccaccgagggcggcgtgaagctggtggacttcggcgtgagcgcccagctgaccagcaccagacacagaagaaacaccagcgtgggcacccccttctggatggcccccgaggtgagatag

SEQ ID NO: 90003 - DNA, 744 bp, Artificial Sequence
  Description of Artificial Sequence: Synthetic coding sequence
atgttccccctgatcggcaagaccatcatcttcgacaacttccccgaccccagcgacacctgggagatcaccgagaccatcggcaagggcacctacggcaaggtgttcaaggtgctgaacaagaagaacggccagaaggccgccgtgaagatcctggaccccatccacgacatcgacgaggagatcgaggccgagtacaacatcctgaaggccctgagcgaccaccccaacgtggtgagattctacggcatctacttcaagaaggacaaggtgaacggcgacaagctgtggctggtgctggagctgtgcagcggcggcagcgtgaccgacctggtgaagggcttcctgaagagaggcgagagaatgagcgagcccctgatcgcctacatcctgcacgaggccctgatgggcctgcagcacctgcacaacaacaagaccatccacagagacgtgaagggcaacaacatcctgctgaccaccgagggcggcgtgaagctggtggacttcggcgtgagcgcccagctgaccagcaccagacacagaagaaacaccagcgtgggcacccccttctggatggcccccgaggtgatcgcctgcgagcagcagctggacaccacctacgacgccagatgcgacacctggagcctgggcatcaccgccatcgagctgggcgacggcgacccccccctggccgacctgcaccccatgagagccctgttcaagatccccagaagcgacgactag

SEQ ID NO: 90004 - DNA, 1995 bp, Artificial Sequence
  Description of Artificial Sequence: Synthetic coding sequence
atgttccccctgatcggcaagaccatcatcttcgacaacttccccgaccccagcgacacctgggagatcaccgagaccatcggcaagggcacctacggcaaggtgttcaaggtgctgaacaagaagaacggccagaaggccgccgtgaagatcctggaccccatccacgacatcgacgaggagatcgaggccgagtacaacatcctgaaggccctgagcgaccaccccaacgtggtgagattctacggcatctacttcaagaaggacaaggtgaacggcgacaagctgtggctggtgctggagctgtgcagcggcggcagcgtgaccgacctggtgaagggcttcctgaagagaggcgagagaatgagcgagcccctgatcgcctacatcctgcacgaggccctgatgggcctgcagcacctgcacaacaacaagaccatccacagagacgtgaagggcaacaacatcctgctgaccaccgagggcggcgtgaagctggtggacttcggcgtgagcgcccagctgaccagcaccagacacagaagaaacaccagcgtgggcacccccttctggatggcccccgaggtgatcgcctgcgagcagcagctggacaccacctacgacgccagatgcgacacctggagcctgggcatcaccgccatcgagctgggcgacggcgacccccccctggccgacctgcaccccatgagagccctgttcaagatccccagaaaccccccccccaagctgagacagcccgagctgtggagcgccgagttcaacgacttcatcagcaagtgcctgaccaaggactacgagaagagacccaccgtgagcgagctgctgcagcacaagttcatcacccagatcgagggcaaggacgtgatgctgcagaagcagctgaccgagttcatcggcatccaccagtgcatgggcggcaccgagaaggccagaagagagagaatccacaccaagaagggcaacttcaacagacccctgatcagcaacctgaaggacgtggacgacctggccaccctggagatcctggacgagaacaccgtgagcgagcagctggagaagtgctacagcagagaccagatctacgtgtacgtgggcgacatcctgatcgccctgaaccccttccagagcctgggcctgtacagcaccaagcacagcaagctgtacatcggcagcaagagaaccgccagccccccccacatcttcgccatggccgacctgggctaccagagcatgatcacctacaacagcgaccagtgcatcgtgatcagcggcgagagcggcgccggcaagaccgagaacgcccacctgctggtgcagcagctgaccgtgctgggcaaggccaacaacagaaccctgcaggagaagatcctgcaggtgaacaacctggtggaggccttcggcaacgcctgcaccatcatcaacgacaacagcagcagattcggcaagtacctggagatgaagttcaccagcagcggcgccgtggtgggcgcccagatcagcgagtacctgctggagaagagcagagtgatccaccaggccatcggcgagaagaacttccacatcttctactacatctacgccggcctggccgagaagaagaagctggcccactacaagctgcccgagaacaagccccccagatacctgcagaacgaccacctgagaaccgtgcaggacatcatgaacaacagcttctacaagagccagtacgagctgatcgagcagtgcttcaaggtgatcggcttcaccatggaggtgctgggcggcggcgagcccagagagggcggcggcgagagagccagcagccagcccctgagactgcaggaggcccccgcccagaacctgcccgcccccgcccccagacccgccgtgctgaccgtgcagagaggcagccacagaagaagaaaggccctggagcccgccggccagcagggccccagcagacacagcggcgccggcaccagcagacactag

SEQ ID NO: 90005 - DNA, 3834 bp, Artificial Sequence
  Description of Artificial Sequence: Synthetic coding sequence
aagcacctgtacggcctgttccactacaaccccatgatgctgggcctggagagcctgcccgaccccaccgacacctgggagatcatcgagaccatcggcaagggcacctacggcaaggtgtacaaggtgaccaacaagagagacggcagcctggccgccgtgaagatcctggaccccgtgagcgacatggacgaggagatcgaggccgagtacaacatcctgcagttcctgcccaaccaccccaacgtggtgaagttctacggcatgttctacaaggccgaccactgcgtgggcggccagctgtggctggtgctggagctgtgcaacggcggcagcgtgaccgagctggtgaagggcctgctgagatgcggccagagactggacgaggccatgatcagctacatcctgtacggcgccctgctgggcctgcagcacctgcacaacaacagaatcatccacagagacgtgaagggcaacaacatcctgctgaccaccgagggcggcgtgaagctggtggacttcggcgtgagcgcccagctgaccagcaccagactgagaagaaacaccagcgtgggcacccccttctggatggcccccgaggtgatcgcctgcgagcagcagtacgacagcagctacgacgccagatgcgacgtgtggagcctgggcatcaccgccatcgagctgggcgacggcgacccccccctgttcgacatgcaccccgtgaagaccctgttcaagatccccagaaaccccccccccaccctgctgcaccccgagaagtggtgcgaggagttcaaccacttcatcagccagtgcctgatcaaggacttcgagagaagacccagcgtgacccacctgctggaccaccccttcatcaagggcgtgcacggcaaggtgctgttcctgcagaagcagctggccaaggtgctgcaggaccagaagcaccagaaccccgtggccaagaccagacacgagagaatgcacaccagaagaccctaccacgtggaggacgccgagaagtactgcctggaggacgacctggtgaacctggaggtgctggacgaggacaccatcatccaccagctgcagaagagatacgccgacctgctgatctacacctacgtgggcgacatcctgatcgccctgaaccccttccagaacctgagcatctacagcccccagttcagcagactgtaccacggcgtgaagagagccagcaaccccccccacatcttcgccagcgccgacgccgcctaccagtgcatggtgaccctgagcaaggaccagtgcatcgtgatcagcggcgagagcggcagcggcaagaccgagagcgcccacctgatcgtgcagcacctgaccttcctgggcaaggccaacaaccagaccctgagagagaagatcctgcaggtgaacagcctggtggaggccttcggcaacagctgcaccgccatcaacgacaacagcagcagattcggcaagtacctggagatgatgttcacccccaccggcgtggtgatgggcgccagaatcagcgagtacctgctggagaagagcagagtgatcaagcaggccgccagagagaagaacttccacatcttctactacatctacgccggcctgcaccaccagaagaagctgagcgacttcagactgcccgaggagaagccccccagatacatcgccgacgagaccggcagagtgatgcacgacatcaccagcaaggagagctacagaagacagttcgaggccatccagcactgcttcagaatcatcggcttcaccgacaaggaggtgcacagcgtgtacagaatcctggccggcatcctgaacatcggcaacatcgagttcgccgccatcagcagccagcaccagaccgacaagagcgaggtgcccaacgccgaggccctgcagaacgccgccagcgtgctgtgcatcagccccgaggagctgcaggaggccctgaccagccactgcgtggtgaccagaggcgagaccatcatcagagccaacaccgtggacagagccgccgacgtgagagacgccatgagcaaggccctgtacggcagactgttcagctggatcgtgaacagaatcaacaccctgctgcagcccgacgagaacatctgcagcgccggcggcggcatgaacgtgggcatcctggacatcttcggcttcgagaacttccagagaaacagcttcgagcagctgtgcatcaacatcgccaacgagcagatccagtactacttcaaccagcacgtgttcgccctggagcagatggagtaccagaacgagggcatcgacgccgtgcccgtggagtacgaggacaacagacccctgctggacatgttcctgcagaagcccctgggcctgctggccctgctggacgaggagagcagattcccccaggccaccgaccagaccctggtggacaagttcgaggacaacctgagatgcaagtacttctggagacccaagggcgtggagctgtgcttcggcatccagcactacgccggcaaggtgctgtacgacgccagcggcgtgctggagaagaacagagacaccctgcccgccgacgtggtggtggtgctgagaaccagcgagaacaagctgctgcagcagctgttcagcatccccctgaccaagaccggcaacctggcccagaccagagccagaatcaccgtggccagcagcagcctgcccccccacttcagcgccggcaaggccaaggtggacaccctggaggtgatcagacaccccgaggagaccaccaacatgaagagacagaccgtggccagctacttcagatacagcctgatggacctgctgagcaagatggtggtgggccagccccacttcgtgagatgcatcaagcccaacgacgacagagaggccctgcagttcagcagagagagagtgctggcccagctgagaagcaccggcatcctggagaccgtgagcatcagaagacagggctacagccacagaatcctgttcgaggagttcgtgaagagatactactacctggccttcaccgcccaccagacccccctggccagcaaggagagctgcgtggccatcctggagaagagcagactggaccactgggtgctgggcaagaccaaggtgttcctgaagtactaccacgtggagcagctgaacctgctgctgagagaggtgatcggcagagtggtggtgctgcaggcctacaccaagggctggctgggcgccagaagatacaagagagtgagagagaagagagagaagggcgccatcgccatccagagcgcctggagaggctacgacgccagaagaaagttcaagaagatcagcaacagaagaaacgagagcgccgcccacaaccaggccggcgacaccagcaaccagagcagcggcccccacagccccgtggccgccggcaccagaggcagcgccgaggtgcaggactgcagcgagcccggcgaccacaaggtgctgagaggcagcgtgcacagaagaagccacagccaggccgagagcaacaacggcagaacccagaccagcagcaacagccccgccgtgaccgagaagaacggccacagccaggcccagagcagccccaagggctgcgacatcttcgccggccacgccaacaagcacagcgtgagcggcaccgacctgctgagcagcagaatctgccaccccgcccccgaccagcagggcctgagcctgtggggcgccccccagaagcccgccttcccccactacggctgcaacttctacggcttcagaaagtggagctgcaccgaggccagcaacaccagccccaccatgagcgccgcccagaacgccgagtag

SEQ ID NO: 90006 - DNA, 4053 bp, Artificial Sequence
  Description of Artificial Sequence: Synthetic coding sequence
atgctgcagagcgccctgctgagcaccagaaagcacctgtacggcctgttccactacaaccccatgatgctgggcctggagagcctgcccgaccccaccgacacctgggagatcatcgagaccatcggcaagggcacctacggcaaggtgtacaaggtgaccaacaagagagacggcagcctggccgccgtgaagatcctggaccccgtgagcgacatggacgaggagatcgaggccgagtacaacatcctgcagttcctgcccaaccaccccaacgtggtgaagttctacggcatgttctacaaggccgaccactgcgtgggcggccagctgtggctggtgctggagctgtgcaacggcggcagcgtgaccgagctggtgaagggcctgctgagatgcggccagagactggacgaggccatgatcagctacatcctgtacggcgccctgctgggcctgcagcacctgcacaacaacagaatcatccacagagacgtgaagggcaacaacatcctgctgaccaccgagggcggcgtgaagctggtggacttcggcgtgagcgcccagctgaccagcaccagactgagaagaaacaccagcgtgggcacccccttctggatggcccccgaggtgatcgcctgcgagcagcagtacgacagcagctacgacgccagatgcgacgtgtggagcctgggcatcaccgccatcgagctgggcgacggcgacccccccctgttcgacatgcaccccgtgaagaccctgttcaagatccccagaaaccccccccccaccctgctgcaccccgagaagtggtgcgaggagttcaaccacttcatcagccagtgcctgatcaaggacttcgagagaagacccagcgtgacccacctgctggaccaccccttcatcaagggcgtgcacggcaaggtgctgttcctgcagaagcagctggccaaggtgctgcaggaccagaagcaccagaaccccgtggccaagaccagacacgagagaatgcacaccagaagaccctaccacgtggaggacgccgagaagtactgcctggaggacgacctggtgaacctggaggtgctggacgaggacaccatcatccaccagctgcagaagagatacgccgacctgctgatctacacctacgtgggcgacatcctgatcgccctgaaccccttccagaacctgagcatctacagcccccagttcagcagactgtaccacggcgtgaagagagccagcaaccccccccacatcttcgccagcgccgacgccgcctaccagtgcatggtgaccctgagcaaggaccagtgcatcgtgatcagcggcgagagcggcagcggcaagaccgagagcgcccacctgatcgtgcagcacctgaccttcctgggcaaggccaacaaccagaccctgagagagaagatcctgcaggtgaacagcctggtggaggccttcggcaacagctgcaccgccatcaacgacaacagcagcagattcggcaagtacctggagatgatgttcacccccaccggcgtggtgatgggcgccagaatcagcgagtacctgctggagaagagcagagtgatcaagcaggccgccagagagaagaacttccacatcttctactacatctacgccggcctgcaccaccagaagaagctgagcgacttcagactgcccgaggagaagccccccagatacatcgccgacgagaccggcagagtgatgcacgacatcaccagcaaggagagctacagaagacagttcgaggccatccagcactgcttcagaatcatcggcttcaccgacaaggaggtgcacagcgtgtacagaatcctggccggcatcctgaacatcggcaacatcgagttcgccgccatcagcagccagcaccagaccgacaagagcgaggtgcccaacgccgaggccctgcagaacgccgccagcgtgctgtgcatcagccccgaggagctgcaggaggccctgaccagccactgcgtggtgaccagaggcgagaccatcatcagagccaacaccgtggacagagccgccgacgtgagagacgccatgagcaaggccctgtacggcagactgttcagctggatcgtgaacagaatcaacaccctgctgcagcccgacgagaacatctgcagcgccggcggcggcatgaacgtgggcatcctggacatcttcggcttcgagaacttccagagaaacagcttcgagcagctgtgcatcaacatcgccaacgagcagatccagtactacttcaaccagcacgtgttcgccctggagcagatggagtaccagaacgagggcatcgacgccgtgcccgtggagtacgaggacaacagacccctgctggacatgttcctgcagaagcccctgggcctgctggccctgctggacgaggagagcagattcccccaggccaccgaccagaccctggtggacaagttcgaggacaacctgagatgcaagtacttctggagacccaagggcgtggagctgtgcttcggcatccagcactacgccggcaaggtgctgtacgacgccagcggcgtgctggagaagaacagagacaccctgcccgccgacgtggtggtggtgctgagaaccagcgagaacaagctgctgcagcagctgttcagcatccccctgaccaagaccggcaacctggcccagaccagagccagaatcaccgtggccagcagcagcctgcccccccacttcagcgccggcaaggccaaggtggacaccctggaggtgatcagacaccccgaggagaccaccaacatgaagagacagaccgtggccagctacttcagatacagcctgatggacctgctgagcaagatggtggtgggccagccccacttcgtgagatgcatcaagcccaacgacgacagagaggccctgcagttcagcagagagagagtgctggcccagctgagaagcaccggcatcctggagaccgtgagcatcagaagacagggctacagccacagaatcctgttcgaggagttcgtgaagagatactactacctggccttcaccgcccaccagacccccctggccagcaaggagagctgcgtggccatcctggagaagagcagactggaccactgggtgctgggcaagaccaaggtgttcctgaagtactaccacgtggagcagctgaacctgctgctgagagaggtgatcggcagagtggtggtgctgcaggcctacaccaagggctggctgggcgccagaagatacaagagagtgagagagaagagagagaagggcgccatcgccatccagagcgcctggagaggctacgacgccagaagaaagttcaagaagatcagcaacagaagaaacgagagcgccgcccacaaccaggccggcgacaccagcaaccagagcagcggcccccacagccccgtggccgccggcaccagaggcagcgccgaggtgcaggactgcagcgagcccggcgaccacaaggtgctgagaggcagcgtgcacagaagaagccacagccaggccgagagcaacaacggcagaacccagaccagcagcaacagccccgccgtgaccgagaagaacggccacagccaggcccagagcagccccaagggctgcgacatcttcgccggccacgccaacaagcacagcgtgagcggcaccgacctgctgagcagcagaatctgccaccccgcccccgaccagcagggcctgagcctgtggggcgccccccagaagcccggcagcgagaacggcctggcccagaagcacagaacccccagaagaagatgccagcagcccaagatgctgagcagccccgaggacaccatgtactacaaccagctgaacggcaccctggagtaccagggcagcaagagaaagcccagaaagctgggccagatcaaggtgctggacggcgaggacgagtactacaagagcctgagccccgtggactgcatccccgaggagaacaacagcgcccaccccagcttcttcagcagcagcagcaagggcgacagcttcgcccagcactag

SEQ ID NO: 90007 - DNA, 4026 bp, Artificial Sequence
  Description of Artificial Sequence: Synthetic coding sequence
atgaagcacctgtacggcctgttccactacaaccccatgatgctgggcctggagagcctgcccgaccccaccgacacctgggagatcatcgagaccatcggcaagggcacctacggcaaggtgtacaaggtgaccaacaagagagacggcagcctggccgccgtgaagatcctggaccccgtgagcgacatggacgaggagatcgaggccgagtacaacatcctgcagttcctgcccaaccaccccaacgtggtgaagttctacggcatgttctacaaggccgaccactgcgtgggcggccagctgtggctggtgctggagctgtgcaacggcggcagcgtgaccgagctggtgaagggcctgctgagatgcggccagagactggacgaggccatgatcagctacatcctgtacggcgccctgctgggcctgcagcacctgcacaacaacagaatcatccacagagacgtgaagggcaacaacatcctgctgaccaccgagggcggcgtgaagctggtggacttcggcgtgagcgcccagctgaccagcaccagactgagaagaaacaccagcgtgggcacccccttctggatggcccccgaggtgatcgcctgcgagcagcagtacgacagcagctacgacgccagatgcgacgtgtggagcctgggcatcaccgccatcgagctgggcgacggcgacccccccctgttcgacatgcaccccgtgaagaccctgttcaagatccccagaaaccccccccccaccctgctgcaccccgagaagtggtgcgaggagttcaaccacttcatcagccagtgcctgatcaaggacttcgagagaagacccagcgtgacccacctgctggaccaccccttcatcaagggcgtgcacggcaaggtgctgttcctgcagaagcagctggccaaggtgctgcaggaccagaagcaccagaaccccgtggccaagaccagacacgagagaatgcacaccagaagaccctaccacgtggaggacgccgagaagtactgcctggaggacgacctggtgaacctggaggtgctggacgaggacaccatcatccaccagctgcagaagagatacgccgacctgctgatctacacctacgtgggcgacatcctgatcgccctgaaccccttccagaacctgagcatctacagcccccagttcagcagactgtaccacggcgtgaagagagccagcaaccccccccacatcttcgccagcgccgacgccgcctaccagtgcatggtgaccctgagcaaggaccagtgcatcgtgatcagcggcgagagcggcagcggcaagaccgagagcgcccacctgatcgtgcagcacctgaccttcctgggcaaggccaacaaccagaccctgagagagaagatcctgcaggtgaacagcctggtggaggccttcggcaacagctgcaccgccatcaacgacaacagcagcagattcggcaagtacctggagatgatgttcacccccaccggcgtggtgatgggcgccagaatcagcgagtacctgctggagaagagcagagtgatcaagcaggccgccagagagaagaacttccacatcttctactacatctacgccggcctgcaccaccagaagaagctgagcgacttcagactgcccgaggagaagccccccagatacatcgccgacgagaccggcagagtgatgcacgacatcaccagcaaggagagctacagaagacagttcgaggccatccagcactgcttcagaatcatcggcttcaccgacaaggaggtgcacagcgtgtacagaatcctggccggcatcctgaacatcggcaacatcgagttcgccgccatcagcagccagcaccagaccgacaagagcgaggtgcccaacgccgaggccctgcagaacgccgccagcgtgctgtgcatcagccccgaggagctgcaggaggccctgaccagccactgcgtggtgaccagaggcgagaccatcatcagagccaacaccgtggacagagccgccgacgtgagagacgccatgagcaaggccctgtacggcagactgttcagctggatcgtgaacagaatcaacaccctgctgcagcccgacgagaacatctgcagcgccggcggcggcatgaacgtgggcatcctggacatcttcggcttcgagaacttccagagaaacagcttcgagcagctgtgcatcaacatcgccaacgagcagatccagtactacttcaaccagcacgtgttcgccctggagcagatggagtaccagaacgagggcatcgacgccgtgcccgtggagtacgaggacaacagacccctgctggacatgttcctgcagaagcccctgggcctgctggccctgctggacgaggagagcagattcccccaggccaccgaccagaccctggtggacaagttcgaggacaacctgagatgcaagtacttctggagacccaagggcgtggagctgtgcttcggcatccagcactacgccggcaaggtgctgtacgacgccagcggcgtgctggagaagaacagagacaccctgcccgccgacgtggtggtggtgctgagaaccagcgagaacaagctgctgcagcagctgttcagcatccccctgaccaagaccggcaacctggcccagaccagagccagaatcaccgtggccagcagcagcctgcccccccacttcagcgccggcaaggccaaggtggacaccctggaggtgatcagacaccccgaggagaccaccaacatgaagagacagaccgtggccagctacttcagatacagcctgatggacctgctgagcaagatggtggtgggccagccccacttcgtgagatgcatcaagcccaacgacgacagagaggccctgcagttcagcagagagagagtgctggcccagctgagaagcaccggcatcctggagaccgtgagcatcagaagacagggctacagccacagaatcctgttcgaggagttcgtgaagagatactactacctggccttcaccgcccaccagacccccctggccagcaaggagagctgcgtggccatcctggagaagagcagactggaccactgggtgctgggcaagaccaaggtgttcctgaagtactaccacgtggagcagctgaacctgctgctgagagaggtgatcggcagagtggtggtgctgcaggcctacaccaagggctggctgggcgccagaagatacaagagagtgagagagaagagagagaagggcgccatcgccatccagagcgcctggagaggctacgacgccagaagaaagttcaagaagatcagcaacagaagaaacgagagcgccgcccacaaccaggccggcgacaccagcaaccagagcagcggcccccacagccccgtggccgccggcaccagaggcagcgccgaggtgcaggactgcagcgagcccggcgaccacaaggtgctgagaggcagcgtgcacagaagaagccacagccaggccgagagcaacaacggcagaacccagaccagcagcaacagccccgccgtgaccgagaagaacggccacagccaggcccagagcagccccaagggctgcgacatcttcgccggccacgccaacaagcacagcgtgagcggcaccgacctgctgagcagcagaatctgccaccccgcccccgaccagcagggcctgagcctgtggggcgccccccagaagcccggcagcgagaacggcctggcccagaagcacagaacccccagaagaagatgccagcagcccaagatgctgagcagccccgaggacaccatgtactacaaccagctgaacggcaccctggagtaccagggcagcaagagaaagcccagaaagctgggccagatcaaggtgctggacggcgaggacgagtactacaagagcctgagccccgtggactgcatccccgaggagaacaacagcgcccaccccagcttcttcagcagcagcagcaagggcgacagcttcgcccagcactag

SEQ ID NO: 90008 - DNA, 3945 bp, Artificial Sequence
  Description of Artificial Sequence: Synthetic coding sequence
atgaagcacctgtacggcctgttccactacaaccccatgatgctgggcctggagagcctgcccgaccccaccgacacctgggagatcatcgagaccatcggcaagggcacctacggcaaggtgtacaaggtgaccaacaagagagacggcagcctggccgccgtgaagatcctggaccccgtgagcgacatggacgaggagatcgaggccgagtacaacatcctgcagttcctgcccaaccaccccaacgtggtgaagttctacggcatgttctacaaggccgaccactgcgtgggcggccagctgtggctggtgctggagctgtgcaacggcggcagcgtgaccgagctggtgaagggcctgctgagatgcggccagagactggacgaggccatgatcagctacatcctgtacggcgccctgctgggcctgcagcacctgcacaacaacagaatcatccacagagacgtgaagggcaacaacatcctgctgaccaccgagggcggcgtgaagctggtggacttcggcgtgagcgcccagctgaccagcaccagactgagaagaaacaccagcgtgggcacccccttctggatggcccccgaggtgatcgcctgcgagcagcagtacgacagcagctacgacgccagatgcgacgtgtggagcctgggcatcaccgccatcgagctgggcgacggcgacccccccctgttcgacatgcaccccgtgaagaccctgttcaagatccccagaaaccccccccccaccctgctgcaccccgagaagtggtgcgaggagttcaaccacttcatcagccagtgcctgatcaaggacttcgagagaagacccagcgtgacccacctgctggaccaccccttcatcaagggcgtgcacggcaaggtgctgttcctgcagaagcagctggccaaggtgctgcaggaccagaagcaccagaaccccgtggccaagaccagacacgagagaatgcacaccagaagaccctaccacgtggaggacgccgagaagtactgcctggaggacgacctggtgaacctggaggtgctggacgaggacaccatcatccaccagctgcagaagagatacgccgacctgctgatctacacctacgtgggcgacatcctgatcgccctgaaccccttccagaacctgagcatctacagcccccagttcagcagactgtaccacggcgtgaagagagccagcaaccccccccacatcttcgccagcgccgacgccgcctaccagtgcatggtgaccctgagcaaggaccagtgcatcgtgatcagcggcgagagcggcagcggcaagaccgagagcgcccacctgatcgtgcagcacctgaccttcctgggcaaggccaacaaccagaccctgagagagaagatcctgcaggtgaacagcctggtggaggccttcggcaacagctgcaccgccatcaacgacaacagcagcagattcggcaagtacctggagatgatgttcacccccaccggcgtggtgatgggcgccagaatcagcgagtacctgctggagaagagcagagtgatcaagcaggccgccagagagaagaacttccacatcttctactacatctacgccggcctgcaccaccagaagaagctgagcgacttcagactgcccgaggagaagccccccagatacatcgccgacgagaccggcagagtgatgcacgacatcaccagcaaggagagctacagaagacagttcgaggccatccagcactgcttcagaatcatcggcttcaccgacaaggaggtgcacagcgtgtacagaatcctggccggcatcctgaacatcggcaacatcgagttcgccgccatcagcagccagcaccagaccgacaagagcgaggtgcccaacgccgaggccctgcagaacgccgccagcgtgctgtgcatcagccccgaggagctgcaggaggccctgaccagccactgcgtggtgaccagaggcgagaccatcatcagagccaacaccgtggacagagccgccgacgtgagagacgccatgagcaaggccctgtacggcagactgttcagctggatcgtgaacagaatcaacaccctgctgcagcccgacgagaacatctgcagcgccggcggcggcatgaacgtgggcatcctggacatcttcggcttcgagaacttccagagaaacagcttcgagcagctgtgcatcaacatcgccaacgagcagatccagtactacttcaaccagcacgtgttcgccctggagcagatggagtaccagaacgagggcatcgacgccgtgcccgtggagtacgaggacaacagacccctgctggacatgttcctgcagaagcccctgggcctgctggccctgctggacgaggagagcagattcccccaggccaccgaccagaccctggtggacaagttcgaggacaacctgagatgcaagtacttctggagacccaagggcgtggagctgtgcttcggcatccagcactacgccggcaaggtgctgtacgacgccagcggcgtgctggagaagaacagagacaccctgcccgccgacgtggtggtggtgctgagaaccagcgagaacaagctgctgcagcagctgttcagcatccccctgaccaagaccggcaacctggcccagaccagagccagaatcaccgtggccagcagcagcctgcccccccacttcagcgccggcaaggccaaggtggacaccctggaggtgatcagacaccccgaggagaccaccaacatgaagagacagaccgtggccagctacttcagatacagcctgatggacctgctgagcaagatggtggtgggccagccccacttcgtgagatgcatcaagcccaacgacgacagagaggccctgcagttcagcagagagagagtgctggcccagctgagaagcaccggcatcctggagaccgtgagcatcagaagacagggctacagccacagaatcctgttcgaggagttcgtgaagagatactactacctggccttcaccgcccaccagacccccctggccagcaaggagagctgcgtggccatcctggagaagagcagactggaccactgggtgctgggcaagaccaaggtgttcctgaagtactaccacgtggagcagctgaacctgctgctgagagaggtgatcggcagagtggtggtgctgcaggcctacaccaagggctggctgggcgccagaagatacaagagagtgagagagaagagagagaagggcgccatcgccatccagagcggcgacaccagcaaccagagcagcggcccccacagccccgtggccgccggcaccagaggcagcgccgaggtgcaggactgcagcgagcccggcgaccacaaggtgctgagaggcagcgtgcacagaagaagccacagccaggccgagagcaacaacggcagaacccagaccagcagcaacagccccgccgtgaccgagaagaacggccacagccaggcccagagcagccccaagggctgcgacatcttcgccggccacgccaacaagcacagcgtgagcggcaccgacctgctgagcagcagaatctgccaccccgcccccgaccagcagggcctgagcctgtggggcgccccccagaagcccggcagcgagaacggcctggcccagaagcacagaacccccagaagaagatgccagcagcccaagatgctgagcagccccgaggacaccatgtactacaaccagctgaacggcaccctggagtaccagggcagcaagagaaagcccagaaagctgggccagatcaaggtgctggacggcgaggacgagtactacaagagcctgagccccgtggactgcatccccgaggagaacaacagcgcccaccccagcttcttcagcagcagcagcaagggcgacagcttcgcccagcactag

SEQ ID NO: 90009 - DNA, 3390 bp, Artificial Sequence
  Description of Artificial Sequence: Synthetic coding sequence
atgaacatcaacgacggcggcagaagaagattcgaggacaacgagcacaccctgagaatctaccccggcgccatcagcgagggcaccatctactgccccatccccgccagaaagaacagcaccgccgccgaggtgatcgagagcctgatcaacaagctgcacctggacaagaccaagtgctacgtgctggccgaggtgaaggagttcggcggcgaggagtggatcctgaaccccaccgactgccccgtgcagagaatgatgctgtggcccagaatggccctggagaacagactgagcggcgaggactacagattcctgctgagagagaagaacctggacggcagcatccactacggcagcctgcagagctggctgagagtgaccgaggagagaagaagaatgatggagagaggcttcctgccccagccccagcagaaggacttcgacgacctgtgcagcctgcccgacctgaacgagaagaccctgctggagaacctgagaaacagattcaagcacgagaagatctacacctacgtgggcagcatcctgatcgtgatcaaccccttcaagttcctgcccatctacaaccccaagtacgtgaagatgtacgacaaccaccagctgggcaagctggagccccacatctacgccgtggccgacgtggcctaccacgccatgctgcagagaaagaagaaccagtgcatcgtgatcagcggcgagagcggcagcggcaagacccagagcaccaacttcctgatccaccacctgaccgccctgagccagaagggcttcgccagcggcgtggagcagatcatcctgggcgccggccccgtgctggaggccttcggcaacgccaagaccgcccacaacaacaacagcagcagattcggcaagttcatccaggtgaactaccaggagaccggcaccgtgctgggcgcctacgtggagaagtacctgctggagaagagcagactggtgtaccaggagcacaacgagagaaactaccacgtgttctactacctgctggccggcgccagcgaggacgagagaagcgccttccacctgaagcagcccgaggagtaccactacctgaaccaggactgcttcaccgtggagggcgaggacctgagacacgacttcgagagactgcagctggccatggagatggtgggcttcctgcccaagaccagaagacagatcttcagcctgctgagcgccatcctgcacctgggcaacatctgctacaagaagaagacctacagagacgacagcatcgacatctgcaaccccgaggtgctgcccatcgtgagcgagctgctggaggtgaaggaggagatgctgttcgaggccctggtgaccagaaagaccgtgaccgtgggcgagaagctgatcctgccctacaagctggccgaggccgtgaccgtgagaaacagcatggccaagagcctgtacagcgccctgttcgactggatcgtgttcagaatcaaccacgccctgctgaacagcaaggacctggagcacaacaccaagaccctgagcatcggcgtgctggacatcttcggcttcgaggactacgagaacaacagcttcgagcagttctgcatcaacttcgccaacgagagactgcagcactacttcaaccagcacatcttcaagctggagcaggaggagtacagaaccgagggcatcagctggcacaacatcgactacatcgacaacacctgctgcatcaacctgatcagcaagaagcccaccggcctgctgcacctgctggacgaggagagcaacttcccccaggccaccaaccagaccctgctggacaagttcaagcaccagcacgaggacaacagctacatcgagttccccgccgtgatggagcccgccttcatcatcaagcactacgccggcaaggtgaagtacggcgtgaaggacttcagagagaagaacaccgaccacatgagacccgacatcgtggccctgctgagaagcagcaagaacgccttcatcagcggcatgatcggcatcgaccccgtggccgtgttcagatgggccatcctgagagccttcttcagagccatggtggccttcagagaggccggcaagagaaacatccacagaaagaccggccacgacgacaccgccccctgcgccatcctgaagagcatggacagcttcagcttcctgcagcaccccgtgcaccagagaagcctggagatcctgcagagatgcaaggaggagaagtacagcatcaccagaaagaaccccagaacccccctgagcgacctgcagggcatgaacgccctgaacgagaagaaccagcacgacaccttcgacatcgcctggaacggcagaaccggcatcagacagagcagactgagcagcggcaccagcctgctggacaaggacggcatcttcgccaacagcaccagcagcaagctgctggagagagcccacggcatcctgaccagaaacaagaacttcaagagcaagcccgccctgcccaagcacctgctggaggtgaacagcctgaagcacctgaccagactgaccctgcaggacagaatcaccaagagcctgctgcacctgcacaagaagaagaagccccccagcatcagcgcccagttccaggccagcctgagcaagctgatggagaccctgggccaggccgagccctacttcgtgaagtgcatcagaagcaacgccgagaagctgcccctgagattcagcgacgtgctggtgctgagacagctgagatacaccggcatgctggagaccgtgagaatcagacagagcggctacagcagcaagtacagcttccaggacttcgtgagccacttccacgtgctgctgcccagaaacatcatccccagcaagttcaacatccaggacttcttcagaaagatcaacctgaaccccgacaactaccaggtgggcaagaccatggtgttcctgaaggagcaggagagacagcacctgcaggacctgctgcaccaggaggtgctgagaagaatcatcctgctgcagagatggttcagagtgctgctgtgcagacagcacttcctgcacctgagacaggccagcgtgatcatccagagattctggagaaactacctgaaccagaagcaggtgagagacgccgccgtgcagaaggacgccttcgtgatggccagcgccgccgccctgctgcaggccagctggagagcccacctggagagacagagatacctggagctgagagccgccgccatcgtgatccagcagaagtggagagactactacagaagaagacacatggccgccatctgcatccaggccagatggaaggcctacagagagagcaagagataccaggagcagagaaagaactaccccttcgccatcaacatgtag

SEQ ID NO: 90010 - DNA, 7647 bp, Artificial Sequence
  Description of Artificial Sequence: Synthetic coding sequence
atgaacatcaacgacggcggcagaagaagattcgaggacaacgagcacaccctgagaatctaccccggcgccatcagcgagggcaccatctactgccccatccccgccagaaagaacagcaccgccgccgaggtgatcgagagcctgatcaacaagctgcacctggacaagaccaagtgctacgtgctggccgaggtgaaggagttcggcggcgaggagtggatcctgaaccccaccgactgccccgtgcagagaatgatgctgtggcccagaatggccctggagaacagactgagcggcgaggactacagattcctgctgagagagaagaacctggacggcagcatccactacggcagcctgcagagctggctgagagtgaccgaggagagaagaagaatgatggagagaggcttcctgccccagccccagcagaaggacttcgacgacctgtgcagcctgcccgacctgaacgagaagaccctgctggagaacctgagaaacagattcaagcacgagaagatctacacctacgtgggcagcatcctgatcgtgatcaaccccttcaagttcctgcccatctacaaccccaagtacgtgaagatgtacgacaaccaccagctgggcaagctggagccccacatctacgccgtggccgacgtggcctaccacgccatgctgcagagaaagaagaaccagtgcatcgtgatcagcggcgagagcggcagcggcaagacccagagcaccaacttcctgatccaccacctgaccgccctgagccagaagggcttcgccagcggcgtggagcagatcatcctgggcgccggccccgtgctggaggccttcggcaacgccaagaccgcccacaacaacaacagcagcagattcggcaagttcatccaggtgaactaccaggagaccggcaccgtgctgggcgcctacgtggagaagtacctgctggagaagagcagactggtgtaccaggagcacaacgagagaaactaccacgtgttctactacctgctggccggcgccagcgaggacgagagaagcgccttccacctgaagcagcccgaggagtaccactacctgaaccagatcaccaagaagcccctgagacagagctgggacgactactgctacgacagcgagcccgactgcttcaccgtggagggcgaggacctgagacacgacttcgagagactgcagctggccatggagatggtgggcttcctgcccaagaccagaagacagatcttcagcctgctgagcgccatcctgcacctgggcaacatctgctacaagaagaagacctacagagacgacagcatcgacatctgcaaccccgaggtgctgcccatcgtgagcgagctgctggaggtgaaggaggagatgctgttcgaggccctggtgaccagaaagaccgtgaccgtgggcgagaagctgatcctgccctacaagctggccgaggccgtgaccgtgagaaacagcatggccaagagcctgtacagcgccctgttcgactggatcgtgttcagaatcaaccacgccctgctgaacagcaaggacctggagcacaacaccaagaccctgagcatcggcgtgctggacatcttcggcttcgaggactacgagaacaacagcttcgagcagttctgcatcaacttcgccaacgagagactgcagcactacttcaaccagcacatcttcaagctggagcaggaggagtacagaaccgagggcatcagctggcacaacatcgactacatcgacaacacctgctgcatcaacctgatcagcaagaagcccaccggcctgctgcacctgctggacgaggagagcaacttcccccaggccaccaaccagaccctgctggacaagttcaagcaccagcacgaggacaacagctacatcgagttccccgccgtgatggagcccgccttcatcatcaagcactacgccggcaaggtgaagtacggcgtgaaggacttcagagagaagaacaccgaccacatgagacccgacatcgtggccctgctgagaagcagcaagaacgccttcatcagcggcatgatcggcatcgaccccgtggccgtgttcagatgggccatcctgagagccttcttcagagccatggtggccttcagagaggccggcaagagaaacatccacagaaagaccggccacgacgacaccgccccctgcgccatcctgaagagcatggacagcttcagcttcctgcagcaccccgtgcaccagagaagcctggagatcctgcagagatgcaaggaggagaagtacagcatcaccagaaagaaccccagaacccccctgagcgacctgcagggcatgaacgccctgaacgagaagaaccagcacgacaccttcgacatcgcctggaacggcagaaccggcatcagacagagcagactgagcagcggcaccagcctgctggacaaggacggcatcttcgccaacagcaccagcagcaagctgctggagagagcccacggcatcctgaccagaaacaagaacttcaagagcaagcccgccctgcccaagcacctgctggaggtgaacagcctgaagcacctgaccagactgaccctgcaggacagaatcaccaagagcctgctgcacctgcacaagaagaagaagccccccagcatcagcgcccagttccaggccagcctgagcaagctgatggagaccctgggccaggccgagccctacttcgtgaagtgcatcagaagcaacgccgagaagctgcccctgagattcagcgacgtgctggtgctgagacagctgagatacaccggcatgctggagaccgtgagaatcagacagagcggctacagcagcaagtacagcttccaggacttcgtgagccacttccacgtgctgctgcccagaaacatcatccccagcaagttcaacatccaggacttcttcagaaagatcaacctgaaccccgacaactaccaggtgggcaagaccatggtgttcctgaaggagcaggagagacagcacctgcaggacctgctgcaccaggaggtgctgagaagaatcatcctgctgcagagatggttcagagtgctgctgtgcagacagcacttcctgcacctgagacaggccagcgtgatcatccagagattctggagaaactacctgaaccagaagcaggtgagagacgccgccgtgcagaaggacgccttcgtgatggccagcgccgccgccctgctgcaggccagctggagagcccacctggagagacagagatacctggagctgagagccgccgccatcgtgatccagcagaagtggagagactactacagaagaagacacatggccgccatctgcatccaggccagatggaaggcctacagagagagcaagagataccaggagcagagaaagaagatcatcctgctgcagagcacctgcagaggcttcagagccagacagagattcaaggccctgaaggagcagagactgagagagaccaagcccgaggtgggcctggtgaacatcaagggctacggcagcctggagatccagggcagcgaccccagcggctgggaggactgcagcttcgacaacagaatcaaggccatcgaggagtgcaagagcgtgatcgagagcaacagaatcagcagagagagcagcgtggactgcctgaaggagagccccaacaagcagcaggagagagcccagagccagagcggcgtggacctgcaggaggacgtgctggtgagagagagacccagaagcctggaggacctgcaccagaagaaggtgggcagagccaagagagagagcagaagaatgagagagctggagcaggccatcttcagcctggagctgctgaaggtgagaagcctgggcggcatcagccccagcgaggacagaagatggagcaccgagctggtgcccgagggcctgcagagccccagaggcacccccgacagcgagagcagccagggcagcctggagctgctgagctacgaggagagccagaagagcaagctggagagcgtgatcagcgacgagggcgacctgcagttccccagccccaagatcagcagcagccccaagttcgacagcagagacaacgccctgagcgccagcaacgagaccagcagcgccgagcacctgaaggacggcaccatgaaggagatggtggtgtgcagcagcgagagcatcacctgcaagccccagctgaaggacagcttcatcagcaacagcctgcccaccttcttctacatcccccagcaggaccccctgaagaccaacagccagctggacaccagcatccagagaaacaagctgctggagaacgaggacaccgccggcgaggccctgaccctggacatcaacagagagaccagaagataccactgcagcggcaaggaccagatcgtgcccagcctgaacaccgagagcagcaaccccgtgctgaagaagctggagaagctgaacaccgagaaggaggagagacagaagcagctgcagcagcagaacgagaaggagatgatggagcagatcagacagcagaccgacatcctggagaaggagagaaaggccttcaagaccatcgagaagcccagaatcggcgagtgcctggtggcccccagcagctaccagagcaagcagagagtggagagacccagcagcctgctgagcctgaacaccagcaacaagggcgagctgaacgtgctgggcagcctgagcctgaaggacgccgccctggcccagaaggacagcagcagcgcccacctgccccccaaggacagacccgtgaccgtgttcttcgagagaaagggcagcccctgccagagcagcaccgtgaaggagctgagcaagaccgacagaatgggcacccagctgaacgtggcctgcaagctgagcaacaacagaatcagcaagagagagcacttcagacccacccagagctacagccacaacagcgacgacctgagcagagagggcaacgccagacccatcttcttcacccccaaggacaacatgagcatccccctggtgagcaaggaggccctgaacagcaagaacccccagctgcacaaggaggacgagcccgcctggaagcccgtgaagctggccggccccggccagagagagaccagccagagattcagcagcgtggacgagcaggccaagctgcacaagaccatgagccagggcgagatcaccaagctggccgtgagacagaaggccagcgacagcgacatcagaccccagagagccaagatgagattctgggccaagggcaagcagggcgagaagaagaccaccagagtgaagcccaccacccagagcgaggtgagccccctgttcgccggcaccgacgtgatccccgcccaccagttccccgacgagctggccgcctaccaccccaccccccccctgagccccgagctgcccggcagctgcagaaaggagttcaaggagaacaaggagcccagccccaaggccaagagaaagagaagcgtgaagatcagcaacgtggccctggacagcatgcactggcagaacgacagcgtgcagatcatcgccagcgtgagcgacctgaagagcatggacgagttcctgctgaagaaggtgaacgacctggacaacgaggacagcaagaaggacaccctggtggacgtggtgttcaagaaggccctgaaggagttcagacagaacatcttcagcttctacagcagcgccctggccatggacgacggcaagagcatcagatacaaggacctgtacgccctgttcgagcagatcctggagaagaccatgagactggagcagagagacagcctgggcgagagccccgtgagagtgtgggtgaacaccttcaaggtgttcctggacgagtacatgaacgagttcaagaccagcgactgcaccgccaccaaggtgcccaagaccgagagaaagaagagaagaaagaaggagaccgacctggtggaggagcacaacggccacatcttcaaggccacccagtacagcatccccacctactgcgagtactgcagcagcctgatctggatcatggacagagccagcgtgtgcaagctgtgcaagtacgcctgccacaagaagtgctgcctgaagaccaccgccaagtgcagcaagaagtacgaccccgagctgagcagcagacagttcggcgtggagctgagcagactgaccagcgaggacagaaccgtgcccctggtggtggagaagctgatcaactacatcgagatgcacggcctgtacaccgagggcatctacagaaagagcggcagcaccaacaagatcaaggagctgagacagggcctggacaccgacgccgagagcgtgaacctggacgactacaacatccacgtgatcgccagcgtgttcaagcagtggctgagagacctgcccaaccccctgatgaccttcgagctgtacgaggagttcctgagagccatgggcctgcaggagagaaaggagaccatcagaggcgtgtacagcgtgatcgaccagctgagcagaacccacctgaacaccctggagagactgatcttccacctggtgagaatcgccctgcaggaggacaccaacagaatgagcgccaacgccctggccatcgtgttcgccccctgcatcctgagatgccccgacaccaccgaccccctgcagagcgtgcaggacatcagcaagaccaccacctgcgtggagctgatcgtggtggagcagatgaacaagtacaaggccagactgaaggacatcagcagcctggagttcgccgagaacaaggccaagaccagactgagcctgatcagaagaagcatgggcaagggcagaatcagaagaggcaactaccccggccccagcagccccgtggtggtgagactgcccagcgtgagcgacgtgagcgaggagaccctgaccagcgaggccgccatggagaccgacatcaccgagcagcagcaggccgccatgcagcaggaggagagagtgctgaccgagcagatcgagaacctgcagaaggagaaggaggagctgaccttcgagatgctggtgctggagcccagagccagcgacgacgagaccctggagagcgaggccagcatcggcaccgccgacagcagcgagaacctgaacatggagagcgagtacgccatcagcgagaagagcgagagaagcctggccctgagcagcctgaagaccgccggcaagagcgagcccagcagcaagctgagaaagcagctgaagaagcagcaggacagcctggacgtggtggacagcagcgtgagcagcctgtgcctgagcaacaccgccagcagccacggcaccagaaagctgttccagatctacagcaagagccccttctacagagccgccagcggcaacgaggccctgggcatggagggccccctgggccagaccaagttcctggaggacaagccccagttcatcagcagaggcaccttcaaccccgagaagggcaagcagaagctgaagaacgtgaagaacagcccccagaagaccaaggagacccccgagggcaccgtgatgagcggcagaagaaagaccgtggaccccgactgcaccagcaaccagcagctggccctgttcggcaacaacgagttcatggtgtag

SEQ ID NO: 90011 - DNA, 7860 bp, Artificial Sequence
  Description of Artificial Sequence: Synthetic coding sequence
atgaacatcaacgacggcggcagaagaagattcgaggacaacgagcacaccctgagaatctaccccggcgccatcagcgagggcaccatctactgccccatccccgccagaaagaacagcaccgccgccgaggtgatcgagagcctgatcaacaagctgcacctggacaagaccaagtgctacgtgctggccgaggtgaaggagttcggcggcgaggagtggatcctgaaccccaccgactgccccgtgcagagaatgatgctgtggcccagaatggccctggagaacagactgagcggcgaggactacagattcctgctgagagagaagaacctggacggcagcatccactacggcagcctgcagagctggctgagagtgaccgaggagagaagaagaatgatggagagaggcttcctgccccagccccagcagaaggacttcgacgacctgtgcagcctgcccgacctgaacgagaagaccctgctggagaacctgagaaacagattcaagcacgagaagatctacacctacgtgggcagcatcctgatcgtgatcaaccccttcaagttcctgcccatctacaaccccaagtacgtgaagatgtacgacaaccaccagctgggcaagctggagccccacatctacgccgtggccgacgtggcctaccacgccatgctgcagagaaagaagaaccagtgcatcgtgatcagcggcgagagcggcagcggcaagacccagagcaccaacttcctgatccaccacctgaccgccctgagccagaagggcttcgccagcggcgtggagcagatcatcctgggcgccggccccgtgctggaggccttcggcaacgccaagaccgcccacaacaacaacagcagcagattcggcaagttcatccaggtgaactaccaggagaccggcaccgtgctgggcgcctacgtggagaagtacctgctggagaagagcagactggtgtaccaggagcacaacgagagaaactaccacgtgttctactacctgctggccggcgccagcgaggacgagagaagcgccttccacctgaagcagcccgaggagtaccactacctgaaccagatcaccaagaagcccctgagacagagctgggacgactactgctacgacagcgagcccgactgcttcaccgtggagggcgaggacctgagacacgacttcgagagactgcagctggccatggagatggtgggcttcctgcccaagaccagaagacagatcttcagcctgctgagcgccatcctgcacctgggcaacatctgctacaagaagaagacctacagagacgacagcatcgacatctgcaaccccgaggtgctgcccatcgtgagcgagctgctggaggtgaaggaggagatgctgttcgaggccctggtgaccagaaagaccgtgaccgtgggcgagaagctgatcctgccctacaagctggccgaggccgtgaccgtgagaaacagcatggccaagagcctgtacagcgccctgttcgactggatcgtgttcagaatcaaccacgccctgctgaacagcaaggacctggagcacaacaccaagaccctgagcatcggcgtgctggacatcttcggcttcgaggactacgagaacaacagcttcgagcagttctgcatcaacttcgccaacgagagactgcagcactacttcaaccagcacatcttcaagctggagcaggaggagtacagaaccgagggcatcagctggcacaacatcgactacatcgacaacacctgctgcatcaacctgatcagcaagaagcccaccggcctgctgcacctgctggacgaggagagcaacttcccccaggccaccaaccagaccctgctggacaagttcaagcaccagcacgaggacaacagctacatcgagttccccgccgtgatggagcccgccttcatcatcaagcactacgccggcaaggtgaagtacggcgtgaaggacttcagagagaagaacaccgaccacatgagacccgacatcgtggccctgctgagaagcagcaagaacgccttcatcagcggcatgatcggcatcgaccccgtggccgtgttcagatgggccatcctgagagccttcttcagagccatggtggccttcagagaggccggcaagagaaacatccacagaaagaccggccacgacgacaccgccccctgcgccatcctgaagagcatggacagcttcagcttcctgcagcaccccgtgcaccagagaagcctggagatcctgcagagatgcaaggaggagaagtacagcatcaccagaaagaaccccagaacccccctgagcgacctgcagggcatgaacgccctgaacgagaagaaccagcacgacaccttcgacatcgcctggaacggcagaaccggcatcagacagagcagactgagcagcggcaccagcctgctggacaaggacggcatcttcgccaacagcaccagcagcaagctgctggagagagcccacggcatcctgaccagaaacaagaacttcaagagcaagcccgccctgcccaagcacctgctggaggtgaacagcctgaagcacctgaccagactgaccctgcaggacagaatcaccaagagcctgctgcacctgcacaagaagaagaagccccccagcatcagcgcccagttccaggccagcctgagcaagctgatggagaccctgggccaggccgagccctacttcgtgaagtgcatcagaagcaacgccgagaagctgcccctgagattcagcgacgtgctggtgctgagacagctgagatacaccggcatgctggagaccgtgagaatcagacagagcggctacagcagcaagtacagcttccaggacttcgtgagccacttccacgtgctgctgcccagaaacatcatccccagcaagttcaacatccaggacttcttcagaaagatcaacctgaaccccgacaactaccaggtgggcaagaccatggtgttcctgaaggagcaggagagacagcacctgcaggacctgctgcaccaggaggtgctgagaagaatcatcctgctgcagagatggttcagagtgctgctgtgcagacagcacttcctgcacctgagacaggccagcgtgatcatccagagattctggagaaactacctgaaccagaagcaggtgagagacgccgccgtgcagaaggacgccttcgtgatggccagcgccgccgccctgctgcaggccagctggagagcccacctggagagacagagatacctggagctgagagccgccgccatcgtgatccagcagaagtggagagactactacagaagaagacacatggccgccatctgcatccaggccagatggaaggcctacagagagagcaagagataccaggagcagagaaagaagatcatcctgctgcagagcacctgcagaggcttcagagccagacagagattcaaggccctgaaggagcagagactgagagagaccaagcccgaggtgggcctggtgaacatcaagggctacggcagcctggagatccagggcagcgaccccagcggctgggaggactgcagcttcgacaacagaatcaaggccatcgaggagtgcaagagcgtgatcgagagcaacagaatcagcagagagagcagcgtggactgcctgaaggagagccccaacaagcagcaggagagagcccagagccagagcggcgtggacctgcaggaggacgtgctggtgagagagagacccagaagcctggaggacctgcaccagaagaaggtgggcagagccaagagagagagcagaagaatgagagagctggagcaggccatcttcagcctggagctgctgaaggtgagaagcctgggcggcatcagccccagcgaggacagaagatggagcaccgagctggtgcccgagggcctgcagagccccagaggcacccccgacagcgagagcagccagggcagcctggagctgctgagctacgaggagagccagaagagcaagctggagagcgtgatcagcgacgagggcgacctgcagttccccagccccaagatcagcagcagccccaagttcgacagcagagacaacgccctgagcgccagcaacgagaccagcagcgccgagcacctgaaggacggcaccatgaaggagatggtggtgtgcagcagcgagagcatcacctgcaagccccagctgaaggacagcttcatcagcaacagcctgcccaccttcttctacatcccccagcaggaccccctgaagaccaacagccagctggacaccagcatccagagaaacaagctgctggagaacgaggacaccgccggcgaggccctgaccctggacatcaacagagagaccagaagataccactgcagcggcaaggaccagatcgtgcccagcctgaacaccgagagcagcaaccccgtgctgaagaagctggagaagctgaacaccgagaaggaggagagacagaagcagctgcagcagcagaacgagaaggagatgatggagcagatcagacagcagaccgacatcctggagaaggagagaaaggccttcaagaccatcgagaagcccagaatcggcgagtgcctggtggcccccagcagctaccagagcaagcagagagtggagagacccagcagcctgctgagcctgaacaccagcaacaagggcgagctgaacgtgctgggcagcctgagcctgaaggacgccgccctggcccagaaggacagcagcagcgcccacctgccccccaaggacagacccgtgaccgtgttcttcgagagaaagggcagcccctgccagagcagcaccgtgaaggagctgagcaagaccgacagaatgggcacccagctgaacgtggcctgcaagctgagcaacaacagaatcagcaagagagagcacttcagacccacccagagctacagccacaacagcgacgacctgagcagagagggcaacgccagacccatcttcttcacccccaaggacaacatgagcatccccctggtgagcaaggaggccctgaacagcaagaacccccagctgcacaaggaggacgagcccgcctggaagcccgtgaagctggccggccccggccagagagaggtggccagacccgcccacaagaagaaggccagaatggccagaaccagaagcgacttcctgaccagaggcaccttcgccgacggcgagggcgacaccgaggaggacgactacgacgacatcatcgagcccctgctgagcctggaccaggccagccactgcgagctgggccccgcccccagcctgggccaggccagccacagcgacagcgagatgaccagccagagattcagcagcgtggacgagcaggccaagctgcacaagaccatgagccagggcgagatcaccaagctggccgtgagacagaaggccagcgacagcgacatcagaccccagagagccaagatgagattctgggccaagggcaagcagggcgagaagaagaccaccagagtgaagcccaccacccagagcgaggtgagccccctgttcgccggcaccgacgtgatccccgcccaccagttccccgacgagctggccgcctaccaccccaccccccccctgagccccgagctgcccggcagctgcagaaaggagttcaaggagaacaaggagcccagccccaaggccaagagaaagagaagcgtgaagatcagcaacgtggccctggacagcatgcactggcagaacgacagcgtgcagatcatcgccagcgtgagcgacctgaagagcatggacgagttcctgctgaagaaggtgaacgacctggacaacgaggacagcaagaaggacaccctggtggacgtggtgttcaagaaggccctgaaggagttcagacagaacatcttcagcttctacagcagcgccctggccatggacgacggcaagagcatcagatacaaggacctgtacgccctgttcgagcagatcctggagaagaccatgagactggagcagagagacagcctgggcgagagccccgtgagagtgtgggtgaacaccttcaaggtgttcctggacgagtacatgaacgagttcaagaccagcgactgcaccgccaccaaggtgcccaagaccgagagaaagaagagaagaaagaaggagaccgacctggtggaggagcacaacggccacatcttcaaggccacccagtacagcatccccacctactgcgagtactgcagcagcctgatctggatcatggacagagccagcgtgtgcaagctgtgcaagtacgcctgccacaagaagtgctgcctgaagaccaccgccaagtgcagcaagaagtacgaccccgagctgagcagcagacagttcggcgtggagctgagcagactgaccagcgaggacagaaccgtgcccctggtggtggagaagctgatcaactacatcgagatgcacggcctgtacaccgagggcatctacagaaagagcggcagcaccaacaagatcaaggagctgagacagggcctggacaccgacgccgagagcgtgaacctggacgactacaacatccacgtgatcgccagcgtgttcaagcagtggctgagagacctgcccaaccccctgatgaccttcgagctgtacgaggagttcctgagagccatgggcctgcaggagagaaaggagaccatcagaggcgtgtacagcgtgatcgaccagctgagcagaacccacctgaacaccctggagagactgatcttccacctggtgagaatcgccctgcaggaggacaccaacagaatgagcgccaacgccctggccatcgtgttcgccccctgcatcctgagatgccccgacaccaccgaccccctgcagagcgtgcaggacatcagcaagaccaccacctgcgtggagctgatcgtggtggagcagatgaacaagtacaaggccagactgaaggacatcagcagcctggagttcgccgagaacaaggccaagaccagactgagcctgatcagaagaagcatgggcaagggcagaatcagaagaggcaactaccccggccccagcagccccgtggtggtgagactgcccagcgtgagcgacgtgagcgaggagaccctgaccagcgaggccgccatggagaccgacatcaccgagcagcagcaggccgccatgcagcaggaggagagagtgctgaccgagcagatcgagaacctgcagaaggagaaggaggagctgaccttcgagatgctggtgctggagcccagagccagcgacgacgagaccctggagagcgaggccagcatcggcaccgccgacagcagcgagaacctgaacatggagagcgagtacgccatcagcgagaagagcgagagaagcctggccctgagcagcctgaagaccgccggcaagagcgagcccagcagcaagctgagaaagcagctgaagaagcagcaggacagcctggacgtggtggacagcagcgtgagcagcctgtgcctgagcaacaccgccagcagccacggcaccagaaagctgttccagatctacagcaagagccccttctacagagccgccagcggcaacgaggccctgggcatggagggccccctgggccagaccaagttcctggaggacaagccccagttcatcagcagaggcaccttcaaccccgagaagggcaagcagaagctgaagaacgtgaagaacagcccccagaagaccaaggagacccccgagggcaccgtgatgagcggcagaagaaagaccgtggaccccgactgcaccagcaaccagcagctggccctgttcggcaacaacgagttcatggtgtag

SEQ ID NO: 90012 - DNA, 7590 bp, Artificial Sequence
  Description of Artificial Sequence: Synthetic coding sequence
atgaacatcaacgacggcggcagaagaagattcgaggacaacgagcacaccctgagaatctaccccggcgccatcagcgagggcaccatctactgccccatccccgccagaaagaacagcaccgccgccgaggtgatcgagagcctgatcaacaagctgcacctggacaagaccaagtgctacgtgctggccgaggtgaaggagttcggcggcgaggagtggatcctgaaccccaccgactgccccgtgcagagaatgatgctgtggcccagaatggccctggagaacagactgagcggcgaggactacagattcctgctgagagagaagaacctggacggcagcatccactacggcagcctgcagagctggctgagagtgaccgaggagagaagaagaatgatggagagaggcttcctgccccagccccagcagaaggacttcgacgacctgtgcagcctgcccgacctgaacgagaagaccctgctggagaacctgagaaacagattcaagcacgagaagatctacacctacgtgggcagcatcctgatcgtgatcaaccccttcaagttcctgcccatctacaaccccaagtacgtgaagatgtacgacaaccaccagctgggcaagctggagccccacatctacgccgtggccgacgtggcctaccacgccatgctgcagagaaagaagaaccagtgcatcgtgatcagcggcgagagcggcagcggcaagacccagagcaccaacttcctgatccaccacctgaccgccctgagccagaagggcttcgccagcggcgtggagcagatcatcctgggcgccggccccgtgctggaggccttcggcaacgccaagaccgcccacaacaacaacagcagcagattcggcaagttcatccaggtgaactaccaggagaccggcaccgtgctgggcgcctacgtggagaagtacctgctggagaagagcagactggtgtaccaggagcacaacgagagaaactaccacgtgttctactacctgctggccggcgccagcgaggacgagagaagcgccttccacctgaagcagcccgaggagtaccactacctgaaccaggactgcttcaccgtggagggcgaggacctgagacacgacttcgagagactgcagctggccatggagatggtgggcttcctgcccaagaccagaagacagatcttcagcctgctgagcgccatcctgcacctgggcaacatctgctacaagaagaagacctacagagacgacagcatcgacatctgcaaccccgaggtgctgcccatcgtgagcgagctgctggaggtgaaggaggagatgctgttcgaggccctggtgaccagaaagaccgtgaccgtgggcgagaagctgatcctgccctacaagctggccgaggccgtgaccgtgagaaacagcatggccaagagcctgtacagcgccctgttcgactggatcgtgttcagaatcaaccacgccctgctgaacagcaaggacctggagcacaacaccaagaccctgagcatcggcgtgctggacatcttcggcttcgaggactacgagaacaacagcttcgagcagttctgcatcaacttcgccaacgagagactgcagcactacttcaaccagcacatcttcaagctggagcaggaggagtacagaaccgagggcatcagctggcacaacatcgactacatcgacaacacctgctgcatcaacctgatcagcaagaagcccaccggcctgctgcacctgctggacgaggagagcaacttcccccaggccaccaaccagaccctgctggacaagttcaagcaccagcacgaggacaacagctacatcgagttccccgccgtgatggagcccgccttcatcatcaagcactacgccggcaaggtgaagtacggcgtgaaggacttcagagagaagaacaccgaccacatgagacccgacatcgtggccctgctgagaagcagcaagaacgccttcatcagcggcatgatcggcatcgaccccgtggccgtgttcagatgggccatcctgagagccttcttcagagccatggtggccttcagagaggccggcaagagaaacatccacagaaagaccggccacgacgacaccgccccctgcgccatcctgaagagcatggacagcttcagcttcctgcagcaccccgtgcaccagagaagcctggagatcctgcagagatgcaaggaggagaagtacagcatcaccagaaagaaccccagaacccccctgagcgacctgcagggcatgaacgccctgaacgagaagaaccagcacgacaccttcgacatcgcctggaacggcagaaccggcatcagacagagcagactgagcagcggcaccagcctgctggacaaggacggcatcttcgccaacagcaccagcagcaagctgctggagagagcccacggcatcctgaccagaaacaagaacttcaagagcaagcccgccctgcccaagcacctgctggaggtgaacagcctgaagcacctgaccagactgaccctgcaggacagaatcaccaagagcctgctgcacctgcacaagaagaagaagccccccagcatcagcgcccagttccaggccagcctgagcaagctgatggagaccctgggccaggccgagccctacttcgtgaagtgcatcagaagcaacgccgagaagctgcccctgagattcagcgacgtgctggtgctgagacagctgagatacaccggcatgctggagaccgtgagaatcagacagagcggctacagcagcaagtacagcttccaggacttcgtgagccacttccacgtgctgctgcccagaaacatcatccccagcaagttcaacatccaggacttcttcagaaagatcaacctgaaccccgacaactaccaggtgggcaagaccatggtgttcctgaaggagcaggagagacagcacctgcaggacctgctgcaccaggaggtgctgagaagaatcatcctgctgcagagatggttcagagtgctgctgtgcagacagcacttcctgcacctgagacaggccagcgtgatcatccagagattctggagaaactacctgaaccagaagcaggtgagagacgccgccgtgcagaaggacgccttcgtgatggccagcgccgccgccctgctgcaggccagctggagagcccacctggagagacagagatacctggagctgagagccgccgccatcgtgatccagcagaagtggagagactactacagaagaagacacatggccgccatctgcatccaggccagatggaaggcctacagagagagcaagagataccaggagcagagaaagaagatcatcctgctgcagagcacctgcagaggcttcagagccagacagagattcaaggccctgaaggagcagagactgagagagaccaagcccgaggtgggcctggtgaacatcaagggctacggcagcctggagatccagggcagcgaccccagcggctgggaggactgcagcttcgacaacagaatcaaggccatcgaggagtgcaagagcgtgatcgagagcaacagaatcagcagagagagcagcgtggactgcctgaaggagagccccaacaagcagcaggagagagcccagagccagagcggcgtggacctgcaggaggacgtgctggtgagagagagacccagaagcctggaggacctgcaccagaagaaggtgggcagagccaagagagagagcagaagaatgagagagctggagcaggccatcttcagcctggagctgctgaaggtgagaagcctgggcggcatcagccccagcgaggacagaagatggagcaccgagctggtgcccgagggcctgcagagccccagaggcacccccgacagcgagagcagccagggcagcctggagctgctgagctacgaggagagccagaagagcaagctggagagcgtgatcagcgacgagggcgacctgcagttccccagccccaagatcagcagcagccccaagttcgacagcagagacaacgccctgagcgccagcaacgagaccagcagcgccgagcacctgaaggacggcaccatgaaggagatggtggtgtgcagcagcgagagcatcacctgcaagccccagctgaaggacagcttcatcagcaacagcctgcccaccttcttctacatcccccagcaggaccccctgaagaccaacagccagctggacaccagcatccagagaaacaagctgctggagaacgaggacaccgccggcgaggccctgaccctggacatcaacagagagaccagaagataccactgcagcggcaaggaccagatcgtgcccagcctgaacaccgagagcagcaaccccgtgctgaagaagctggagaagctgaacaccgagaaggaggagagacagaagcagctgcagcagcagaacgagaaggagatgatggagcagatcagacagcagaccgacatcctggagaaggagagaaaggccttcaagaccatcgagaagcccagaatcggcgagtgcctggtggcccccagcagctaccagagcaagcagagagtggagagacccagcagcctgctgagcctgaacaccagcaacaagggcgagctgaacgtgctgggcagcctgagcctgaaggacgccgccctggcccagaaggacagcagcagcgcccacctgccccccaaggacagacccgtgaccgtgttcttcgagagaaagggcagcccctgccagagcagcaccgtgaaggagctgagcaagaccgacagaatgggcacccagctgaacgtggcctgcaagctgagcaacaacagaatcagcaagagagagcacttcagacccacccagagctacagccacaacagcgacgacctgagcagagagggcaacgccagacccatcttcttcacccccaaggacaacatgagcatccccctggtgagcaaggaggccctgaacagcaagaacccccagctgcacaaggaggacgagcccgcctggaagcccgtgaagctggccggccccggccagagagagaccagccagagattcagcagcgtggacgagcaggccaagctgcacaagaccatgagccagggcgagatcaccaagctggccgtgagacagaaggccagcgacagcgacatcagaccccagagagccaagatgagattctgggccaagggcaagcagggcgagaagaagaccaccagagtgaagcccaccacccagagcgaggtgagccccctgttcgccggcaccgacgtgatccccgcccaccagttccccgacgagctggccgcctaccaccccaccccccccctgagccccgagctgcccggcagctgcagaaaggagttcaaggagaacaaggagcccagccccaaggccaagagaaagagaagcgtgaagatcagcaacgtggccctggacagcatgcactggcagaacgacagcgtgcagatcatcgccagcgtgagcgacctgaagagcatggacgagttcctgctgaagaaggtgaacgacctggacaacgaggacagcaagaaggacaccctggtggacgtggtgttcaagaaggccctgaaggagttcagacagaacatcttcagcttctacagcagcgccctggccatggacgacggcaagagcatcagatacaaggacctgtacgccctgttcgagcagatcctggagaagaccatgagactggagcagagagacagcctgggcgagagccccgtgagagtgtgggtgaacaccttcaaggtgttcctggacgagtacatgaacgagttcaagaccagcgactgcaccgccaccaaggtgcccaagaccgagagaaagaagagaagaaagaaggagaccgacctggtggaggagcacaacggccacatcttcaaggccacccagtacagcatccccacctactgcgagtactgcagcagcctgatctggatcatggacagagccagcgtgtgcaagctgtgcaagtacgcctgccacaagaagtgctgcctgaagaccaccgccaagtgcagcaagaagtacgaccccgagctgagcagcagacagttcggcgtggagctgagcagactgaccagcgaggacagaaccgtgcccctggtggtggagaagctgatcaactacatcgagatgcacggcctgtacaccgagggcatctacagaaagagcggcagcaccaacaagatcaaggagctgagacagggcctggacaccgacgccgagagcgtgaacctggacgactacaacatccacgtgatcgccagcgtgttcaagcagtggctgagagacctgcccaaccccctgatgaccttcgagctgtacgaggagttcctgagagccatgggcctgcaggagagaaaggagaccatcagaggcgtgtacagcgtgatcgaccagctgagcagaacccacctgaacaccctggagagactgatcttccacctggtgagaatcgccctgcaggaggacaccaacagaatgagcgccaacgccctggccatcgtgttcgccccctgcatcctgagatgccccgacaccaccgaccccctgcagagcgtgcaggacatcagcaagaccaccacctgcgtggagctgatcgtggtggagcagatgaacaagtacaaggccagactgaaggacatcagcagcctggagttcgccgagaacaaggccaagaccagactgagcctgatcagaagaagcatgggcaagggcagaatcagaagaggcaactaccccggccccagcagccccgtggtggtgagactgcccagcgtgagcgacgtgagcgaggagaccctgaccagcgaggccgccatggagaccgacatcaccgagcagcagcaggccgccatgcagcaggaggagagagtgctgaccgagcagatcgagaacctgcagaaggagaaggaggagctgaccttcgagatgctggtgctggagcccagagccagcgacgacgagaccctggagagcgaggccagcatcggcaccgccgacagcagcgagaacctgaacatggagagcgagtacgccatcagcgagaagagcgagagaagcctggccctgagcagcctgaagaccgccggcaagagcgagcccagcagcaagctgagaaagcagctgaagaagcagcaggacagcctggacgtggtggacagcagcgtgagcagcctgtgcctgagcaacaccgccagcagccacggcaccagaaagctgttccagatctacagcaagagccccttctacagagccgccagcggcaacgaggccctgggcatggagggccccctgggccagaccaagttcctggaggacaagccccagttcatcagcagaggcaccttcaaccccgagaagggcaagcagaagctgaagaacgtgaagaacagcccccagaagaccaaggagacccccgagggcaccgtgatgagcggcagaagaaagaccgtggaccccgactgcaccagcaaccagcagctggccctgttcggcaacaacgagttcatggtgtag

SEQ ID NO: 90013 - DNA, 2190 bp, Artificial Sequence
  Description of Artificial Sequence: Synthetic coding sequence
atgaacatcaacgacggcggcagaagaagattcgaggacaacgagcacaccctgagaatctaccccggcgccatcagcgagggcaccatctactgccccatccccgccagaaagaacagcaccgccgccgaggtgatcgagagcctgatcaacaagctgcacctggacaagaccaagtgctacgtgctggccgaggtgaaggagttcggcggcgaggagtggatcctgaaccccaccgactgccccgtgcagagaatgatgctgtggcccagaatggccctggagaacagactgagcggcgaggactacagattcctgctgagagagaagaacctggacggcagcatccactacggcagcctgcagagctggctgagagtgaccgaggagagaagaagaatgatggagagaggcttcctgccccagccccagcagaaggacttcgacgacctgtgcagcctgcccgacctgaacgagaagaccctgctggagaacctgagaaacagattcaagcacgagaagatctacacctacgtgggcagcatcctgatcgtgatcaaccccttcaagttcctgcccatctacaaccccaagtacgtgaagatgtacgacaaccaccagctgggcaagctggagccccacatctacgccgtggccgacgtggcctaccacgccatgctgcagagaaagaagaaccagtgcatcgtgatcagcggcgagagcggcagcggcaagacccagagcaccaacttcctgatccaccacctgaccgccctgagccagaagggcttcgccagcggcgtggagcagatcatcctgggcgccggccccgtgctggaggccttcggcaacgccaagaccgcccacaacaacaacagcagcagattcggcaagttcatccaggtgaactaccaggagaccggcaccgtgctgggcgcctacgtggagaagtacctgctggagaagagcagactggtgtaccaggagcacaacgagagaaactaccacgtgttctactacctgctggccggcgccagcgaggacgagagaagcgccttccacctgaagcagcccgaggagtaccactacctgaaccagatcaccaagaagcccctgagacagagctgggacgactactgctacgacagcgagcccgactgcttcaccgtggagggcgaggacctgagacacgacttcgagagactgcagctggccatggagatggtgggcttcctgcccaagaccagaagacagatcttcagcctgctgagcgccatcctgcacctgggcaacatctgctacaagaagaagacctacagagacgacagcatcgacatctgcaaccccgaggtgctgcccatcgtgagcgagctgctggaggtgaaggaggagatgctgttcgaggccctggtgaccagaaagaccgtgaccgtgggcgagaagctgatcctgccctacaagctggccgaggccgtgaccgtgagaaacagcatggccaagagcctgtacagcgccctgttcgactggatcgtgttcagaatcaaccacgccctgctgaacagcaaggacctggagcacaacaccaagaccctgagcatcggcgtgctggacatcttcggcttcgaggactacgagaacaacagcttcgagcagttctgcatcaacttcgccaacgagagactgcagcactacttcaaccagcacatcttcaagctggagcaggaggagtacagaaccgagggcatcagctggcacaacatcgactacatcgacaacacctgctgcatcaacctgatcagcaagaagcccaccggcctgctgcacctgctggacgaggagagcaacttcccccaggccaccaaccagaccctgctggacaagttcaagcaccagcacgaggacaacagctacatcgagttccccgccgtgatggagcccgccttcatcatcaagcactacgccggcaaggtgaagtacggcgtgaaggacttcagagagaagaacaccgaccacatgagacccgacatcgtggccctgctgagaagcagcaagaacgccttcatcagcggcatgatcggcatcgaccccgtggccgtgttcagatgggccatcctgagagccttcttcagagccatggtggccttcagagaggccggcaagagaaacatccacagaaagaccggcaagtag

SEQ ID NO: 90014 - DNA, 1509 bp, Artificial Sequence
  Description of Artificial Sequence: Synthetic coding sequence
atggacaaggccctgctgtgcagcgtgtgcaagatgacctgccacaagaagtgcgtgcacaagatccagagccactgcagctacacctacggcagaaagggcgagcccggcgtggagcccggccacttcggcgtgtgcgtggacagcctgaccagcgacaaggccagcgtgcccatcgtgctggagaagctgctggagcacgtggagatgcacggcctgtacaccgagggcctgtacagaaagagcggcgccgccaacagaaccagagagctgagacaggccctgcagaccgaccccgccgccgtgaagctggagaacttccccatccacgccatcaccggcgtgctgaagcagtggctgagagagctgcccgagcccctgatgaccttcgcccagtacggcgacttcctgagagccgtggagctgcccgagaagcaggagcagctggccgccatctacgccgtgctggagcacctgcccgaggccaaccacaacagcctggagagactgatcttccacctgctggccgtggccctgctggaggacgtgaacagaatgagccccggcgccctggccatcatcttcgccccctgcctgctgagatgccccgacaacagcgaccccctgaccagcatgaaggacgtgctgaagatcaccacctgcgtggagatgctgatcaaggagcagatgagaaagtacaaggtgaagatggaggagatcagccagctggaggccgccgagagcatcgccttcagaagactgagcctgctgagacagaacgccccctggcccctgaagctgggcttcagcagcccctacgagggcgtgctgaacaagagccccaagaccagagacatccaggaggaggagctggaggtgctgctggaggaggaggccgccggcggcgacgaggacagagagaaggagatcctgatcgagagaatccagagcatcaaggaggagaagcaggacatcacctacagactgcccgagctggaccccagaggcagcgacgaggagaacctggacagcgagaccagcgccagcaccgagagcctgctggaggagagagccggcagaggcgccagcgagggcccccccgcccccgccctgccctgccccggcgcccccacccccagccccctgcccaccgtggccgccccccccagaagaagacccagcagcttcgtgaccgtgagagtgaagacccccagaagaacccccatcatgcccaccgccaacatcaagctgccccccggcctgcccagccacctgcccagatgggcccccggcgccagagaggccgccgcccccgtgagaagaagagagccccccgccagaagacccgaccagatccacagcgtgtacatcacccccggcgccgacctgcccgtgcagggcgccctggagcccctggaggaggacggccagccccccggcgccaagagaagatacagcgacccccccacctactgcctgccccccgccagcggccagaccaacggctag

SEQ ID NO: 90015 - DNA, 6069 bp, Artificial Sequence
  Description of Artificial Sequence: Synthetic coding sequence
atgagcgtgaaggaggccggcagcagcggcagaagagagcaggccgcctaccacctgcacatctacccccagctgagcaccaccgagagccaggccagctgcagagtgaccgccaccaaggacagcaccaccagcgacgtgatcaaggacgccatcgccagcctgagactggacggcaccaagtgctacgtgctggtggaggtgaaggagagcggcggcgaggagtgggtgctggacgccaacgacagccccgtgcacagagtgctgctgtggcccagaagagcccaggacgagcacccccaggaggacggctactacttcctgctgcaggagagaaacgccgacggcaccatcaagtacgtgcacatgcagctggtggcccaggccaccgccaccagaagactggtggagagaggcctgctgcccagacagcaggccgacttcgacgacctgtgcaacctgcccgagctgaccgagggcaacctgctgaagaacctgaagcacagattcctgcagcagaagatctacacctacgccggcagcatcctggtggccatcaaccccttcaagttcctgcccatctacaaccccaagtacgtgaagatgtacgagaaccagcagctgggcaagctggagccccacgtgttcgccctggccgacgtggcctactacaccatgctgagaaagagagtgaaccagtgcatcgtgatcagcggcgagagcggcagcggcaagacccagagcaccaacttcctgatccactgcctgaccgccctgagccagaagggctacgccagcggcgtggagagaaccatcctgggcgccggccccgtgctggaggccttcggcaacgccaagaccgcccacaacaacaacagcagcagattcggcaagttcatccaggtgagctacctggagagcggcatcgtgagaggcgccgtggtggagaagtacctgctggagaagagcagactggtgagccaggagaaggacgagagaaactaccacgtgttctactacctgctgctgggcgtgagcgaggaggagagacaggagttccagctgaagcagcccgaggactacttctacctgaaccagcacaacctgaagatcgaggacggcgaggacctgaagcacgacttcgagagactgaagcaggccatggagatggtgggcttcctgcccgccaccaagaagcagatcttcgccgtgctgagcgccatcctgtacctgggcaacgtgacctacaagaagagagccaccggcagagaggagggcctggaggtgggcccccccgaggtgctggacaccctgagccagctgctgaaggtgaagagagagatcctggtggaggtgctgaccaagagaaagaccgtgaccgtgaacgacaagctgatcctgccctacagcctgagcgaggccatcaccgccagagacagcatggccaagagcctgtacagcgccctgttcgactggatcgtgctgagaatcaaccacgccctgctgaacaagaaggacgtggaggaggccgtgagctgcctgagcatcggcgtgctggacatcttcggcttcgaggacttcgagagaaacagcttcgagcagttctgcatcaactacgccaacgagcagctgcagtactacttcaaccagcacatcttcaagctggagcaggaggagtaccagggcgagggcatcacctggcacaacatcggctacaccgacaacgtgggctgcatccacctgatcagcaagaagcccaccggcctgttctacctgctggacgaggagagcaacttcccccacgccaccagccagaccctgctggccaagttcaagcagcagcacgaggacaacaagtacttcctgggcacccccgtgatggagcccgccttcatcatccagcacttcgccggcaaggtgaagtaccagatcaaggacttcagagagaagaacatggactacatgagacccgacatcgtggccctgctgagaggcagcgacagcagctacgtgagagagctgatcggcatggaccccgtggccgtgttcagatgggccgtgctgagagccgccatcagagccatggccgtgctgagagaggccggcagactgagagccgagagagccgagaaggccgccggcatgagcagccccggcgcccagagccaccccgaggagctgcccagaggcgccagcacccccagcgagaagctgtacagagacctgcacaaccagatgatcaagagcatcaagggcctgccctggcagggcgaggaccccagaagcctgctgcagagcctgagcagactgcagaagcccagagccttcatcctgaagagcaagggcatcaagcagaagcagatcatccccaagaacctgctggacagcaagagcctgaagctgatcatcagcatgaccctgcacgacagaaccaccaagagcctgctgcacctgcacaagaagaagaagccccccagcatcagcgcccagttccagaccagcctgaacaagctgctggaggccctgggcaaggccgagcccttcttcatcagatgcatcagaagcaacgccgagaagaaggagctgtgcttcgacgacgagctggtgctgcagcagctgagatacaccggcatgctggagaccgtgagaatcagaagaagcggctacagcgccaagtacaccttccaggacttcaccgagcagttccaggtgctgctgcccaaggacgcccagccctgcagagaggtgatcagcaccctgctggagaagatgaagatcgacaagagaaactaccagatcggcaagaccaaggtgttcctgaaggagaccgagagacaggccctgcaggagaccctgcacagagaggtggtgagaaagatcctgctgctgcagagctggttcagaatggtgctggagagaagacacttcctgcagatgaagagagccgccgtgaccatccaggcctgctggagaagctacagagtgagaagagccctggagagaacccaggccgccgtgtacctgcaggccagctggagaggctactggcagagaaagctgtacagacaccagaagcagagcatcatcagactgcagagcctgtgcagaggccacctgcagagaaagagcttcagccagatgatcagcgagaagcagaaggccgaggagaaggagagagaggccctggaggccgccagagccggcgccgaggagggcggccagggccaggccgccggcggccagcaggtggccgagcagggccccgagcccgccgaggacggcggccacctggccagcgagcccgaggtgcagcccagcgacagaagccccctggagcacagcagccccgagaaggaggcccccagccccgagaagaccctgcccccccagaagaccgtggccgccgagagccacgagaaggtgcccagcagcagagagaagagagagagcagaagacagagaggcctggagcacgtgaagttccagaacaagcacatccagagctgcaaggaggagagcgccctgagagagcccagcagaagagtgacccaggagcagggcgtgagcctgctggaggacaagaaggagagcagagaggacgagaccctgctggtggtggagaccgaggccgagaacaccagccagaagcagcccaccgagcagccccaggccatggccgtgggcaaggtgagcgaggagaccgagaagaccctgcccagcggcagccccagacccggccagctggagagacccaccagcctggccctggacagcagagtgagcccccccgcccccggcagcgcccccgagacccccgaggacaagagcaagccctgcggcagccccagagtgcaggagaagcccgacagccccggcggcagcacccagatccagagatacctggacgccgagagactggccagcgccgtggagctgtggagaggcaagaagctggtggccgccgccagccccagcgccatgctgagccagagcctggacctgagcgacagacacagagccaccggcgccgccctgacccccaccgaggagagaagaaccagcttcagcaccagcgacgtgagcaagctgctgcccagcctggccaaggcccagcccgccgccgagaccaccgacggcgagagaagcgccaagaagcccgccgtgcagaagaagaagcccggcgacgccagcagcctgcccgacgccggcctgagccccggcagccaggtggacagcaagagcaccttcaagagactgttcctgcacaagaccaaggacaagaagtacagcctggagggcgccgaggagctggagaacgccgtgagcggccacgtggtgctggaggccaccaccatgaagaagggcctggaggcccccagcggccagcagcacagacacgccgccggcgagaagagaaccaaggagcccggcggcaagggcaagaagaacagaaacgtgaagatcggcaagatcaccgtgagcgagaagtggagagagagcgtgttcagacagatcaccaacgccaacgagctgaagtacctggacgagttcctgctgaacaagatcaacgacctgagaagccagaagacccccatcgagagcctgttcatcgaggccaccgagaagttcagaagcaacatcaagaccatgtacagcgtgcccaacggcaagatccacgtgggctacaaggacctgatggagaactaccagatcgtggtgagcaacctggccaccgagagaggccagaaggacaccaacctggtgctgaacctgttccagagcctgctggacgagttcaccagaggctacaccaagaacgacttcgagcccgtgaagcagagcaaggcccagaagaagaagagaaagcaggagagagccgtgcaggagcacaacggccacgtgttcgccagctaccaggtgagcatcccccagagctgcgagcagtgcctgagctacatctggctgatggacaaggccctgctgtgcagcgtgtgcaagatgacctgccacaagaagtgcgtgcacaagatccagagccactgcagctacacctacggcagaaagggcgagcccggcgtggagcccggccacttcggcgtgtgcgtggacagcctgaccagcgacaaggccagcgtgcccatcgtgctggagaagctgctggagcacgtggagatgcacggcctgtacaccgagggcctgtacagaaagagcggcgccgccaacagaaccagagagctgagacaggccctgcagaccgaccccgccgccgtgaagctggagaacttccccatccacgccatcaccggcgtgctgaagcagtggctgagagagctgcccgagcccctgatgaccttcgcccagtacggcgacttcctgagagccgtggagctgcccgagaagcaggagcagctggccgccatctacgccgtgctggagcacctgcccgaggccaaccacaacagcctggagagactgatcttccacctggtgaaggtggccctgctggaggacgtgaacagaatgagccccggcgccctggccatcatcttcgccccctgcctgctgagatgccccgacaacagcgaccccctgaccagcatgaaggacgtgctgaagatcaccacctgcgtggagatgctgatcaaggagcagatgagaaagtacaaggtgaagatggaggagatcagccagctggaggccgccgagagcatcgccttcagaagactgagcctgctgagacagaacgccccctggcccctgaagctgggcttcagcagcccctacgagggcgtgctgaacaagagccccaagaccagagacatccaggaggaggagctggaggtgctgctggaggaggaggccgccggcggcgacgaggacagagagaaggagatcctgatcgagagaatccagagcatcaaggaggagaaggaggacatcacctacagactgcccgagctggaccccagaggcagcgacgaggagaacctggacagcgagaccagcgccagcaccgagagcctgctggaggagagagccggcagaggcgccagcgagggccagtactag

SEQ ID NO: 90016 - DNA, 6069 bp, Artificial Sequence; identical to SEQ ID NO: 90015
  Description of Artificial Sequence: Synthetic coding sequence

SEQ ID NO: 90017 - DNA, 519 bp, Artificial Sequence
  Description of Artificial Sequence: Synthetic coding sequence
atgagcagcaagaaggccaagaccaagaccaccaagaagagaccccagagagccaccagcaacgtgttcgccatgttcgaccagagccagatccaggagttcaaggaggccttcaacatgatcgaccagaacagagacggcttcatcgacaaggaggacctgcacgacatgctggccagcctgggcaagaaccccaccgacgcctacctggacgccatgatgaacgaggcccccggccccatcaacttcaccatgttcctgaccatgttcggcgagaagctgaacggcaccgaccccgaggacgtgatcagaaacgccttcgcctgcttcgacgaggaggccaccggcaccatccaggaggactacctgagagagctgctgaccaccatgggcgacagattcaccgacgaggaggtggacgagctgtacagagaggcccccatcgacaagaagggcaacttcaactacatcgagttcaccagaatcctgaagcacggcgccaaggacaaggacgactag

SEQ ID NO: 90018 - DNA, 1791 bp, Artificial Sequence
  Description of Artificial Sequence: Synthetic coding sequence
atggccaccgagaacggcgccgtggagctgggcatccagaaccccagcaccgacaaggcccccaagggccccaccggcgagagacccctggccgccggcaaggaccccggcccccccgaccccaagaaggcccccgacccccccaccctgaagaaggacgccaaggcccccgccagcgagaagggcgacggcaccctggcccagcccagcaccagcagccagggccccaagggcgagggcgacagaggcggcggccccgccgagggcagcgccggcccccccgccgccctgccccagcagaccgccacccccgagaccagcgtgaagaagcccaaggccgagcagggcgccagcggcagccaggaccccggcaagcccagagtgggcaagaaggccgccgagggccaggccgccgccagaagaggcagccccgccttcctgcacagccccagctgccccgccatcatcagcagcagcgagaagctgctggccaagaagccccccagcgaggccagcgagctgaccttcgagggcgtgcccatgacccacagccccaccgaccccagacccgccaaggccgaggagggcaagaacatcctggccgagagccagaaggaggtgggcgagaagacccccggccaggccggccaggccaagatgcagggcgacaccagcagaggcatcgagttccaggccgtgcccagcgagaagagcgaggtgggccaggccctgtgcctgaccgccagagaggaggactgcttccagatcctggacgactgcccccccccccccgcccccttcccccacagaatggtggagctgagaaccggcaacgtgagcagcgagttcagcatgaacagcaaggaggccctgggcggcggcaagttcggcgccgtgtgcacctgcatggagaaggccaccggcctgaagctggccgccaaggtgatcaagaagcagacccccaaggacaaggagatggtgctgctggagatcgaggtgatgaaccagctgaaccacagaaacctgatccagctgtacgccgccatcgagaccccccacgagatcgtgctgttcatggagtacatcgagggcggcgagctgttcgagagaatcgtggacgaggactaccacctgaccgaggtggacaccatggtgttcgtgagacagatctgcgacggcatcctgttcatgcacaagatgagagtgctgcacctggacctgaagcccgagaacatcctgtgcgtgaacaccaccggccacctggtgaagatcatcgacttcggcctggccagaagatacaaccccaacgagaagctgaaggtgaacttcggcacccccgagttcctgagccccgaggtggtgaactacgaccagatcagcgacaagaccgacatgtggagcatgggcgtgatcacctacatgctgctgagcggcctgagccccttcctgggcgacgacgacaccgagaccctgaacaacgtgctgagcggcaactggtacttcgacgaggagaccttcgaggccgtgagcgacgaggccaaggacttcgtgagcaacctgatcgtgaaggaccagagagccagaatgaacgccgcccagtgcctggcccacccctggctgaacaacctggccgagaaggccaagagatgcaacagaagactgaagagccagatcctgctgaagaagtacctgatgaagagaagatggaagaagaacttcatcgccgtgagcgccgccaacagattcaagaagatcagcagcagcggcgccctgatggccctgggcgtgtag

SEQ ID NO: 90019 - DNA, 1791 bp, Artificial Sequence; identical to SEQ ID NO: 90018
  Description of Artificial Sequence: Synthetic coding sequence

SEQ ID NO: 90020 - DNA, 2460 bp, Artificial Sequence
  Description of Artificial Sequence: Synthetic coding sequence
atgagcggcaccagcaaggagagcctgggccacggcggcctgcccggcctgggcaagacctgcctgaccaccatggacaccaagctgaacatgctgaacgagaaggtggaccagctgctgcacttccaggaggacgtgaccgagaagctgcagagcatgtgcagagacatgggccacctggagagaggcctgcacagactggaggccagcagagcccccggccccggcggcgccgacggcgtgccccacatcgacacccaggccggctggcccgaggtgctggagctggtgagagccatgcagcaggacgccgcccagcacggcgccagactggaggccctgttcagaatggtggccgccgtggacagagccatcgccctggtgggcgccaccttccagaagagcaaggtggccgacttcctgatgcagggcagagtgccctggagaagaggcagccccggcgacagccccgaggagaacaaggagagagtggaggaggagggcggcaagcccaagcacgtgctgagcaccagcggcgtgcagagcgacgccagagagcccggcgaggagagccagaaggccgacgtgctggagggcaccgccgagagactgccccccatcagagccagcggcctgggcgccgaccccgcccaggccgtggtgagccccggccagggcgacggcgtgcccggccccgcccaggccttccccggccacctgcccctgcccaccaaggtggaggccaaggcccccgagacccccagcgagaacctgagaaccggcctggagctggcccccgcccccggcagagtgaacgtggtgagccccagcctggaggtggcccccggcgccggccagggcgccagcagcagcagacccgaccccgagcccctggaggagggcaccagactgacccccggccccggcccccagtgccccggcccccccggcctgcccgcccaggccagagccacccacagcggcggcgagaccccccccagaatcagcatccacatccaggagatggacacccccggcgagatgctgatgaccggcagaggcagcctgggccccaccctgaccaccgaggcccccgccgccgcccagcccggcaagcagggcccccccggcaccggcagatgcctgcaggcccccggcaccgagcccggcgagcagacccccgagggcgccagagagctgagccccctgcaggagagcagcagccccggcggcgtgaaggccgaggaggagcagagagccggcgccgagcccggcaccagacccagcctggccagaagcgacgacaacgaccacgaggtgggcgccctgggcctgcagcagggcaagagccccggcgccggcaaccccgagcccgagcaggactgcgccgccagagcccccgtgagagccgaggccgtgagaagaatgccccccggcgccgaggccggcagcgtggtgctggacgacagccccgccccccccgcccccttcgagcacagagtggtgagcgtgaaggagaccagcatcagcgccggctacgaggtgtgccagcacgaggtgctgggcggcggcagattcggccaggtgcacagatgcaccgagaagagcaccggcctgcccctggccgccaagatcatcaaggtgaagagcgccaaggacagagaggacgtgaagaacgagatcaacatcatgaaccagctgagccacgtgaacctgatccagctgtacgacgccttcgagagcaagcacagctgcaccctggtgatggagtacgtggacggcggcgagctgttcgacagaatcaccgacgagaagtaccacctgaccgagctggacgtggtgctgttcaccagacagatctgcgagggcgtgcactacctgcaccagcactacatcctgcacctggacctgaagcccgagaacatcctgtgcgtgaaccagaccggccaccagatcaagatcatcgacttcggcctggccagaagatacaagcccagagagaagctgaaggtgaacttcggcacccccgagttcctggcccccgaggtggtgaactacgagttcgtgagcttccccaccgacatgtggagcgtgggcgtgatcacctacatgctgctgagcggcctgagccccttcctgggcgagaccgacgccgagaccatgaacttcatcgtgaactgcagctgggacttcgacgccgacaccttcgagggcctgagcgaggaggccaaggacttcgtgagcagactgctggtgaaggagaagagctgcagaatgagcgccacccagtgcctgaagcacgagtggctgaacaacctgcccgccaaggccagcagaagcaagaccagactgaagagccagctgctgctgcagaagtacatcgcccagagaaagtggaagaagcacttctacgtggtgaccgccgccaacagactgagaaagttccccaccagcccctag

SEQ ID NO: 90021 - DNA, 1437 bp, Artificial Sequence
  Description of Artificial Sequence: Synthetic coding sequence
atggacacccccggcgagatgctgatgaccggcagaggcagcctgggccccaccctgaccaccgaggcccccgccgccgcccagcccggcaagcagggcccccccggcaccggcagatgcctgcaggcccccggcaccgagcccggcgagcagacccccgagggcgccagagagctgagccccctgcaggagagcagcagccccggcggcgtgaaggccgaggaggagcagagagccggcgccgagcccggcaccagacccagcctggccagaagcgacgacaacgaccacgaggtgggcgccctgggcctgcagcagggcaagagccccggcgccggcaaccccgagcccgagcaggactgcgccgccagagcccccgtgagagccgaggccgtgagaagaatgccccccggcgccgaggccggcagcgtggtgctggacgacagccccgccccccccgcccccttcgagcacagagtggtgagcgtgaaggagaccagcatcagcgccggctacgaggtgtgccagcacgaggtgctgggcggcggcagattcggccaggtgcacagatgcaccgagaagagcaccggcctgcccctggccgccaagatcatcaaggtgaagagcgccaaggacagagaggacgtgaagaacgagatcaacatcatgaaccagctgagccacgtgaacctgatccagctgtacgacgccttcgagagcaagcacagctgcaccctggtgatggagtacgtggacggcggcgagctgttcgacagaatcaccgacgagaagtaccacctgaccgagctggacgtggtgctgttcaccagacagatctgcgagggcgtgcactacctgcaccagcactacatcctgcacctggacctgaagcccgagaacatcctgtgcgtgaaccagaccggccaccagatcaagatcatcgacttcggcctggccagaagatacaagcccagagagaagctgaaggtgaacttcggcacccccgagttcctggcccccgaggtggtgaactacgagttcgtgagcttccccaccgacatgtggagcgtgggcgtgatcacctacatgctgctgagcggcctgagccccttcctgggcgagaccgacgccgagaccatgaacttcatcgtgaactgcagctgggacttcgacgccgacaccttcgagggcctgagcgaggaggccaaggacttcgtgagcagactgctggtgaaggagaagagctgcagaatgagcgccacccagtgcctgaagcacgagtggctgaacaacctgcccgccaaggccagcagaagcaagaccagactgaagagccagctgctgctgcagaagtacatcgcccagagaaagtggaagaagcacttctacgtggtgaccgccgccaacagactgagaaagttccccaccagcccctag

SEQ ID NO: 90022 - DNA, 4212 bp, Artificial Sequence
  Description of Artificial Sequence: Synthetic coding sequence
tgactgctgctggagagctgcgagaaggagaagcaggccctgctgcagaacctgaaggaggtggaggacaaggccagcgcctacgaggaccagctgcagggccaggcccagcaggtggagaccctgcagaaggagaagctgagcgccaccttcgagggcagcgagcaggtgcaccagctggaggagcagctggaggccagagaggccagcgtgagaagactggccgagcacgtgcagagcctgtgcgacgagagagacctgctgagacagagattccaggagctgaccgagagagtggccaccagcgacgaggacgtggccgagctgagagagaagctgagaagaagagaggccgacaaccagagcctggagcacagctaccagagagtgagcagccagctgcagagcatgcacaccctgctgagagagaaggaggaggagctggagagaatcaaggaggcccacgagaaggtgctggagaagaaggagcaggacctgaacgaggccctggtgaagatggtggccctgggcagcagcctggaggagaccgagatcaagctgcaggccaaggaggagatcctgagaaagttcgccagcgagagccccaaggacatggaggagcccagaagcacccccgaggagaccgagagagacggcaccctgctgcccggccagcccgtgcaggccaccagagcccccctgggcctgccccacaccagactggaggacgaggacgaggacctgggcgccccccccggcgaggagtacggcgacggcagccccagcagagaggacagcatggtgccccccaagagcgtggaggtgctggacagagagggccaccagcagggcaccgccaagctggaccagggcgcccccggcgtgaagagacagagaatcagattcagcaccatccagtgccagagatacatccaccccgagggcagcgagaagacctggaccagcagcaccagcagcgacaccagccaggacagaagccccagcgaggagagcatgagcagcgagcccgcccccagcgtgctgcccgccaccggcgacagcgacacctacctgagcatcatccacagcctggagaccaagctgtacgtgaccgaggagaagctgaaggacgtgaccgtgagactggagagccagcagggccagagcagagaggccctgctggccctgcaccaccagtgggccggcaccgaggcccagctgagagagcagctgagagccagcctgctgcaggtgggcgccctggccagccagctggagcaggagagacaggagagagccagaagagtggagggccacgtgggcgagctgggcgacttccaggtgaagaacagccaggccctgatgtgcctggagaactgcagagagcagctgagaagcctgcccagagccagccaggaggacgagcaggacgccagagccgccagcctggccagcgtggagagcgccctggtgagcgccatccaggccctgcagcactggcccgcccccgcccacggcggcgccagagcccagctggagaccggcggcaccgaggagaacggcaagcccgccagcctgcagcagtgcagccagagcgagctgaccgagcaggagcaggtgagactgctgagcgaccagatcgccctggaggccagcctgatcagccagatcgccgacagcctgaagaacaccaccagcgacgtgagcagaatgctgcacgagatcagctggagcggccagccccccatggagagcgccggcgcccccgtggacacctgggccagaaaggtgctggtggacggcgagttctggagccaggtggagagcctgagaaagcacctgggcaccctgggcggcgaggccgtgggcgccagcggcgacggccagcagagcatcccccagggcctggcccccatcctggccaacgccacctgggtgagagccgagctgagcttcgccacccagagcgtgagagagagcttccacagaagactgcagagcatccaggagaccctgagaggcacccagaccgccctgagacagcacaagtgcctgctgagagagatcctgggcgcctaccagacccccgacttcgagagagtgatgcagcaggtgctggaggccctgagactgcccgccggccacgaggacggcgtgcagctgagctgggacctgagccccctgggcgaggtgctgggcagagacagcgacagcagccaggagcccttcgacgtgagcgaccagagccccggcgccttcgtggccatccaggaggagctggcccagcagctgaaggagaaggccagcctgctggaggagatcgccgccgccctgcccagcctgccccccgtggagagcctgagagactgccagaagctgctgcaggtgagccagagcctgagctacaacacctgcctgggcggcctgggccagtacagcagcctgctggtgcaggacgccatcatccaggcccaggtgtgctacgccagctgcagaatcagactggagtacgagaaggagctgcagctgtgcaaggagagctggcagaccagagagcccagctgcagcgagcaggcccaggccgccagagccctgagagaggagtacgaggagctgctgagaaagcagaagagcgagtacctggacgtgatcgccatcgtggagagagagaacgccgagctgaaggccaaggccgcccagctggaccaccagcagcagtgcctggaggacgccgagagcaagcacagcatgagcatgttcaccctgagaggcagatacgaggaggagatcagatgcgtggtggagcagctgaccagaaccgagagcaccctgcaggccgagagaagcagagtgctgagccagctggacgccagcgtgagagacagacaggacatggagagacaccacggcgagcagatccagaccctggaggacagattccagctgaaggtgagagagctgcagaccatccacgaggaggagctgagaaccctgcaggagcactacagccagagcctgagatgcctgcaggacaccctgtgcctgcaccagggcccccaccccaaggccctgcccgcccccgcccccaactggcaggccacccagggcgaggccgacagcatgaccggcctgagagagagaatccaggagctggaggcccagatggacgtgatgagagaggagctgggccacaaggacctggagggcgacgccgccaccctgagagagaagtaccagagagacctggagagcctgaaggccacctgcgagagaggcttcgccgccatggaggagacccaccagaagaagatcgaggacctgcagagacagcaccagagagagctggagaagctgagagaggagaaggacagactgctggccgaggagaccgccgccaccatcagcgccatcgaggccatgaagaacgcccacagagaggagatggagagagagctggagaagagccagagaagccagatcagcagcgtgaacagcgacgtggaggccctgagaagacagtacctggaggagctgcagagcgtgcagagagagctggaggtgctgagcgagcagtacagccagaagtgcctggagaacgcccacctggcccaggccctggaggccgagagacaggccctgagacagtgccagagagagaaccaggagctgaacgcccacaaccaggagctgaacaacagactggccgccgagatcaccagactgagaaccctgctgaccggcgacggcggcggcgaggccaccggcagccccctggcccagggcaaggacgcctacgagctggaggtgctgctgagagtgaaggagagcgagatccagtacctgaagcaggagatcagcagcctgaaggacgagctgcagaccgccctgagagacaagaagtacgccagcgacaagtacaaggacatctacaccgagctgagcatcgccaaggccaaggccgactgcgacatcagcagactgaaggagcagctgaaggccgccaccgaggccctgggcgagaagagccccgacagcgccaccgtgagcggctacgacatcatgaagagcaagagcaaccccgacttcctgaagaaggacagaagctgcgtgaccagacagctgagaaacatcagaagcaagagcctgaaggagggcctgaccgtgcaggagagactgaagctgttcgagagcagagacctgaagaaggactag

SEQ ID NO: 90023 - DNA, 3078 bp, Artificial Sequence
  Description of Artificial Sequence: Synthetic coding sequence
atgagcgccgccaaggagaacccctgcagaaagttccaggccaacatcttcaacaagagcaagtgccagaactgcttcaagcccagagagagccacctgctgaacgacgaggacctgacccaggccaagcccatctacggcggctggctgctgctggcccccgacggcaccgacttcgacaaccccgtgcacagaagcagaaagtggcagagaagattcttcatcctgtacgagcacggcctgctgagatacgccctggacgagatgcccaccaccctgccccagggcaccatcaacatgaaccagtgcaccgacgtggtggacggcgagggcagaaccggccagaagttcagcctgtgcatcctgacccccgagaaggagcacttcatcagagccgagaccaaggagatcgtgagcggctggctggagatgctgatggtgtaccccagaaccaacaagcagaaccagaagaagaagagaaaggtggagccccccaccccccaggagcccggccccgccaaggtggccgtgaccagcagcagcagcagcagcagcagcagcagcagcatccccagcgccgagaaggtgcccaccaccaagagcaccctgtggcaggaggagatgagaaccaaggaccagcccgacggcagcagcctgagccccgcccagagccccagccagagccagccccccgccgccagcagcctgagagagcccggcctggagagcaaggaggaggagagcgccatgagcagcgacagaatggactgcggcagaaaggtgagagtggagagcggctacttcagcctggagaagaccaagcaggacctgaaggccgaggagcagcagctgcccccccccctgagcccccccagccccagcacccccaaccacagaagaagccaggtgatcgagaagttcgaggccctggacatcgagaaggccgagcacatggagaccaacgccgtgggccccagccccagcagcgacaccagacagggcagaagcgagaagagagccttccccagaaagagagacttcaccaacgaggccccccccgcccccctgcccgacgccagcgccagccccctgagcccccacagaagagccaagagcctggacagaagaagcaccgagcccagcgtgacccccgacctgctgaacttcaagaagggctggctgaccaagcagtacgaggacggccagtggaagaagcactggttcgtgctggccgaccagagcctgagatactacagagacagcgtggccgaggaggccgccgacctggacggcgagatcgacctgagcgcctgctacgacgtgaccgagtaccccgtgcagagaaactacggcttccagatccacaccaaggagggcgagttcaccctgagcgccatgaccagcggcatcagaagaaactggatccagaccatcatgaagcacgtgcaccccaccaccgcccccgacgtgaccagcagcctgcccgaggagaagaacaagagcagctgcagcttcgagacctgccccagacccaccgagaagcaggaggccgagctgggcgagcccgaccccgagcagaagagaagcagagccagagagagaagaagagagggcagaagcaagaccttcgactgggccgagttcagacccatccagcaggccctggcccaggagagagtgggcggcgtgggccccgccgacacccacgagcccctgagacccgaggccgagcccggcgagctggagagagagagagccagaagaagagaggagagaagaaagagattcggcatgctggacgccaccgacggccccggcaccgaggacgccgccctgagaatggaggtggacagaagccccggcctgcccatgagcgacctgaagacccacaacgtgcacgtggagatcgagcagagatggcaccaggtggagaccacccccctgagagaggagaagcaggtgcccatcgcccccgtgcacctgagcagcgaggacggcggcgacagactgagcacccacgagctgaccagcctgctggagaaggagctggagcagagccagaaggaggccagcgacctgctggagcagaacagactgctgcaggaccagctgagagtggccctgggcagagagcagagcgccagagagggctacgtgctgcaggccacctgcgagagaggcttcgccgccatggaggagacccaccagaagaagatcgaggacctgcagagacagcaccagagagagctggagaagctgagagaggagaaggacagactgctggccgaggagaccgccgccaccatcagcgccatcgaggccatgaagaacgcccacagagaggagatggagagagagctggagaagagccagagaagccagatcagcagcgtgaacagcgacgtggaggccctgagaagacagtacctggaggagctgcagagcgtgcagagagagctggaggtgctgagcgagcagtacagccagaagtgcctggagaacgcccacctggcccaggccctggaggccgagagacaggccctgagacagtgccagagagagaaccaggagctgaacgcccacaaccaggagctgaacaacagactggccgccgagatcaccagactgagaaccctgctgaccggcgacggcggcggcgaggccaccggcagccccctggcccagggcaaggacgcctacgagctggaggtgctgctgagagtgaaggagagcgagatccagtacctgaagcaggagatcagcagcctgaaggacgagctgcagaccgccctgagagacaagaagtacgccagcgacaagtacaaggacatctacaccgagctgagcatcgccaaggccaaggccgactgcgacatcagcagactgaaggagcagctgaaggccgccaccgaggccctgggcgagaagagccccgacagcgccaccgtgagcggctacgacatcatgaagagcaagagcaaccccgacttcctgaagaaggacagaagctgcgtgaccagacagctgagaaacatcagaagcaagagcgtgatcgagcaggtgagctgggacacctag

SEQ ID NO: 90024 - DNA, 3078 bp, Artificial Sequence; identical to SEQ ID NO: 90023
  Description of Artificial Sequence: Synthetic coding sequence

SEQ ID NO: 90025 - DNA, 192 bp, Artificial Sequence
  Description of Artificial Sequence: Synthetic coding sequence
atgagcgccgccaaggagaacccctgcagaaagttccaggccaacatcttcaacaagagcaagtgccagaactgcttcaagcccagagagagccacctgctgaacgacgaggacctgacccagcagaacacccaccccctggagatgaagagaggcgcccacatctacgacgccagaatgttcagctgctag

SEQ ID NO: 90026 - DNA, 282 bp, Artificial Sequence
  Description of Artificial Sequence: Synthetic coding sequence
atgagcgccgccaaggagaacccctgcagaaagttccaggccaacatcttcaacaagagcaagtgccagaactgcttcaagcccagagagagccacctgctgaacgacgaggacctgacccaggccaagcccatctacggcggctggctgctgctggcccccgacggcaccgacttcgacaaccccgtgcacagaagcagaaagtggcagagaagattcttcatcctgtacgagcacggcctgctgagatacgccctggacgagatgatgagcagccagtag

SEQ ID NO: 90027 - DNA, 3117 bp, Artificial Sequence
  Description of Artificial Sequence: Synthetic coding sequence
atgagcgccgccaaggagaacccctgcagaaagttccaggccaacatcttcaacaagagcaagtgccagaactgcttcaagcccagagagagccacctgctgaacgacgaggacctgacccaggccaagcccatctacggcggctggctgctgctggcccccgacggcaccgacttcgacaaccccgtgcacagaagcagaaagtggcagagaagattcttcatcctgtacgagcacggcctgctgagatacgccctggacgagatgcccaccaccctgccccagggcaccatcaacatgaaccagtgcaccgacgtggtggacggcgagggcagaaccggccagaagttcagcctgtgcatcctgacccccgagaaggagcacttcatcagagccgagaccaaggagatcgtgagcggctggctggagatgctgatggtgtaccccagaaccaacaagcagaaccagaagaagaagagaaaggtggagccccccaccccccaggagcccggccccgccaaggtggccgtgaccagcagcagcagcagcagcagcagcagcagcagcatccccagcgccgagaaggtgcccaccaccaagagcaccctgtggcaggaggagatgagaaccaaggaccagcccgacggcagcagcctgagccccgcccagagccccagccagagccagccccccgccgccagcagcctgagagagcccggcctggagagcaaggaggaggagagcgccatgagcagcgacagaatggactgcggcagaaaggtgagagtggagagcggctacttcagcctggagaagaccaagcaggacctgaaggccgaggagcagcagctgcccccccccctgagcccccccagccccagcacccccaaccacagaagaagccaggtgatcgagaagttcgaggccctggacatcgagaaggccgagcacatggagaccaacgccgtgggccccagccccagcagcgacaccagacagggcagaagcgagaagagagccttccccagaaagagagacttcaccaacgaggccccccccgcccccctgcccgacgccagcgccagccccctgagcccccacagaagagccaagagcctggacagaagaagcaccgagcccagcgtgacccccgacctgctgaacttcaagaagggctggctgaccaagcagtacgaggacggccagtggaagaagcactggttcgtgctggccgaccagagcctgagatactacagagacagcgtggccgaggaggccgccgacctggacggcgagatcgacctgagcgcctgctacgacgtgaccgagtaccccgtgcagagaaactacggcttccagatccacaccaaggagggcgagttcaccctgagcgccatgaccagcggcatcagaagaaactggatccagaccatcatgaagcacgtgcaccccaccaccgcccccgacgtgaccagcagcctgcccgaggagaagaacaagagcagctgcagcttcgagacctgccccagacccaccgagaagcaggaggccgagctgggcgagcccgaccccgagcagaagagaagcagagccagagagagaagaagagagggcagaagcaagaccttcgactgggccgagttcagacccatccagcaggccctggcccaggagagagtgggcggcgtgggccccgccgacacccacgagcccctgagacccgaggccgagcccggcgagctggagagagagagagccagaagaagagaggagagaagaaagagattcggcatgctggacgccaccgacggccccggcaccgaggacgccgccctgagaatggaggtggacagaagccccggcctgcccatgagcgacctgaagacccacaacgtgcacgtggagatcgagcagagatggcaccaggtggagaccacccccctgagagaggagaagcaggtgcccatcgcccccgtgcacctgagcagcgaggacggcggcgacagactgagcacccacgagctgaccagcctgctggagaaggagctggagcagagccagaaggaggccagcgacctgctggagcagaacagactgctgcaggaccagctgagagtggccctgggcagagagcagagcgccagagagggctacgtgctgcaggccacctgcgagagaggcttcgccgccatggaggagacccaccagaagaagatcgaggacctgcagagacagcaccagagagagctggagaagctgagagaggagaaggacagactgctggccgaggagaccgccgccaccatcagcgccatcgaggccatgaagaacgcccacagagaggagatggagagagagctggagaagagccagagaagccagatcagcagcgtgaacagcgacgtggaggccctgagaagacagtacctggaggagctgcagagcgtgcagagagagctggaggtgctgagcgagcagtacagccagaagtgcctggagaacgcccacctggcccaggccctggaggccgagagacaggccctgagacagtgccagagagagaaccaggagctgaacgcccacaaccaggagctgaacaacagactggccgccgagatcaccagactgagaaccctgctgaccggcgacggcggcggcgaggccaccggcagccccctggcccagggcaaggacgcctacgagctggaggtgctgctgagagtgaaggagagcgagatccagtacctgaagcaggagatcagcagcctgaaggacgagctgcagaccgccctgagagacaagaagtacgccagcgacaagtacaaggacatctacaccgagctgagcatcgccaaggccaaggccgactgcgacatcagcagactgaaggagcagctgaaggccgccaccgaggccctgggcgagaagagccccgacagcgccaccgtgagcggctacgacatcatgaagagcaagagcaaccccgacttcctgaagaaggacagaagctgcgtgaccagacagctgagaaacatcagaagcaagagcctgaaggagggcctgaccgtgcaggagagactgaagctgttcgagagcagagacctgaagaaggactag

SEQ ID NO: 90028 - DNA, 3276 bp, Artificial Sequence
  Description of Artificial Sequence: Synthetic coding sequence
tgaagattcagcaccatccagtgccagagatacatccaccccgagggcagcgagaagacctggaccagcagcaccagcagcgacaccagccaggacagaagccccagcgaggagagcatgagcagcgagcccgcccccagcgtgctgcccgccaccggcgacagcgacacctacctgagcatcatccacagcctggagaccaagctgtacgtgaccgaggagaagctgaaggacgtgaccgtgagactggagagccagcagggccagagcagagaggccctgctggccctgcaccaccagtgggccggcaccgaggcccagctgagagagcagctgagagccagcctgctgcaggtgggcgccctggccagccagctggagcaggagagacaggagagagccagaagagtggagggccacgtgggcgagctgggcgacttccaggtgaagaacagccaggccctgatgtgcctggagaactgcagagagcagctgagaagcctgcccagagccagccaggaggacgagcaggacgccagagccgccagcctggccagcgtggagagcgccctggtgagcgccatccaggccctgcagcactggcccgcccccgcccacggcggcgccagagcccagctggagaccggcggcaccgaggagaacggcaagcccgccagcctgcagcagtgcagccagagcgagctgaccgagcaggagcaggtgagactgctgagcgaccagatcgccctggaggccagcctgatcagccagatcgccgacagcctgaagaacaccaccagcgacgtgagcagaatgctgcacgagatcagctggagcggccagccccccatggagagcgccggcgcccccgtggacacctgggccagaaaggtgctggtggacggcgagttctggagccaggtggagagcctgagaaagcacctgggcaccctgggcggcgaggccgtgggcgccagcggcgacggccagcagagcatcccccagggcctggcccccatcctggccaacgccacctgggtgagagccgagctgagcttcgccacccagagcgtgagagagagcttccacagaagactgcagagcatccaggagaccctgagaggcacccagaccgccctgagacagcacaagtgcctgctgagagagatcctgggcgcctaccagacccccgacttcgagagagtgatgcagcaggtgctggaggccctgagactgcccgccggccacgaggacggcgtgcagctgagctgggacctgagccccctgggcgaggtgctgggcagagacagcgacagcagccaggagcccttcgacgtgagcgaccagagccccggcgccttcgtggccatccaggaggagctggcccagcagctgaaggagaaggccagcctgctggaggagatcgccgccgccctgcccagcctgccccccgtggagagcctgagagactgccagaagctgctgcaggtgagccagagcctgagctacaacacctgcctgggcggcctgggccagtacagcagcctgctggtgcaggacgccatcatccaggcccaggtgtgctacgccagctgcagaatcagactggagtacgagaaggagctgcagctgtgcaaggagagctggcagaccagagagcccagctgcagcgagcaggcccaggccgccagagccctgagagaggagtacgaggagctgctgagaaagcagaagagcgagtacctggacgtgatcgccatcgtggagagagagaacgccgagctgaaggccaaggccgcccagctggaccaccagcagcagtgcctggaggacgccgagagcaagcacagcatgagcatgttcaccctgagaggcagatacgaggaggagatcagatgcgtggtggagcagctgaccagaaccgagagcaccctgcaggccgagagaagcagagtgctgagccagctggacgccagcgtgagagacagacaggacatggagagacaccacggcgagcagatccagaccctggaggacagattccagctgaaggtgagagagctgcagaccatccacgaggaggagctgagaaccctgcaggagcactacagccagagcctgagatgcctgcaggacaccctgtgcctgcaccagggcccccaccccaaggccctgcccgcccccgcccccaactggcaggccacccagggcgaggccgacagcatgaccggcctgagagagagaatccaggagctggaggcccagatggacgtgatgagagaggagctgggccacaaggacctggagggcgacgccgccaccctgagagagaagtaccagagagacctggagagcctgaaggccacctgcgagagaggcttcgccgccatggaggagacccaccagaagaagatcgaggacctgcagagacagcaccagagagagctggagaagctgagagaggagaaggacagactgctggccgaggagaccgccgccaccatcagcgccatcgaggccatgaagaacgcccacagagaggagatggagagagagctggagaagagccagagaagccagatcagcagcgtgaacagcgacgtggaggccctgagaagacagtacctggaggagctgcagagcgtgcagagagagctggaggtgctgagcgagcagtacagccagaagtgcctggagaacgcccacctggcccaggccctggaggccgagagacaggccctgagacagtgccagagagagaaccaggagctgaacgcccacaaccaggagctgaacaacagactggccgccgagatcaccagactgagaaccctgctgaccggcgacggcggcggcgaggccaccggcagccccctggcccagggcaaggacgcctacgagctggaggtgctgctgagagtgaaggagagcgagatccagtacctgaagcaggagatcagcagcctgaaggacgagctgcagaccgccctgagagacaagaagtacgccagcgacaagtacaaggacatctacaccgagctgagcatcgccaaggccaaggccgactgcgacatcagcagactgaaggagcagctgaaggccgccaccgaggccctgggcgagaagagccccgacagcgccaccgtgagcggctacgacatcatgaagagcaagagcaaccccgacttcctgaagaaggacagaagctgcgtgaccagacagctgagaaacatcagaagcaagagcgtgatcgagcaggtgagctgggacacctag

SEQ ID NO: 90029 - DNA, 840 bp, Artificial Sequence
  Description of Artificial Sequence: Synthetic coding sequence
tgacaggaggccgagctgggcgagcccgaccccgagcagaagagaagcagagccagagagagaagaagagagggcagaagcaagaccttcgactgggccgagttcagacccatccagcaggccctggcccaggagagagtgggcggcgtgggccccgccgacacccacgagcccctgagacccgaggccgagcccggcgagctggagagagagagagccagaagaagagaggagagaagaaagagattcggcatgctggacgccaccgacggccccggcaccgaggacgccgccctgagaatggaggtggacagaagccccggcctgcccatgagcgacctgaagacccacaacgtgcacgtggagatcgagcagagatggcaccaggtggagaccacccccctgagagaggagaagcaggtgcccatcgcccccgtgcacctgagcagcgaggacggcggcgacagactgagcacccacgagctgaccagcctgctggagaaggagctggagcagagccagaaggaggccagcgacctgctggagcagaacagactgctgcaggaccagctgagagtggccctgggcagagagcagagcgccagagagggctacgtgctgcagaccgaggtggccgccagccccagcggcgcctggcagagactgcacagagtgaaccaggacctgcagagcgagctggaggcccagtgccagagacaggagctgatcacccaccagatccagaccctgaagagaagctacggcgaggccaaggacaccatcagacaccacgaggccgagatcagaagcctgcaggccagactgagcaacgccgcctag

SEQ ID NO: 90030 - DNA, 585 bp, Artificial Sequence
  Description of Artificial Sequence: Synthetic coding sequence
ctgagacagcagaccgtggaggagctgcagagcgtgcagagagagctggaggtgctgagcgagcagtacagccagaagtgcctggagaacgcccacctggcccaggccctggaggccgagagacaggccctgagacagtgccagagagagaaccaggagctgaacgcccacaaccaggtgctgctgagagtgaaggagagcgagatccagtacctgaagcaggagatcagcagcctgaaggacgagctgcagaccgccctgagagacaagaagtacgccagcgacaagtacaaggacatctacaccgagctgagcatcgccaaggccaaggccgactgcgacatcagcagactgaaggagcagctgaaggccgccaccgaggccctgggcgagaagagccccgacagcgccaccgtgagcggctacgacatcatgaagagcaagagcaaccccgacttcctgaagaaggacagaagctgcgtgaccagacagctgagaaacatcagaagcaagagcctgaaggagggcctgaccgtgcaggagagactgaagctgttcgagagcagagacctgaagaaggactag

SEQ ID NO: 90031 - DNA, 3003 bp, Artificial Sequence
  Description of Artificial Sequence: Synthetic coding sequence
atgagcgccgccaaggagaacccctgcagaaagttccaggccaacatcttcaacaagagcaagtgccagaactgcttcaagcccagagagagccacctgctgaacgacgaggacctgacccaggccaagcccatctacggcggctggctgctgctggcccccgacggcaccgacttcgacaaccccgtgcacagaagcagaaagtggcagagaagattcttcatcctgtacgagcacggcctgctgagatacgccctggacgagatgcccaccaccctgccccagggcaccatcaacatgaaccagtgcaccgacgtggtggacggcgagggcagaaccggccagaagttcagcctgtgcatcctgacccccgagaaggagcacttcatcagagccgagaccaaggagatcgtgagcggctggctggagatgctgatggtgtaccccagaaccaacaagcagaaccagaagaagaagagaaaggtggagccccccaccccccaggagcccggccccgccaaggtggccgtgaccagcagcagcagcagcagcagcagcagcagcagcatccccagcgccgagaaggtgcccaccaccaagagcaccctgtggcaggaggagatgagaaccaaggaccagcccgacggcagcagcctgagccccgcccagagccccagccagagccagccccccgccgccagcagcctgagagagcccggcctggagagcaaggaggaggagagcgccatgagcagcgacagaatggactgcggcagaaaggtgagagtggagagcggctacttcagcctggagaagaccaagcaggacctgaaggccgaggagcagcagctgcccccccccctgagcccccccagccccagcacccccaaccacagaagaagccaggtgatcgagaagttcgaggccctggacatcgagaaggccgagcacatggagaccaacgccgtgggccccagccccagcagcgacaccagacagggcagaagcgagaagagagccttccccagaaagagacccgacctgctgaacttcaagaagggctggctgaccaagcagtacgaggacggccagtggaagaagcactggttcgtgctggccgaccagagcctgagatactacagagacagcgtggccgaggaggccgccgacctggacggcgagatcgacctgagcgcctgctacgacgtgaccgagtaccccgtgcagagaaactacggcttccagatccacaccaaggagggcgagttcaccctgagcgccatgaccagcggcatcagaagaaactggatccagaccatcatgaagcacgtgcaccccaccaccgcccccgacgtgaccagcagcctgcccgaggagaagaacaagagcagctgcagcttcgagacctgccccagacccaccgagaagcaggaggccgagctgggcgagcccgaccccgagcagaagagaagcagagccagagagagaagaagagagggcagaagcaagaccttcgactgggccgagttcagacccatccagcaggccctggcccaggagagagtgggcggcgtgggccccgccgacacccacgagcccctgagacccgaggccgagcccggcgagctggagagagagagagccagaagaagagaggagagaagaaagagattcggcatgctggacgccaccgacggccccggcaccgaggacgccgccctgagaatggaggtggacagaagccccggcctgcccatgagcgacctgaagacccacaacgtgcacgtggagatcgagcagagatggcaccaggtggagaccacccccctgagagaggagaagcaggtgcccatcgcccccgtgcacctgagcagcgaggacggcggcgacagactgagcacccacgagctgaccagcctgctggagaaggagctggagcagagccagaaggaggccagcgacctgctggagcagaacagactgctgcaggaccagctgagagtggccctgggcagagagcagagcgccagagagggctacgtgctgcaggccacctgcgagagaggcttcgccgccatggaggagacccaccagaagaagatcgaggacctgcagagacagcaccagagagagctggagaagctgagagaggagaaggacagactgctggccgaggagaccgccgccaccatcagcgccatcgaggccatgaagaacgcccacagagaggagatggagagagagctggagaagagccagagaagccagatcagcagcgtgaacagcgacgtggaggccctgagaagacagtacctggaggagctgcagagcgtgcagagagagctggaggtgctgagcgagcagtacagccagaagtgcctggagaacgcccacctggcccaggccctggaggccgagagacaggccctgagacagtgccagagagagaaccaggagctgaacgcccacaaccaggagctgaacaacagactggccgccgagatcaccagactgagaaccctgctgaccggcgacggcggcggcgaggccaccggcagccccctggcccagggcaaggacgcctacgagctggaggtgctgctgagagtgaaggagagcgagatccagtacctgaagcaggagatcagcagcctgaaggacgagctgcagaccgccctgagagacaagaagtacgccagcgacaagtacaaggacatctacaccgagctgagcatcgccaaggccaaggccgactgcgacatcagcagactgaaggagcagctgaaggccgccaccgaggccctgggcgagaagagccccgacagcgccaccgtgagcggctacgacatcatgaagagcaagagcaaccccgacttcctgaagaaggacagaagctgcgtgaccagacagctgagaaacatcagaagcaagagcctgaaggagggcctgaccgtgcaggagagactgaagctgttcgagagcagagacctgaagaaggactag

SEQ ID NO: 90032 - DNA, 795 bp, Artificial Sequence
  Description of Artificial Sequence: Synthetic coding sequence
atggagaactacggcatcgagtggcacagcgtgagagacagcgagggccagaagctgctgatcggcgtgggccccgagggcatcagcatctgcaaggacgacttcagccccatcaacagaatcgcctaccccgtggtgcagatggccacccagagcggcaagaacgtgtacctgaccgtgaccaaggagagcggcaacagcatcgtgctgctgttcaagatgatcagcaccagagccgccagcggcctgtacagagccatcaccgagacccacgccttctacagatgcgacaccgtgaccagcgccgtgatgatgcagtacagcagagacctgaagggccacctggccagcctgttcctgaacgagaacatcaacctgggcaagaagtacgtgttcgacatcaagagaaccagcaaggaggtgtacgaccacgccagaagagccctgtacaacgccggcgtggtggacctggtgagcagaaacaaccagagccccagccacagccccctgaagagcagcgagagcagcatgaactgcagcagctgcgagggcctgagctgccagcagaccagagtgctgcaggagaagctgagaaagctgaaggaggccatgctgtgcatggtgtgctgcgaggaggagatcaacagcaccttctgcccctgcggccacaccgtgtgctgcgagagctgcgccgcccagctgcagagctgccccgtgtgcagaagcagagtggagcacgtgcagcacgtgtacctgcccacccacaccagcctgctgaacctgaccgtgatctag

SEQ ID NO: 90033 - DNA, 1338 bp, Artificial Sequence
  Description of Artificial Sequence: Synthetic coding sequence
atgctgtgctacgtgaccagacccgacgccgtgctgatggaggtggaggtggaggccaaggccaacggcgaggactgcctgaaccaggtgtgcagaagactgggcatcatcgaggtggactacttcggcctgcagttcaccggcagcaagggcgagagcctgtggctgaacctgagaaacagaatcagccagcagatggacggcctggccccctacagactgaagctgagagtgaagttcttcgtggagccccacctgatcctgcaggagcagaccagacacatcttcttcctgcacatcaaggaggccctgctggccggccacctgctgtgcagccccgagcaggccgtggagctgagcgccctgctggcccagaccaagttcggcgactacaaccagaacaccgccaagtacaactacgaggagctgtgcgccaaggagctgagcagcgccaccctgaacagcatcgtggccaagcacaaggagctggagggcaccagccaggccagcgccgagtaccaggtgctgcagatcgtgagcgccatggagaactacggcatcgagtggcacagcgtgagagacagcgagggccagaagctgctgatcggcgtgggccccgagggcatcagcatctgcaaggacgacttcagccccatcaacagaatcgcctaccccgtggtgcagatggccacccagagcggcaagaacgtgtacctgaccgtgaccaaggagagcggcaacagcatcgtgctgctgttcaagatgatcagcaccagagccgccagcggcctgtacagagccatcaccgagacccacgccttctacagatgcgacaccgtgaccagcgccgtgatgatgcagtacagcagagacctgaagggccacctggccagcctgttcctgaacgagaacatcaacctgggcaagaagtacgtgttcgacatcaagagaaccagcaaggaggtgtacgaccacgccagaagagccctgtacaacgccggcgtggtggacctggtgagcagaaacaaccagagccccagccacagccccctgaagagcagcgagagcagcatgaactgcagcagctgcgagggcctgagctgccagcagaccagagtgctgcaggagaagctgagaaagctgaaggaggccatgctgtgcatggtgtgctgcgaggaggagatcaacagcaccttctgcccctgcggccacaccgtgtgctgcgagagctgcgccgcccagctgcagagctgccccgtgtgcagaagcagagtggagcacgtgcagcacgtgtacctgcccacccacaccagcctgctgaacctgaccgtgatctag

SEQ ID NO: 90034 - DNA, 5487 bp, Artificial Sequence
  Description of Artificial Sequence: Synthetic coding sequence
atggccgccagcgagctgtacaccaagttcgccagagtgtggatccccgaccccgaggaggtgtggaagagcgccgagctgctgaaggactacaagcccggcgacaaggtgctgctgctgcacctggaggagggcaaggacctggagtaccacctggaccccaagaccaaggagctgccccacctgagaaaccccgacatcctggtgggcgagaacgacctgaccgccctgagctacctgcacgagcccgccgtgctgcacaacctgagagtgagattcatcgacagcaagctgatctacacctactgcggcatcgtgctggtggccatcaacccctacgagcagctgcccatctacggcgaggacatcatcaacgcctacagcggccagaacatgggcgacatggacccccacatcttcgccgtggccgaggaggcctacaagcagatggccagagacgagagaaaccagagcatcatcgtgagcggcgagagcggcgccggcaagaccgtgagcgccaagtacgccatgagatacttcgccaccgtgagcggcagcgccagcgaggccaacgtggaggagaaggtgctggccagcaaccccatcatggagagcatcggcaacgccaagaccaccagaaacgacaacagcagcagattcggcaagtacatcgagatcggcttcgacaagagatacagaatcatcggcgccaacatgagaacctacctgctggagaagagcagagtggtgttccaggccgaggaggagagaaactaccacatcttctaccagctgtgcgccagcgccaagctgcccgagttcaagatgctgagactgggcaacgccgacaacttcaactacaccaagcagggcggcagccccgtgatcgagggcgtggacgacgccaaggagatggcccacaccagacaggcctgcaccctgctgggcatcagcgagagccaccagatgggcatcttcagaatcctggccggcatcctgcacctgggcaacgtgggcttcaccagcagagacgccgacagctgcaccatcccccccaagcacgagcccctgtgcatcttctgcgagctgatgggcgtggactacgaggagatgtgccactggctgtgccacagaaagctggccaccgccaccgagacctacatcaagcccatcagcaagctgcaggccaccaacgccagagacgccctggccaagcacatctacgccaagctgttcaactggatcgtggacaacgtgaaccaggccctgcacagcgccgtgaagcagcacagcttcatcggcgtgctggacatctacggcttcgagaccttcgagatcaacagcttcgagcagttctgcatcaactacgccaacgagaagctgcagcagcagttcaacatgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaaggacgacaagaacaccatgaccgacagcaccatcctgctggaggacgtgcagaagatgaaggacaagggcgagatcgcccaggcctacatcggcctgaaggagaccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctggacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90035 - DNA, 5643 bp, Artificial Sequence
  Description of Artificial Sequence: Synthetic coding sequence
atgaagagcagcagcctggagaccatgttcgccagagtgtggatccccgaccccgaggaggtgtggaagagcgccgagctgctgaaggactacaagcccggcgacaaggtgctgctgctgcacctggaggagggcaaggacctggagtaccacctggaccccaagaccaaggagctgccccacctgagaaaccccgacatcctggtgggcgagaacgacctgaccgccctgagctacctgcacgagcccgccgtgctgcacaacctgagagtgagattcatcgacagcaagctgatctacacctactgcggcatcgtgctggtggccatcaacccctacgagcagctgcccatctacggcgaggacatcatcaacgcctacagcggccagaacatgggcgacatggacccccacatcttcgccgtggccgaggaggcctacaagcagatggccagagacgagagaaaccagagcatcatcgtgagcggcgagagcggcgccggcaagaccgtgagcgccaagtacgccatgagatacttcgccaccgtgagcggcagcgccagcgaggccaacgtggaggagaaggtgctggccagcaaccccatcatggagagcatcggcaacgccaagaccaccagaaacgacaacagcagcagattcggcaagtacatcgagatcggcttcgacaagagatacagaatcatcggcgccaacatgagaacctacctgctggagaagagcagagtggtgttccaggccgaggaggagagaaactaccacatcttctaccagctgtgcgccagcgccaagctgcccgagttcaagatgctgagactgggcaacgccgacaacttcaactacaccaagcagggcggcagccccgtgatcgagggcgtggacgacgccaaggagatggcccacaccagacaggcctgcaccctgctgggcatcagcgagagccaccagatgggcatcttcagaatcctggccggcatcctgcacctgggcaacgtgggcttcaccagcagagacgccgacagctgcaccatcccccccaagcacgagcccctgtgcatcttctgcgagctgatgggcgtggactacgaggagatgtgccactggctgtgccacagaaagctggccaccgccaccgagacctacatcaagcccatcagcaagctgcaggccaccaacgccagagacgccctggccaagcacatctacgccaagctgttcaactggatcgtggacaacgtgaaccaggccctgcacagcgccgtgaagcagcacagcttcatcggcgtgctggacatctacggcttcgagaccttcgagatcaacagcttcgagcagttctgcatcaactacgccaacgagaagctgcagcagcagttcaacatgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaagctgcacgagaacaccatgaccgacagcaccatcctgctggaggacgtgcagaagatgaaggacaagggcgagatcgcccaggcctacatcggcctgaaggagaccaacagaagcagcgccctggactaccacgagctgaacgaggacggcgagctgtggctggtgtacgagggcctgaagcaggccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctgtacttcgaggagctgtacgccgacgaccccaagaagtaccagagctacagaatcagcctgtacaagagaatgatcgacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90036 - DNA, 4089 bp, Artificial Sequence
  Description of Artificial Sequence: Synthetic coding sequence
atgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaaggacgacaagaacaccatgaccgacagcaccatcctgctggaggacgtgcagaagatgaaggacaagggcgagatcgcccaggcctacatcggcctgaaggagaccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctggacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90037 - DNA, 5568 bp, Artificial Sequence
  Description of Artificial Sequence: Synthetic coding sequence
atggccgccagcgagctgtacaccaagttcgccagagtgtggatccccgaccccgaggaggtgtggaagagcgccgagctgctgaaggactacaagcccggcgacaaggtgctgctgctgcacctggaggagggcaaggacctggagtaccacctggaccccaagaccaaggagctgccccacctgagaaaccccgacatcctggtgggcgagaacgacctgaccgccctgagctacctgcacgagcccgccgtgctgcacaacctgagagtgagattcatcgacagcaagctgatctacacctactgcggcatcgtgctggtggccatcaacccctacgagcagctgcccatctacggcgaggacatcatcaacgcctacagcggccagaacatgggcgacatggacccccacatcttcgccgtggccgaggaggcctacaagcagatggccagagacgagagaaaccagagcatcatcgtgagcggcgagagcggcgccggcaagaccgtgagcgccaagtacgccatgagatacttcgccaccgtgagcggcagcgccagcgaggccaacgtggaggagaaggtgctggccagcaaccccatcatggagagcatcggcaacgccaagaccaccagaaacgacaacagcagcagattcggcaagtacatcgagatcggcttcgacaagagatacagaatcatcggcgccaacatgagaacctacctgctggagaagagcagagtggtgttccaggccgaggaggagagaaactaccacatcttctaccagctgtgcgccagcgccaagctgcccgagttcaagatgctgagactgggcaacgccgacaacttcaactacaccaagcagggcggcagccccgtgatcgagggcgtggacgacgccaaggagatggcccacaccagacaggcctgcaccctgctgggcatcagcgagagccaccagatgggcatcttcagaatcctggccggcatcctgcacctgggcaacgtgggcttcaccagcagagacgccgacagctgcaccatcccccccaagcacgagcccctgtgcatcttctgcgagctgatgggcgtggactacgaggagatgtgccactggctgtgccacagaaagctggccaccgccaccgagacctacatcaagcccatcagcaagctgcaggccaccaacgccagagacgccctggccaagcacatctacgccaagctgttcaactggatcgtggacaacgtgaaccaggccctgcacagcgccgtgaagcagcacagcttcatcggcgtgctggacatctacggcttcgagaccttcgagatcaacagcttcgagcagttctgcatcaactacgccaacgagaagctgcagcagcagttcaacatgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaaggacgacaagaacaccatgaccgacagcaccatcctgctggaggacgtgcagaagatgaaggacaagggcgagatcgcccaggcctacatcggcctgaaggagaccaacagaagcagcgccctggactaccacgagctgaacgaggacggcgagctgtggctggtgtacgagggcctgaagcaggccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctggacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90038 - DNA, 5559 bp, Artificial Sequence
  Description of Artificial Sequence: Synthetic coding sequence
atggccgccagcgagctgtacaccaagttcgccagagtgtggatccccgaccccgaggaggtgtggaagagcgccgagctgctgaaggactacaagcccggcgacaaggtgctgctgctgcacctggaggagggcaaggacctggagtaccacctggaccccaagaccaaggagctgccccacctgagaaaccccgacatcctggtgggcgagaacgacctgaccgccctgagctacctgcacgagcccgccgtgctgcacaacctgagagtgagattcatcgacagcaagctgatctacacctactgcggcatcgtgctggtggccatcaacccctacgagcagctgcccatctacggcgaggacatcatcaacgcctacagcggccagaacatgggcgacatggacccccacatcttcgccgtggccgaggaggcctacaagcagatggccagagacgagagaaaccagagcatcatcgtgagcggcgagagcggcgccggcaagaccgtgagcgccaagtacgccatgagatacttcgccaccgtgagcggcagcgccagcgaggccaacgtggaggagaaggtgctggccagcaaccccatcatggagagcatcggcaacgccaagaccaccagaaacgacaacagcagcagattcggcaagtacatcgagatcggcttcgacaagagatacagaatcatcggcgccaacatgagaacctacctgctggagaagagcagagtggtgttccaggccgaggaggagagaaactaccacatcttctaccagctgtgcgccagcgccaagctgcccgagttcaagatgctgagactgggcaacgccgacaacttcaactacaccaagcagggcggcagccccgtgatcgagggcgtggacgacgccaaggagatggcccacaccagacaggcctgcaccctgctgggcatcagcgagagccaccagatgggcatcttcagaatcctggccggcatcctgcacctgggcaacgtgggcttcaccagcagagacgccgacagctgcaccatcccccccaagcacgagcccctgtgcatcttctgcgagctgatgggcgtggactacgaggagatgtgccactggctgtgccacagaaagctggccaccgccaccgagacctacatcaagcccatcagcaagctgcaggccaccaacgccagagacgccctggccaagcacatctacgccaagctgttcaactggatcgtggacaacgtgaaccaggccctgcacagcgccgtgaagcagcacagcttcatcggcgtgctggacatctacggcttcgagaccttcgagatcaacagcttcgagcagttctgcatcaactacgccaacgagaagctgcagcagcagttcaacatgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaagaacaccatgaccgacagcaccatcctgctggaggacgtgcagaagatgaaggacaagggcgagatcgcccaggcctacatcggcctgaaggagaccaacagaagcagcgccctggactaccacgagctgaacgaggacggcgagctgtggctggtgtacgagggcctgaagcaggccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctggacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90039 - DNA, 4377 bp, Artificial Sequence
  Description of Artificial Sequence: Synthetic coding sequence
atgtgccactggctgtgccacagaaagctggccaccgccaccgagacctacatcaagcccatcagcaagctgcaggccaccaacgccagagacgccctggccaagcacatctacgccaagctgttcaactggatcgtggacaacgtgaaccaggccctgcacagcgccgtgaagcagcacagcttcatcggcgtgctggacatctacggcttcgagaccttcgagatcaacagcttcgagcagttctgcatcaactacgccaacgagaagctgcagcagcagttcaacatgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaagctgcacgagaacaccatgaccgacagcaccatcctgctggaggacgtgcagaagatgaaggacaagggcgagatcgcccaggcctacatcggcctgaaggagaccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctggacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90040 - DNA, 5562 bp, Artificial Sequence
  Description of Artificial Sequence: Synthetic coding sequence
atggccgccagcgagctgtacaccaagttcgccagagtgtggatccccgaccccgaggaggtgtggaagagcgccgagctgctgaaggactacaagcccggcgacaaggtgctgctgctgcacctggaggagggcaaggacctggagtaccacctggaccccaagaccaaggagctgccccacctgagaaaccccgacatcctggtgggcgagaacgacctgaccgccctgagctacctgcacgagcccgccgtgctgcacaacctgagagtgagattcatcgacagcaagctgatctacacctactgcggcatcgtgctggtggccatcaacccctacgagcagctgcccatctacggcgaggacatcatcaacgcctacagcggccagaacatgggcgacatggacccccacatcttcgccgtggccgaggaggcctacaagcagatggccagagacgagagaaaccagagcatcatcgtgagcggcgagagcggcgccggcaagaccgtgagcgccaagtacgccatgagatacttcgccaccgtgagcggcagcgccagcgaggccaacgtggaggagaaggtgctggccagcaaccccatcatggagagcatcggcaacgccaagaccaccagaaacgacaacagcagcagattcggcaagtacatcgagatcggcttcgacaagagatacagaatcatcggcgccaacatgagaacctacctgctggagaagagcagagtggtgttccaggccgaggaggagagaaactaccacatcttctaccagctgtgcgccagcgccaagctgcccgagttcaagatgctgagactgggcaacgccgacaacttcaactacaccaagcagggcggcagccccgtgatcgagggcgtggacgacgccaaggagatggcccacaccagacaggcctgcaccctgctgggcatcagcgagagccaccagatgggcatcttcagaatcctggccggcatcctgcacctgggcaacgtgggcttcaccagcagagacgccgacagctgcaccatcccccccaagcacgagcccctgtgcatcttctgcgagctgatgggcgtggactacgaggagatgtgccactggctgtgccacagaaagctggccaccgccaccgagacctacatcaagcccatcagcaagctgcaggccaccaacgccagagacgccctggccaagcacatctacgccaagctgttcaactggatcgtggacaacgtgaaccaggccctgcacagcgccgtgaagcagcacagcttcatcggcgtgctggacatctacggcttcgagaccttcgagatcaacagcttcgagcagttctgcatcaactacgccaacgagaagctgcagcagcagttcaacatgcacgtgttcaagctggagcaggaggagtacatgaaggagcagatcccctggaccctgatcgacttctacgacaaccagccctgcatcaacctgatcgagagcaagctgggcatcctggacctgctggacgaggagtgcaagatgcccaagggcaccgacgacacctgggcccagaagctgtacaacacccacctgaacaagtgcgccctgttcgagaagcccagactgagcaacaaggccttcatcatccagcacttcgccgacaaggtggagtaccagtgcgagggcttcctggagaagaacaaggacaccgtgttcgaggagcagatcaaggtgctgaagagcagcaagttcaagatgctgcccgagctgttccaggacgacgagaaggccatcagccccaccagcgccaccagcagcggcagaacccccctgaccagaacccccgccaagcccaccaagggcagacccggccagatggccaaggagcacaagaagaccgtgggccaccagttcagaaacagcctgcacctgctgatggagaccctgaacgccaccaccccccactacgtgagatgcatcaagcccaacgacttcaagttccccttcaccttcgacgagaagagagccgtgcagcagctgagagcctgcggcgtgctggagaccatcagaatcagcgccgccggcttccccagcagatggacctaccaggagttcttcagcagatacagagtgctgatgaagcagaaggacgtgctgagcgacagaaagcagacctgcaagaacgtgctggagaagctgatcctggacaaggacaagtaccagttcggcaagaccaagatcttcttcagagccggccaggtggcctacctggagaagctgagagccgacaagctgagagccgcctgcatcagaatccagaagaccatcagaggctggctgctgagaaagaagtacctgagaatgagaaaggccgccatcaccatgcagagatacgtgagaggctaccaggccagatgctacgccaagttcctgagaagaaccaaggccgccaccatcatccagaagtactggagaatgtacgtggtgagaagaagatacaagatcagaagagccgccaccatcgtgctgcagagctacctgagaggcttcctggccagaaacagatacagaaagatcctgagagagcacaaggccgtgatcatccagaagagagtgagaggctggctggccagaacccactacaagagaagcatgcacgccatcatctacctgcagtgctgcttcagaagaatgatggccaagagagagctgaagaagctgaagatcgaggccagaagcgtggagagatacaagaagctgcacatcggcatggagaacaagatcatgcagctgcagagaaaggtggacgagcagaacaaggactacaagtgcctggtggagaagctgaccaacctggagggcatctacaacagcgagaccgagaagctgagaagcgacctggagagactgcagctgagcgaggaggaggccaaggtggccaccggcagagtgctgagcctgcaggaggagatcgccaagctgagaaaggacctggagcagaccagaagcgagaagaagtgcatcgaggagcacgccgacagatacaagcaggagaccgagcagctggtgagcaacctgaaggaggagaacaccctgctgaagcaggagaaggaggccctgaaccacagaatcgtgcagcaggccaaggagatgaccgagaccatggagaagaagctggtggaggagaccaagcagctggagctggacctgaacgacgagagactgagataccagaacctgctgaacgagttcagcagactggaggagagatacgacgacctgaaggaggagatgaccctgatggtgcacgtgcccaagcccggccacaagagaaccgacagcacccacagcagcaacgagagcgagtacatcttcagcagcgagatcgccgagatggaggacatccccagcagaaccgaggagcccagcgagaagaaggtgcccctggacatgagcctgttcctgaagctgcagaagagagtgaccgagctggagcaggagaagcaggtgatgcaggacgagctggacagaaaggaggagcaggtgctgagaagcaaggccaaggaggaggagagaccccagatcagaggcgccgagctggagtacgagagcctgaagagacaggagctggagagcgagaacaagaagctgaagaacgagctgaacgagctgagaaaggccctgagcgagaagagcgcccccgaggtgaccgcccccggcgcccccgcctacagagtgctgatggagcagctgaccagcgtgagcgaggagctggacgtgagaaaggaggaggtgctgatcctgagaagccagctggtgagccagaaggaggccatccagcccaaggacgacaagaacaccatgaccgacagcaccatcctgctggaggacgtgcagaagatgaaggacaagggcgagatcgcccaggcctacatcggcctgaaggagaccaacagactgctggagagccagctgcagagccagaagagaagccacgagaacgaggccgaggccctgagaggcgagatccagagcctgaaggaggagaacaacagacagcagcagctgctggcccagaacctgcagctgccccccgaggccagaatcgaggccagcctgcagcacgagatcaccagactgaccaacgagaacctgtacttcgaggagctgtacgccgacgaccccaagaagtaccagagctacagaatcagcctgtacaagagaatgatcgacctgatggagcagctggagaagcaggacaagaccgtgagaaagctgaagaagcagctgaaggtgttcgccaagaagatcggcgagctggaggtgggccagatggagaacatcagccccggccagatcatcgacgagcccatcagacccgtgaacatccccagaaaggagaaggacttccagggcatgctggagtacaagaaggaggacgagcagaagctggtgaagaacctgatcctggagctgaagcccagaggcgtggccgtgaacctgatccccggcctgcccgcctacatcctgttcatgtgcgtgagacacgccgactacctgaacgacgaccagaaggtgagaagcctgctgaccagcaccatcaacagcatcaagaaggtgctgaagaagagaggcgacgacttcgagaccgtgagcttctggctgagcaacacctgcagattcctgcactgcctgaagcagtacagcggcgaggagggcttcatgaagcacaacaccagcagacagaacgagcactgcctgaccaacttcgacctggccgagtacagacaggtgctgagcgacctggccatccagatctaccagcagctggtgagagtgctggagaacatcctgcagcccatgatcgtgagcggcatgctggagcacgagaccatccagggcgtgagcggcgtgaagcccaccggcctgagaaagagaaccagcagcatcgccgacgagggcacctacaccctggacagcatcctgagacagctgaacagcttccacagcgtgatgtgccagcacggcatggaccccgagctgatcaagcaggtggtgaagcagatgttctacatcatcggcgccatcaccctgaacaacctgctgctgagaaaggacatgtgcagctggagcaagggcatgcagatcagatacaacgtgagccagctggaggagtggctgagagacaagaacctgatgaacagcggcgccaaggagaccctggagcccctgatccaggccgcccagctgctgcaggtgaagaagaagaccgacgacgacgccgaggccatctgcagcatgtgcaacgccctgaccaccgcccagatcgtgaaggtgctgaacctgtacacccccgtgaacgagttcgaggagagagtgagcgtgagcttcatcagaaccatccagatgagactgagagacagaaaggacagcccccagctgctgatggacgccaagcacatcttccccgtgaccttccccttcaaccccagcagcctggccctggagaccatccagatccccgccagcctgggcctgggcttcatcagcagagtgtag

SEQ ID NO: 90041 - DNA, 5547 bp, Artificial Sequence
  Description of Artificial Sequence: Synthetic coding sequence
atgagcgtgggcgagctgtacagccagtgcaccagagtgtggatccccgaccccgacgaggtgtggagaagcgccgagctgaccaaggactacaaggagggcgacaagagcctgcagctgagactggaggacgagaccatcctggagtaccccatcgacgtgcagagaaaccagctgcccttcctgagaaaccccgacatcctggtgggcgagaacgacctgaccgccctgagctacctgcacgagcccgccgtgctgcacaacctgaaggtgagattcctggagagcaaccacatctacacctactgcggcatcgtgctggtggccatcaacccctacgagcagctgcccatctacggccaggacgtgatctacacctacagcggccagaacatgggcgacatggacccccacatcttcgccgtggccgaggaggcctacaagcagatggccagagacgagaagaaccagagcatcatcgtgagcggcgagagcggcgccggcaagaccgtgagcgccaagtacgccatgagatacttcgccaccgtgggcggcagcgccagcgagaccaacatcgaggagaaggtgctggccagcagccccatcatggaggccatcggcaacgccaagaccaccagaaacgacaacagcagcagattcggcaagtacatccagatcggcttcgacaagagataccacatcatcggcgccaacatgagaacctacctgctggagaagagcagagtggtgttccaggccgacgacgagagaaactaccacatcttctaccagctgtgcgccgccgccggcctgcccgagttcaaggagctggccctgaccagcgccgaggacttcttctacaccagccagggcggcgacaccagcatcgagggcgtggacgacgccgaggacttcgagaagaccagacaggccttcaccctgctgggcgtgaaggagagccaccagatgagcatcttcaagatcatcgccagcatcctgcacctgggcagcgtggccatccaggccgagagagacggcgacagctgcagcatcagcccccaggacgtgtacctgagcaacttctgcagactgctgggcgtggagcacagccagatggagcactggctgtgccacagaaagctggtgaccaccagcgagacctacgtgaagaccatgagcctgcagcaggtgatcaacgccagaaacgccctggccaagcacatctacgcccagctgttcggctggatcgtggagcacatcaacaaggccctgcacaccagcctgaagcagcacagcttcatcggcgtgctggacatctacggcttcgagaccttcgaggtgaacagcttcgagcagttctgcatcaactacgccaacgagaagctgcagcagcagttcaacagccacgtgttcaagctggagcaggaggagtacatgaaggagcagatcccctggaccctgatcgacttctacgacaaccagccctgcatcgacctgatcgaggccaagctgggcatcctggacctgctggacgaggagtgcaaggtgcccaagggcaccgaccagaactgggcccagaagctgtacgacagacacagcagcagccagcacttccagaagcccagaatgagcaacaccgccttcatcatcgtgcacttcgccgacaaggtggagtacctgagcgacggcttcctggagaagaacagagacaccgtgtacgaggagcagatcaacatcctgaaggccagcaagttccccctggtggccgacctgttccacgacgacaaggaccccgtgcccgccaccacccccggcaagggcagcagcagcaagatcagcgtgagaagcgccagaccccccatgaaggtgagcaacaaggagcacaagaagaccgtgggccaccagttcagaaccagcctgcacctgctgatggagaccctgaacgccaccaccccccactacgtgagatgcatcaagcccaacgacgagaagctgcccttccacttcgaccccaagagagccgtgcagcagctgagagcctgcggcgtgctggagaccatcagaatcagcgccgccggctaccccagcagatgggcctaccacgacttcttcaacagatacagagtgctggtgaagaagagagagctggccaacaccgacaagaaggccatctgcagaagcgtgctggagaacctgatcaaggaccccgacaagttccagttcggcagaaccaagatcttcttcagagccggccaggtggcctacctggagaagctgagagccgacaagttcagaaccgccaccatcatgatccagaagaccgtgagaggctggctgcagaaggtgaagtaccacagactgaagggcgccaccctgaccctgcagagatactgcagaggccacctggccagaagactggccgagcacctgagaagaatcagagccgccgtggtgctgcagaagcactacagaatgcagagagccagacaggcctaccagagagtgagaagagccgccgtggtgatccaggccttcaccagagccatgttcgtgagaagaacctacagacaggtgctgatggagcacaaggccaccaccatccagaagcacgtgagaggctggatggccagaagacacttccagagactgagagacgccgccatcgtgatccagtgcgccttcagaatgctgaaggccagaagagagctgaaggccctgagaatcgaggccagaagcgccgagcacctgaagagactgaacgtgggcatggagaacaaggtggtgcagctgcagagaaagatcgacgagcagaacaaggagttcaagaccctgagcgagcagctgagcgtgaccaccagcacctacaccatggaggtggagagactgaagaaggagctggtgcactaccagcagagccccggcgaggacaccagcctgagactgcaggaggaggtggagagcctgagaaccgagctgcagagagcccacagcgagagaaagatcctggaggacgcccacagcagagagaaggacgagctgagaaagagagtggccgacctggagcaggagaacgccctgctgaaggacgagaaggagcagctgaacaaccagatcctgtgccagagcaaggacgagttcgcccagaacagcgtgaaggagaacctgatgaagaaggagctggaggaggagagaagcagataccagaacctggtgaaggagtacagccagctggagcagagatacgacaacctgagagacgagatgaccatcatcaagcagacccccggccacagaagaaaccccagcaaccagagcagcctggagagcgacagcaactaccccagcatcagcaccagcgagatcggcgacaccgaggacgccctgcagcaggtggaggagatcggcctggagaaggccgccatggacatgaccgtgttcctgaagctgcagaagagagtgagagagctggagcaggagagaaagaagctgcaggtgcagctggagaagagagagcagcaggacagcaagaaggtgcaggccgagcccccccagaccgacatcgacctggaccccaacgccgacctggcctacaacagcctgaagagacaggagctggagagcgagaacaagaagctgaagaacgacctgaacgagctgagaaaggccgtggccgaccaggccacccagaacaacagcagccacggcagccccgacagctacagcctgctgctgaaccagctgaagctggcccacgaggagctggaggtgagaaaggaggaggtgctgatcctgagaacccagatcgtgagcgccgaccagagaagactggccggcagaaacgccgagcccaacatcaacgccagaagcagctggcccaacagcgagaagcacgtggaccaggaggacgccatcgaggcctaccacggcgtgtgccagaccaacagcaagaccgaggactggggctacctgaacgaggacggcgagctgggcctggcctaccagggcctgaagcaggtggccagactgctggaggcccagctgcaggcccagagcctggagcacgaggaggaggtggagcacctgaaggcccagctggaggccctgaaggaggagatggacaagcagcagcagaccttctgccagaccctgctgctgagccccgaggcccaggtggagttcggcgtgcagcaggagatcagcagactgaccaacgagaacctggacctgaaggagctggtggagaagctggagaagaacgagagaaagctgaagaagcagctgaagatctacatgaagaaggcccaggacctggaggccgcccaggccctggcccagagcgagagaaagagacacgagctgaacagacaggtgaccgtgcagagaaaggagaaggacttccagggcatgctggagtaccacaaggaggacgaggccctgctgatcagaaacctggtgaccgacctgaagccccagatgctgagcggcaccgtgccctgcctgcccgcctacatcctgtacatgtgcatcagacacgccgactacaccaacgacgacctgaaggtgcacagcctgctgaccagcaccatcaacggcatcaagaaggtgctgaagaagcacaacgacgacttcgagatgaccagcttctggctgagcaacacctgcagactgctgcactgcctgaagcagtacagcggcgacgagggcttcatgacccagaacaccgccaagcagaacgagcactgcctgaagaacttcgacctgaccgagtacagacaggtgctgagcgacctgagcatccagatctaccagcagctgatcaagatcgccgagggcgtgctgcagcccatgatcgtgagcgccatgctggagaacgagagcatccagggcctgagcggcgtgaagcccaccggctacagaaagagaagcagcagcatggccgacggcgacaacagctactgcctggaggccatcatcagacagatgaacgccttccacaccgtgatgtgcgaccagggcctggaccccgagatcatcctgcaggtgttcaagcagctgttctacatgatcaacgccgtgaccctgaacaacctgctgctgagaaaggacgtgtgcagctggagcaccggcatgcagctgagatacaacatcagccagctggaggagtggctgagaggcagaaacctgcaccagagcggcgccgtgcagaccatggagcccctgatccaggccgcccagctgctgcagctgaagaagaagacccaggaggacgccgaggccatctgcagcctgtgcaccagcctgagcacccagcagatcgtgaagatcctgaacctgtacacccccctgaacgagttcgaggagagagtgaccgtggccttcatcagaaccatccaggcccagctgcaggagagaaacgacccccagcagctgctgctggacgccaagcacatgttccccgtgctgttccccttcaaccccagcagcctgaccatggacagcatccacatccccgcctgcctgaacctggagttcctgaacgaggtgtag

SEQ ID NO: 90042 - DNA, 2892 bp, Artificial Sequence
  Description of Artificial Sequence: Synthetic coding sequence
atggagcacaaggccaccaccatccagaagcacgtgagaggctggatggccagaagacacttccagagactgagagacgccgccatcgtgatccagtgcgccttcagaatgctgaaggccagaagagagctgaaggccctgagaatcgaggccagaagcgccgagcacctgaagagactgaacgtgggcatggagaacaaggtggtgcagctgcagagaaagatcgacgagcagaacaaggagttcaagaccctgagcgagcagctgagcgtgaccaccagcacctacaccatggaggtggagagactgaagaaggagctggtgcactaccagcagagccccggcgaggacaccagcctgagactgcaggaggaggtggagagcctgagaaccgagctgcagagagcccacagcgagagaaagatcctggaggacgcccacagcagagagaaggacgagctgagaaagagagtggccgacctggagcaggagaacgccctgctgaaggacgagaaggagcagctgaacaaccagatcctgtgccagagcaaggacgagttcgcccagaacagcgtgaaggagaacctgatgaagaaggagctggaggaggagagaagcagataccagaacctggtgaaggagtacagccagctggagcagagatacgacaacctgagagacgagatgaccatcatcaagcagacccccggccacagaagaaaccccagcaaccagagcagcctggagagcgacagcaactaccccagcatcagcaccagcgagatcggcgacaccgaggacgccctgcagcaggtggaggagatcggcctggagaaggccgccatggacatgaccgtgttcctgaagctgcagaagagagtgagagagctggagcaggagagaaagaagctgcaggtgcagctggagaagagagagcagcaggacagcaagaaggtgcaggccgagcccccccagaccgacatcgacctggaccccaacgccgacctggcctacaacagcctgaagagacaggagctggagagcgagaacaagaagctgaagaacgacctgaacgagctgagaaaggccgtggccgaccaggccacccagaacaacagcagccacggcagccccgacagctacagcctgctgctgaaccagctgaagctggcccacgaggagctggaggtgagaaaggaggaggtgctgatcctgagaacccagatcgtgagcgccgaccagagaagactggccggcagaaacgccgagcccaacatcaacgccagaagcagctggcccaacagcgagaagcacgtggaccaggaggacgccatcgaggcctaccacggcgtgtgccagaccaacagactgctggaggcccagctgcaggcccagagcctggagcacgaggaggaggtggagcacctgaaggcccagctggaggccctgaaggaggagatggacaagcagcagcagaccttctgccagaccctgctgctgagccccgaggcccaggtggagttcggcgtgcagcaggagatcagcagactgaccaacgagaacctggacctgaaggagctggtggagaagctggagaagaacgagagaaagctgaagaagcagctgaagatctacatgaagaaggcccaggacctggaggccgcccaggccctggcccagagcgagagaaagagacacgagctgaacagacaggtgaccgtgcagagaaaggagaaggacttccagggcatgctggagtaccacaaggaggacgaggccctgctgatcagaaacctggtgaccgacctgaagccccagatgctgagcggcaccgtgccctgcctgcccgcctacatcctgtacatgtgcatcagacacgccgactacaccaacgacgacctgaaggtgcacagcctgctgaccagcaccatcaacggcatcaagaaggtgctgaagaagcacaacgacgacttcgagatgaccagcttctggctgagcaacacctgcagactgctgcactgcctgaagcagtacagcggcgacgagggcttcatgacccagaacaccgccaagcagaacgagcactgcctgaagaacttcgacctgaccgagtacagacaggtgctgagcgacctgagcatccagatctaccagcagctgatcaagatcgccgagggcgtgctgcagcccatgatcgtgagcgccatgctggagaacgagagcatccagggcctgagcggcgtgaagcccaccggctacagaaagagaagcagcagcatggccgacggcgacaacagctactgcctggaggccatcatcagacagatgaacgccttccacaccgtgatgtgcgaccagggcctggaccccgagatcatcctgcaggtgttcaagcagctgttctacatgatcaacgccgtgaccctgaacaacctgctgctgagaaaggacgtgtgcagctggagcaccggcatgcagctgagatacaacatcagccagctggaggagtggctgagaggcagaaacctgcaccagagcggcgccgtgcagaccatggagcccctgatccaggccgcccagctgctgcagctgaagaagaagacccaggaggacgccgaggccatctgcagcctgtgcaccagcctgagcacccagcagatcgtgaagatcctgaacctgtacacccccctgaacgagttcgaggagagagtgaccgtggccttcatcagaaccatccaggcccagctgcaggagagaaacgacccccagcagctgctgctggacgccaagcacatgttccccgtgctgttccccttcaaccccagcagcctgaccatggacagcatccacatccccgcctgcctgaacctggagttcctgaacgaggtgtag

SEQ ID NO: 90043 - DNA, 2163 bp, Artificial Sequence
  Description of Artificial Sequence: Synthetic coding sequence
atgcactggcccgtgaccagagagtgcaccagagtgtggatccccgaccccgacgaggtgtggagaagcgccgagctgaccaaggactacaaggagggcgacaagagcctgcagctgagactggaggacgagaccatcctggagtaccccatcgacgtgcagagaaaccagctgcccttcctgagaaaccccgacatcctggtgggcgagaacgacctgaccgccctgagctacctgcacgagcccgccgtgctgcacaacctgaaggtgagattcctggagagcaaccacatctacacctactgcggcatcgtgctggtggccatcaacccctacgagcagctgcccatctacggccaggacgtgatctacacctacagcggccagaacatgggcgacatggacccccacatcttcgccgtggccgaggaggcctacaagcagatggccagagacgagaagaaccagagcatcatcgtgagcggcgagagcggcgccggcaagaccgtgagcgccaagtacgccatgagatacttcgccaccgtgggcggcagcgccagcgagaccaacatcgaggagaaggtgctggccagcagccccatcatggaggccatcggcaacgccaagaccaccagaaacgacaacagcagcagattcggcaagtacatccagatcggcttcgacaagagataccacatcatcggcgccaacatgagaacctacctgctggagaagagcagagtggtgttccaggccgacgacgagagaaactaccacatcttctaccagctgtgcgccgccgccggcctgcccgagttcaaggagctggccctgaccagcgccgaggacttcttctacaccagccagggcggcgacaccagcatcgagggcgtggacgacgccgaggacttcgagaagaccagacaggccttcaccctgctgggcgtgaaggagagccaccagatgagcatcttcaagatcatcgccagcatcctgcacctgggcagcgtggccatccaggccgagagagacggcgacagctgcagcatcagcccccaggacgtgtacctgagcaacttctgcagactgctgggcgtggagcacagccagatggagcactggctgtgccacagaaagctggtgaccaccagcgagacctacgtgaagaccatgagcctgcagcaggtgatcaacgccagaaacgccctggccaagcacatctacgcccagctgttcggctggatcgtggagcacatcaacaaggccctgcacaccagcctgaagcagcacagcttcatcggcgtgctggacatctacggcttcgagaccttcgaggtgaacagcttcgagcagttctgcatcaactacgccaacgagaagctgcagcagcagttcaacagccacgtgttcaagctggagcaggaggagtacatgaaggagcagatcccctggaccctgatcgacttctacgacaaccagccctgcatcgacctgatcgaggccaagctgggcatcctggacctgctggacgaggagtgcaaggtgcccaagggcaccgaccagaactgggcccagaagctgtacgacagacacagcagcagccagcacttccagaagcccagaatgagcaacaccgccttcatcatcgtgcacttcgccgacaaggtggagtacctgagcgacggcttcctggagaagaacagagacaccgtgtacgaggagcagatcaacatcctgaaggccagcaagttccccctggtggccgacctgttccacgacgacaaggaccccgtgcccgccaccacccccggcaagggcagcagcagcaagatcagcgtgagaagcgccagaccccccatgaaggtgagcaacaaggagcacaagaagaccgtgggccaccagttcagaaccagcctgagcacccagcagatcgtgaagatcctgaacctgtacacccccctgaacgagttcgaggagagagtgaccgtggccttcatcagaaccatccaggcccagctgcaggagagaaacgacccccagcagctgctgctggacgccaagcacatgttccccgtgctgttccccttcaaccccagcagcctgaccatggacagcatccacatccccgcctgcctgaacctggagttcctgaacgaggtgtag

SEQ ID NO: 90044 - DNA, 5229 bp, Artificial Sequence
  Description of Artificial Sequence: Synthetic coding sequence
atggccgtggccgagctgtacacccagtacaacagagtgtggatccccgaccccgaggaggtgtggaagagcgccgagatcgccaaggactacagagtgggcgacaaggtgctgagactgctgctggaggacggcaccgagctggactacagcgtgaaccccgagagcctgccccccctgagaaaccccgacatcctggtgggcgagaacgacctgaccgccctgagctacctgcacgagcccgccgtgctgcacaacctgagaatcagattcgccgagagcaagctgatctacacctacagcggcatcatcctggtggccatgaacccctacaagcagctgcccatctacggcgacgccatcatccacgcctacagcggccagaacatgggcgacatggacccccacatcttcgccgtggccgaggaggcctacaagcagatggccagaaacaacagaaaccagagcatcatcgtgagcggcgagagcggcgccggcaagaccgtgagcgccagatacgccatgagatacttcgccaccgtgagcaagagcggcagcaacgcccacgtggaggacaaggtgctggccagcaaccccatcaccgaggccgtgggcaacgccaagaccaccagaaacgacaacagcagcagattcggcaagtacaccgagatcagcttcgacgagcagaaccagatcatcggcgccaacatgagcacctacctgctggagaagagcagagtggtgttccagagcgagaacgagagaaactaccacatcttctaccagctgtgcgccagcgcccagcagagcgagttcaagcacctgaagctgggcagcgccgaggagttcaactacaccagaatgggcggcaacaccgtgatcgagggcgtgaacgacagagccgagatggtggagacccagaagaccttcaccctgctgggcttcaaggaggacttccagatggacgtgttcaagatcctggccgccatcctgcacctgggcaacgtgcagatcaccgccgtgggcaacgagagaagcagcgtgagcgaggacgacagccacctgaaggtgttctgcgagctgctgggcctggagagcggcagagtggcccagtggctgtgcaacagaaagatcgtgaccagcagcgagaccgtggtgaagcccatgaccagaccccaggccgtgaacgccagagacgccctggccaagaagatctacgcccacctgttcgacttcatcgtggagagaatcaaccaggccctgcagttcagcggcaagcagcacaccttcatcggcgtgctggacatctacggcttcgagaccttcgacgtgaacagcttcgagcagttctgcatcaactacgccaacgagaagctgcagcagcagttcaacatgcacgtgttcaagctggagcaggaggagtacatgaaggaggacatcccctggaccctgatcgacttctacgacaaccagcccgtgatcgacctgatcgaggccaagatgggcatcctggagctgctggacgaggagtgcctgctgccccacggcaccgacgagaactggctgcagaagctgtacaacaacttcgtgaacagaaaccccctgttcgagaagcccagaatgagcaacaccagcttcgtgatccagcacttcgccgacaaggtggagtacaagtgcgagggcttcctggagaagaacagagacaccgtgtacgacatgctggtggagatcctgagagccagcaagttccacctgtgcgccaacttcttccaggagaaccccaccccccccagccccttcggcagcatgatcaccgtgaagagcgccaagcaggtgatcaagcccaacagcaagcacttcagaaccaccgtgggcagcaagttcagaagcagcctgtacctgctgatggagaccctgaacgccaccaccccccactacgtgagatgcatcaagcccaacgacgagaagctgcccttcgagttcgacagcaagagaatcgtgcagcagctgagagcctgcggcgtgctggagaccatcagaatcagcgcccagagctaccccagcagatggacctacatcgagttctacagcagatacggcatcctgatgaccaagcaggagctgagcttcagcgacaagaaggaggtgtgcaaggtggtgctgcacagactgatccaggacagcaaccagtaccagttcggcaagaccaagatcttcttcagagccggccaggtggcctacctggagaagctgagactggacaagctgagacagagctgcgtgatggtgcagaagcacatgagaggctggctgcagagaaagaagttcctgagagagagaagagccgccctgatcatccagcagtacttcagaggccagcagaccgtgagaaaggccatcaccgccgtggccctgaaggaggcctgggccgccatcatcatccagaagcactgcagaggctacctggtgagaagcctgtaccagctgatcagaatggccaccatcaccatgcaggcctacagcagaggcttcctggccagaagaagatacagaaagatgctggaggagcacaaggccgtgatcctgcagaagtacgccagagcctggctggccagaagaagattccagagcatcagaagattcgtgctgaacatccagctgacctacagagtgcagagactgcagaagaagctggaggaccagaacaaggagaaccacggcctggtggagaagctgaccagcctggccgccctgagagccggcgacgtggagaagatccagaagctggaggccgagctggagaaggccgccacccacagaagaaactacgaggagaagggcaagagatacagagacgccgtggaggagaagctggccaagctgcagaagcacaacagcgagctggagacccagaaggagcagatccagctgaagctgcaggagaagaccgaggagctgaaggagaagatggacaacctgaccaagcagctgttcgacgacgtgcagaaggaggagagacagagaatgctgctggagaagagcttcgagctgaagacccaggactacgagaagcagatccagagcctgaaggaggagatcaaggccctgaaggacgagaagatgcagctgcagcacctggtggagggcgagcacgtgaccagcgacggcctgaaggccgaggtggccagactgagcaagcaggtgaagaccatcagcgagttcgagaaggagatcgagctgctgcaggcccagaagatcgacgtggagaagcacgtgcagagccagaagagagagatgagagagaagatgagcgagatcaccaagcagctgctggagagctacgacatcgaggacgtgagaagcagactgagcgtggaggacctggagcacctgaacgaggacggcgagctgtggttcgcctacgagggcctgaagaaggccaccagagtgctggagagccacttccagagccagaaggactgctacgagaaggagatcgaggccctgaacttcaaggtggtgcacctgagccaggagatcaaccacctgcagaagctgttcagagaggagaacgacatcaacgagagcatcagacacgaggtgaccagactgaccagcgagaacatgatgatccccgacttcaagcagcagatcagcgagctggagaagcagaagcaggacctggagatcagactgaacgagcaggccgagaagatgaagggcaagctggaggagctgagcaaccagctgcacagaagccaggaggaggagggcacccagagaaaggccctggaggcccagaacgagatccacaccaaggagaaggagaagctgatcgacaagatccaggagatgcaggaggccagcgaccacctgaagaagcagttcgagaccgagagcgaggtgaagtgcaacttcagacaggaggccagcagactgaccctggagaacagagacctggaggaggagctggacatgaaggacagagtgatcaagaagctgcaggaccaggtgaagaccctgagcaagaccatcggcaaggccaacgacgtgcacagcagcagcggccccaaggagtacctgggcatgctgcagtacaagagagaggacgaggccaagctgatccagaacctgatcctggacctgaagcccagaggcgtggtggtgaacatgatccccggcctgcccgcccacatcctgttcatgtgcgtgagatacgccgacagcctgaacgacgccaacatgctgaagagcctgatgaacagcaccatcaacggcatcaagcaggtggtgaaggagcacctggaggacttcgagatgctgagcttctggctgagcaacacctgccacttcctgaactgcctgaagcagtacagcggcgaggaggagttcatgaagcacaacagcccccagcagaacaagaactgcctgaacaacttcgacctgagcgagtacagacagatcctgagcgacgtggccatcagaatctaccaccagttcatcatcatcatggagaagaacatccagcccatcatcgtgcccggcatgctggagtacgagagcctgcagggcatcagcggcctgaagcccaccggcttcagaaagagaagcagcagcatcgacgacaccgacggctacaccatgaccagcgtgctgcagcagctgagctacttctacaccaccatgtgccagaacggcctggaccccgagctggtgagacaggccgtgaagcagctgttcttcctgatcggcgccgtgaccctgaacagcctgttcctgagaaaggacatgtgcagctgcagaaagggcatgcagatcagatgcaacatcagctacctggaggagtggctgaaggacaagaacctgcagaacagcctggccaaggagaccctggagcccctgagccaggccgcctggctgctgcaggtgaagaagaccaccgacagcgacgccaaggagatctacgagagatgcaccagcctgagcgccgtgcagatcatcaagatcctgaacagctacacccccatcgacgacttcgagaagagagtgacccccagcttcgtgagaaaggtgcaggccctgctgaacagcagagaggacagcagccagctgatgctggacaccaagtacctgttccaggtgaccttccccttcacccccagcccccacgccctggagatgatccagatccccagcagcttcaagctgggcttcctgaacagactgtag

SEQ ID NO: 90045 - DNA, 1122 bp, Artificial Sequence
  Description of Artificial Sequence: Synthetic coding sequence
atgcccagcagcacccccaccgccggcagaacctgggccatctggacccacacctacctgccctggcagaagagacacaccagcagatggcccgacggcaagagcgaggcccaggacctggacctgctgaccctgtacctgaacctgtactgcatcacccccgccgccgcccccgagctgccccccctgtacgtgttcgtgtgcgagctggacagccagagagcccccatccccggcagcgacgcctacaacgagggcgccggcggcgcctacatgagaaacaacagaaaccagagcatcatcgtgagcggcgagagcggcgccggcaagaccgtgagcgccagatacgccatgagatacttcgccaccgtgagcaagagcggcagcaacgcccacgtggaggacaaggtgctggccagcaaccccatcaccgaggccgtgggcaacgccaagaccaccagaaacgacaacagcagcagattcggcaagtacaccgagatcagcttcgacgagcagaaccagatcatcggcgccaacatgagcacctacctgctggagaagagcagagtggtgttccagagcgagaacgagagaaactaccacatcttctaccagctgtgcgccagcgcccagcagagcgagttcaagcacctgaagctgggcagcgccgaggagttcaactacaccagaatgggcggcaacaccgtgatcgagggcgtgaacgacagagccgagatggtggagacccagaagaccttcaccctgctgggcttcaaggaggacttccagatggacgtgttcaagatcctggccgccatcctgcacctgggcaacgtgcagatcaccgccgtgggcaacgagagaagcagcgtgagcgaggacgacagccacctgaaggtgttctgcgagctgctgggcctggagagcggcagagtggcccagtggctgtgcaacagaaagatcgtgaccagcagcgagaccgtggtgaagcccatgaccagaccccaggccgtgaacgccagagacgccctggccaagaagatctacgcccacctgttcgacttcatcgtggagagaatcaaccaggccctgcagttcagcgtgctgaagcccctgatgtag

SEQ ID NO: 90046 - DNA, 321 bp, Artificial Sequence
  Description of Artificial Sequence: Synthetic coding sequence
atgaacccctacaagcagctgcccatctacggcgacgccatcatccacgcctacagcggccagaacatgggcgacatggacccccacatcttcgccgtggccgaggaggcctacaagcagatggccagaaacaacagaaaccagagcatcatcgtgagcggcgagagcggcgccggcaagaccgtgagcgccagatacgccatgagatacttcgccaccgtgagcaagagcggcagcaacgcccacgtggaggacaaggtgctggccagcaaccccatcaccgaggccgtgggcaacgccaagaccaccagaaacgactag

SEQ ID NO: 90047 - DNA, 1293 bp, Artificial Sequence
  Description of Artificial Sequence: Synthetic coding sequence
atggccgtggccgagctgtacacccagtacaacagagtgtggatccccgaccccgaggaggtgtggaagagcgccgagatcgccaaggactacagagtgggcgacaaggtgctgagactgctgctggaggacggcaccgagctggactacagcgtgaaccccgagagcctgccccccctgagaaaccccgacatcctggtgggcgagaacgacctgaccgccctgagctacctgcacgagcccgccgtgctgcacaacctgagaatcagattcgccgagagcaagctgatctacacctacagcggcatcatcctggtggccatgaacccctacaagcagctgcccatctacggcgacgccatcatccacgcctacagcggccagaacatgggcgacatggacccccacatcttcgccgtggccgaggaggcctacaagcagatggccagaaacaacagaaaccagagcatcatcgtgagcggcgagagcggcgccggcaagaccgtgagcgccagatacgccatgagatacttcgccaccgtgagcaagagcggcagcaacgcccacgtggaggacaaggtgctggccagcaaccccatcaccgaggccgtgggcaacgccaagaccaccagaaacgacaacagcagcagattcggcaagtacaccgagatcagcttcgacgagcagaaccagatcatcggcgccaacatgagcacctacctgctggagaagagcagagtggtgttccagagcgagaacgagagaaactaccacatcttctaccagctgtgcgccagcgcccagcagagcgagttcaagcacctgaagctgggcagcgccgaggagttcaactacaccagaatgggcggcaacaccgtgatcgagggcgtgaacgacagagccgagatggtggagacccagaagaccttcaccctgctgggcttcaaggaggacttccagatggacgtgttcaagatcctggccgccatcctgcacctgggcaacgtgcagatcaccgccgtgggcaacgagagaagcagcgtgagcgaggacgacagccacctgaaggtgttctgcgagctgctgggcctggagagcggcagagtggcccagtggctgtgcaacagaaagatcgtgaccagcagcgagaccgtggtgaagcccatgaccagaccccaggccgtgaacgccagagacgccctggccaagaagatctacgcccacctgttcgacttcatcgtggagagaatcaaccaggccctgcagttcagcgtgctgaagcccctgatgtag

SEQ ID NO: 90048 - DNA, 810 bp, Artificial Sequence
  Description of Artificial Sequence: Synthetic coding sequence
atggccgtggccgagctgtacacccagtacaacagagtgtggatccccgaccccgaggaggtgtggaagagcgccgagatcgccaaggactacagagtgggcgacaaggtgctgagactgctgctggaggacggcaccgagctggactacagcgtgaaccccgagagcctgccccccctgagaaaccccgacatcctggtgggcgagaacgacctgaccgccctgagctacctgcacgagcccgccgtgctgcacaacctgagaatcagattcgccgagagcaagctgatctacacctacagcggcatcatcctggtggccatgaacccctacaagcagctgcccatctacggcgacgccatcatccacgcctacagcggccagaacatgggcgacatggacccccacatcttcgccgtggccgaggaggcctacaagcagatggccagaaacaacagaaaccagagcatcatcgtgagcggcgagagcggcgccggcaagaccgtgagcgccagatacgccatgagatacttcgccaccgtgagcaagagcggcagcaacgcccacgtggaggacaaggtgctggccagcaaccccatcaccgaggccgtgggcaacgccaagaccaccagaaacgacaacagcagcagattcggcaagtacaccgagatcagcttcgacgagcagaaccagatcatcggcgccaacatgagcacctacctgctggagaagagcagagtggtgttccagggcgtgcccaagaacctgatcatccaggagtgggaggccatcctgagcctgagagtgtag

SEQ ID NO: 90049 - DNA, 3762 bp, Artificial Sequence
  Description of Artificial Sequence: Synthetic coding sequence
atggaggacggcaagcccgtgtgggccccccaccccaccgacggcttccagatgggcaacatcgtggacatcggccccgacagcctgaccatcgagcccctgaaccagaagggcaagaccttcctggccctgatcaaccaggtgttccccgccgaggaggacagcaagaaggacgtggaggacaactgcagcctgatgtacctgaacgaggccaccctgctgcacaacatcaaggtgagatacagcaaggacagaatctacacctacgtggccaacatcctgatcgccgtgaacccctacttcgacatccccaagatctacagcagcgaggccatcaagagctaccagggcaagagcctgggcaccagacccccccacgtgttcgccatcgccgacaaggccttcagagacatgaaggtgctgaagatgagccagagcatcatcgtgagcggcgagagcggcgccggcaagaccgagaacaccaagttcgtgctgagatacctgaccgagagctacggcaccggccaggacatcgacgacagaatcgtggaggccaaccccctgctggaggccttcggcaacgccaagaccgtgagaaacaacaacagcagcagattcggcaagttcgtggagatccacttcaacgagaagagcagcgtggtgggcggcttcgtgagccactacctgctggagaagagcagaatctgcgtgcagggcaaggaggagagaaactaccacatcttctacagactgtgcgccggcgccagcgaggacatcagagagaagctgcacctgagcagccccgacaacttcagatacctgaacagaggctgcaccagatacttcgccaacaaggagaccgacaagcagatcctgcagaacagaaagagccccgagtacctgaaggccggcagcatgaaggaccccctgctggacgaccacggcgacttcatcagaatgtgcaccgccatgaagaagatcggcctggacgacgaggagaagctggacctgttcagagtggtggccggcgtgctgcacctgggcaacatcgacttcgaggaggccggcagcaccagcggcggctgcaacctgaagaacaagagcgcccagagcctggagtactgcgccgagctgctgggcctggaccaggacgacctgagagtgagcctgaccaccagagtgatgctgaccaccgccggcggcaccaagggcaccgtgatcaaggtgcccctgaaggtggagcaggccaacaacgccagagacgccctggccaagaccgtgtacagccacctgttcgaccacgtggtgaacagagtgaaccagtgcttccccttcgagaccagcagctacttcatcggcgtgctggacatcgccggcttcgagtacttcgagcacaacagcttcgagcagttctgcatcaactactgcaacgagaagctgcagcagttcttcaacgagagaatcctgaaggaggagcaggagctgtaccagaaggagggcctgggcgtgaacgaggtgcactacgtggacaaccaggactgcatcgacctgatcgaggccaagctggtgggcatcctggacatcctggacgaggagaacagactgccccagcccagcgaccagcacttcaccagcgccgtgcaccagaagcacaaggaccacttcagactgaccatccccagaaagagcaagctggccgtgcacagaaacatcagagacgacgagggcttcatcatcagacacttcgccggcgccgtgtgctacgagaccacccagttcgtggagaagaacaacgacgccctgcacatgagcctggagagcctgatctgcgagagcagagacaagttcatcagagagctgttcgagagcagcaccaacaacaacaaggacaccaagcagaaggccggcaagctgagcttcatcagcgtgggcaacaagttcaagacccagctgaacctgctgctggacaagctgagaagcaccggcgccagcttcatcagatgcatcaagcccaacctgaagatgaccagccaccacttcgagggcgcccagatcctgagccagctgcagtgcagcggcatggtgagcgtgctggacctgatgcagggcggctaccccagcagagccagcttccacgagctgtacaacatgtacaagaagtacatgcccgacaagctggccagactggaccccagactgttctgcaaggccctgttcaaggccctgggcctgaacgagaacgactacaagttcggcctgaccaaggtgttcttcagacccggcaagttcgccgagttcgaccagatcatgaagagcgaccccgaccacctggccgagctggtgaagagagtgaaccactggctgacctgcagcagatggaagaaggtgcagtggtgcagcctgagcgtgatcaagctgaagaacaagatcaagtacagagccgaggcctgcatcaagatgcagaagaccatcagaatgtggctgtgcaagagaagacacaagcccagaatcgacggcctggtgaaggtgggcaccctgaagaagagactggacaagttcaacgaggtggtgagcgtgctgaaggacggcaagcccgagatgaacaagcagatcaagaacctggagatcagcatcgacaccctgatggccaagatcaagagcaccatgatgacccaggagcagatccagaaggagtacgacgccctggtgaagagcagcgaggagctgctgagcgccctgcagaagaagaagcagcaggaggaggaggccgagagactgagaagaatccaggaggagatggagaaggagagaaagagaagagaggaggacgagaagagaagaagaaaggaggaggaggagagaagaatgaagctggagatggaggccaagagaaagcaggaggaggaggagagaaagaagagagaggacgacgagaagagaatccaggccgaggtggaggcccagctggccagacagaaggaggaggagagccagcagcaggccgtgctggagcaggagagaagagacagagagctggccctgagaatcgcccagagcgaggccgagctgatcagcgacgaggcccaggccgacctggccctgagaagaggccccgccgtgctggccaccaaggccgccgccggcaccaagaagtacgacctgagcaagtggaagtacgccgagctgagagacaccatcaacaccagctgcgacatcgagctgctggccgcctgcagagaggagttccacagaagactgaaggtgtaccacgcctggaagagcaagaacaagaagagaaacaccgagaccgagcagagagcccccaagagcgtgaccgactacgcccagcagaaccccgccgcccagatccccgccagacagagagagatcgagatgaacagacagcagagattcttcagaatccccttcatcagacccgccgaccagtacaaggacccccagagcaagaagaagggctggtggtacgcccacttcgacggcccctggatcgccagacagatggagctgcaccccgacaagccccccatcctgctggtggccggcaaggacgacatggagatgtgcgagctgaacctggaggagaccggcctgaccagaaagagaggcgccgagatcctgcccagacagttcgaggagatctgggagagatgcggcggcatccagtacctgcagaacgccatcgagagcagacaggccagacccacctacgccaccgccatgctgcagagcctgctgaagtag

SEQ ID NO: 90050 - DNA, 3858 bp, Artificial Sequence
  Description of Artificial Sequence: Synthetic coding sequence
atggaggacggcaagcccgtgtgggccccccaccccaccgacggcttccagatgggcaacatcgtggacatcggccccgacagcctgaccatcgagcccctgaaccagaagggcaagaccttcctggccctgatcaaccaggtgttccccgccgaggaggacagcaagaaggacgtggaggacaactgcagcctgatgtacctgaacgaggccaccctgctgcacaacatcaaggtgagatacagcaaggacagaatctacacctacgtggccaacatcctgatcgccgtgaacccctacttcgacatccccaagatctacagcagcgaggccatcaagagctaccagggcaagagcctgggcaccagacccccccacgtgttcgccatcgccgacaaggccttcagagacatgaaggtgctgaagatgagccagagcatcatcgtgagcggcgagagcggcgccggcaagaccgagaacaccaagttcgtgctgagatacctgaccgagagctacggcaccggccaggacatcgacgacagaatcgtggaggccaaccccctgctggaggccttcggcaacgccaagaccgtgagaaacaacaacagcagcagattcggcaagttcgtggagatccacttcaacgagaagagcagcgtggtgggcggcttcgtgagccactacctgctggagaagagcagaatctgcgtgcagggcaaggaggagagaaactaccacatcttctacagactgtgcgccggcgccagcgaggacatcagagagaagctgcacctgagcagccccgacaacttcagatacctgaacagaggctgcaccagatacttcgccaacaaggagaccgacaagcagatcctgcagaacagaaagagccccgagtacctgaaggccggcagcatgaaggaccccctgctggacgaccacggcgacttcatcagaatgtgcaccgccatgaagaagatcggcctggacgacgaggagaagctggacctgttcagagtggtggccggcgtgctgcacctgggcaacatcgacttcgaggaggccggcagcaccagcggcggctgcaacctgaagaacaagagcgcccagagcctggagtactgcgccgagctgctgggcctggaccaggacgacctgagagtgagcctgaccaccagagtgatgctgaccaccgccggcggcaccaagggcaccgtgatcaaggtgcccctgaaggtggagcaggccaacaacgccagagacgccctggccaagaccgtgtacagccacctgttcgaccacgtggtgaacagagtgaaccagtgcttccccttcgagaccagcagctacttcatcggcgtgctggacatcgccggcttcgagtacttcgagcacaacagcttcgagcagttctgcatcaactactgcaacgagaagctgcagcagttcttcaacgagagaatcctgaaggaggagcaggagctgtaccagaaggagggcctgggcgtgaacgaggtgcactacgtggacaaccaggactgcatcgacctgatcgaggccaagctggtgggcatcctggacatcctggacgaggagaacagactgccccagcccagcgaccagcacttcaccagcgccgtgcaccagaagcacaaggaccacttcagactgaccatccccagaaagagcaagctggccgtgcacagaaacatcagagacgacgagggcttcatcatcagacacttcgccggcgccgtgtgctacgagaccacccagttcgtggagaagaacaacgacgccctgcacatgagcctggagagcctgatctgcgagagcagagacaagttcatcagagagctgttcgagagcagcaccaacaacaacaaggacaccaagcagaaggccggcaagctgagcttcatcagcgtgggcaacaagttcaagacccagctgaacctgctgctggacaagctgagaagcaccggcgccagcttcatcagatgcatcaagcccaacctgaagatgaccagccaccacttcgagggcgcccagatcctgagccagctgcagtgcagcggcatggtgagcgtgctggacctgatgcagggcggctaccccagcagagccagcttccacgagctgtacaacatgtacaagaagtacatgcccgacaagctggccagactggaccccagactgttctgcaaggccctgttcaaggccctgggcctgaacgagaacgactacaagttcggcctgaccaaggtgttcttcagacccggcaagttcgccgagttcgaccagatcatgaagagcgaccccgaccacctggccgagctggtgaagagagtgaaccactggctgacctgcagcagatggaagaaggtgcagtggtgcagcctgagcgtgatcaagctgaagaacaagatcaagtacagagccgaggcctgcatcaagatgcagaagaccatcagaatgtggctgtgcaagagaagacacaagcccagaatcgacggcctggtgaaggtgggcaccctgaagaagagactggacaagttcaacgaggtggtgagcgtgctgaaggacggcaagcccgagatgaacaagcagatcaagaacctggagatcagcatcgacaccctgatggccaagatcaagagcaccatgatgacccaggagcagatccagaaggagtacgacgccctggtgaagagcagcgaggagctgctgagcgccctgcagaagaagaagcagcaggaggaggaggccgagagactgagaagaatccaggaggagatggagaaggagagaaagagaagagaggaggacgagaagagaagaagaaaggaggaggaggagagaagaatgaagctggagatggaggccaagagaaagcaggaggaggaggagagaaagaagagagaggacgacgagaagagaatccaggccgaggtggaggcccagctggccagacagaaggaggaggagagccagcagcaggccgtgctggagcaggagagaagagacagagagctggccctgagaatcgcccagagcgaggccgagctgatcagcgacgaggcccaggccgacctggccctgagaagaaacgacggcaccagacccaagatgacccccgagcagatggccaaggagatgagcgagttcctgagcagaggccccgccgtgctggccaccaaggccgccgccggcaccaagaagtacgacctgagcaagtggaagtacgccgagctgagagacaccatcaacaccagctgcgacatcgagctgctggccgcctgcagagaggagttccacagaagactgaaggtgtaccacgcctggaagagcaagaacaagaagagaaacaccgagaccgagcagagagcccccaagagcgtgaccgactacgacttcgcccccttcctgaacaacagcccccagcagaaccccgccgcccagatccccgccagacagagagagatcgagatgaacagacagcagagattcttcagaatccccttcatcagacccgccgaccagtacaaggacccccagagcaagaagaagggctggtggtacgcccacttcgacggcccctggatcgccagacagatggagctgcaccccgacaagccccccatcctgctggtggccggcaaggacgacatggagatgtgcgagctgaacctggaggagaccggcctgaccagaaagagaggcgccgagatcctgcccagacagttcgaggagatctgggagagatgcggcggcatccagtacctgcagaacgccatcgagagcagacaggccagacccacctacgccaccgccatgctgcagagcctgctgaagtag

SEQ ID NO: 90051 - DNA, 3861 bp, Artificial Sequence
  Description of Artificial Sequence: Synthetic coding sequence
atggaggacggcaagcccgtgtgggccccccaccccaccgacggcttccagatgggcaacatcgtggacatcggccccgacagcctgaccatcgagcccctgaaccagaagggcaagaccttcctggccctgatcaaccaggtgttccccgccgaggaggacagcaagaaggacgtggaggacaactgcagcctgatgtacctgaacgaggccaccctgctgcacaacatcaaggtgagatacagcaaggacagaatctacacctacgtggccaacatcctgatcgccgtgaacccctacttcgacatccccaagatctacagcagcgaggccatcaagagctaccagggcaagagcctgggcaccagacccccccacgtgttcgccatcgccgacaaggccttcagagacatgaaggtgctgaagatgagccagagcatcatcgtgagcggcgagagcggcgccggcaagaccgagaacaccaagttcgtgctgagatacctgaccgagagctacggcaccggccaggacatcgacgacagaatcgtggaggccaaccccctgctggaggccttcggcaacgccaagaccgtgagaaacaacaacagcagcagattcggcaagttcgtggagatccacttcaacgagaagagcagcgtggtgggcggcttcgtgagccactacctgctggagaagagcagaatctgcgtgcagggcaaggaggagagaaactaccacatcttctacagactgtgcgccggcgccagcgaggacatcagagagaagctgcacctgagcagccccgacaacttcagatacctgaacagaggctgcaccagatacttcgccaacaaggagaccgacaagcagatcctgcagaacagaaagagccccgagtacctgaaggccggcagcatgaaggaccccctgctggacgaccacggcgacttcatcagaatgtgcaccgccatgaagaagatcggcctggacgacgaggagaagctggacctgttcagagtggtggccggcgtgctgcacctgggcaacatcgacttcgaggaggccggcagcaccagcggcggctgcaacctgaagaacaagagcgcccagagcctggagtactgcgccgagctgctgggcctggaccaggacgacctgagagtgagcctgaccaccagagtgatgctgaccaccgccggcggcaccaagggcaccgtgatcaaggtgcccctgaaggtggagcaggccaacaacgccagagacgccctggccaagaccgtgtacagccacctgttcgaccacgtggtgaacagagtgaaccagtgcttccccttcgagaccagcagctacttcatcggcgtgctggacatcgccggcttcgagtacttcgagcacaacagcttcgagcagttctgcatcaactactgcaacgagaagctgcagcagttcttcaacgagagaatcctgaaggaggagcaggagctgtaccagaaggagggcctgggcgtgaacgaggtgcactacgtggacaaccaggactgcatcgacctgatcgaggccaagctggtgggcatcctggacatcctggacgaggagaacagactgccccagcccagcgaccagcacttcaccagcgccgtgcaccagaagcacaaggaccacttcagactgaccatccccagaaagagcaagctggccgtgcacagaaacatcagagacgacgagggcttcatcatcagacacttcgccggcgccgtgtgctacgagaccacccagttcgtggagaagaacaacgacgccctgcacatgagcctggagagcctgatctgcgagagcagagacaagttcatcagagagctgttcgagagcagcaccaacaacaacaaggacaccaagcagaaggccggcaagctgagcttcatcagcgtgggcaacaagttcaagacccagctgaacctgctgctggacaagctgagaagcaccggcgccagcttcatcagatgcatcaagcccaacctgaagatgaccagccaccacttcgagggcgcccagatcctgagccagctgcagtgcagcggcatggtgagcgtgctggacctgatgcagggcggctaccccagcagagccagcttccacgagctgtacaacatgtacaagaagtacatgcccgacaagctggccagactggaccccagactgttctgcaaggccctgttcaaggccctgggcctgaacgagaacgactacaagttcggcctgaccaaggtgttcttcagacccggcaagttcgccgagttcgaccagatcatgaagagcgaccccgaccacctggccgagctggtgaagagagtgaaccactggctgacctgcagcagatggaagaaggtgcagtggtgcagcctgagcgtgatcaagctgaagaacaagatcaagtacagagccgaggcctgcatcaagatgcagaagaccatcagaatgtggctgtgcaagagaagacacaagcccagaatcgacggcctggtgaaggtgggcaccctgaagaagagactggacaagttcaacgaggtggtgagcgtgctgaaggacggcaagcccgagatgaacaagcagatcaagaacctggagatcagcatcgacaccctgatggccaagatcaagagcaccatgatgacccaggagcagatccagaaggagtacgacgccctggtgaagagcagcgaggagctgctgagcgccctgcagaagaagaagcagcaggaggaggaggccgagagactgagaagaatccaggaggagatggagaaggagagaaagagaagagaggaggacgagaagagaagaagaaaggaggaggaggagagaagaatgaagctggagatggaggccaagagaaagcaggaggaggaggagagaaagaagagagaggacgacgagaagagaatccaggccgaggtggaggcccagctggccagacagaaggaggaggagagccagcagcaggccgtgctggagcaggagagaagagacagagagctggccctgagaatcgcccagagcgaggccgagctgatcagcgacgaggcccaggccgacctggccctgagaagatacctggacagctaccccgtgaccagcaagaacgacggcaccagacccaagatgacccccgagcagatggccaaggagatgagcgagttcctgagcagaggccccgccgtgctggccaccaaggccgccgccggcaccaagaagtacgacctgagcaagtggaagtacgccgagctgagagacaccatcaacaccagctgcgacatcgagctgctggccgcctgcagagaggagttccacagaagactgaaggtgtaccacgcctggaagagcaagaacaagaagagaaacaccgagaccgagcagagagcccccaagagcgtgaccgactacgcccagcagaaccccgccgcccagatccccgccagacagagagagatcgagatgaacagacagcagagattcttcagaatccccttcatcagacccgccgaccagtacaaggacccccagagcaagaagaagggctggtggtacgcccacttcgacggcccctggatcgccagacagatggagctgcaccccgacaagccccccatcctgctggtggccggcaaggacgacatggagatgtgcgagctgaacctggaggagaccggcctgaccagaaagagaggcgccgagatcctgcccagacagttcgaggagatctgggagagatgcggcggcatccagtacctgcagaacgccatcgagagcagacaggccagacccacctacgccaccgccatgctgcagagcctgctgaagtag

SEQ ID NO: 90052 - DNA, 3789 bp, Artificial Sequence
  Description of Artificial Sequence: Synthetic coding sequence
atggaggacggcaagcccgtgtgggccccccaccccaccgacggcttccagatgggcaacatcgtggacatcggccccgacagcctgaccatcgagcccctgaaccagaagggcaagaccttcctggccctgatcaaccaggtgttccccgccgaggaggacagcaagaaggacgtggaggacaactgcagcctgatgtacctgaacgaggccaccctgctgcacaacatcaaggtgagatacagcaaggacagaatctacacctacgtggccaacatcctgatcgccgtgaacccctacttcgacatccccaagatctacagcagcgaggccatcaagagctaccagggcaagagcctgggcaccagacccccccacgtgttcgccatcgccgacaaggccttcagagacatgaaggtgctgaagatgagccagagcatcatcgtgagcggcgagagcggcgccggcaagaccgagaacaccaagttcgtgctgagatacctgaccgagagctacggcaccggccaggacatcgacgacagaatcgtggaggccaaccccctgctggaggccttcggcaacgccaagaccgtgagaaacaacaacagcagcagattcggcaagttcgtggagatccacttcaacgagaagagcagcgtggtgggcggcttcgtgagccactacctgctggagaagagcagaatctgcgtgcagggcaaggaggagagaaactaccacatcttctacagactgtgcgccggcgccagcgaggacatcagagagaagctgcacctgagcagccccgacaacttcagatacctgaacagaggctgcaccagatacttcgccaacaaggagaccgacaagcagatcctgcagaacagaaagagccccgagtacctgaaggccggcagcatgaaggaccccctgctggacgaccacggcgacttcatcagaatgtgcaccgccatgaagaagatcggcctggacgacgaggagaagctggacctgttcagagtggtggccggcgtgctgcacctgggcaacatcgacttcgaggaggccggcagcaccagcggcggctgcaacctgaagaacaagagcgcccagagcctggagtactgcgccgagctgctgggcctggaccaggacgacctgagagtgagcctgaccaccagagtgatgctgaccaccgccggcggcaccaagggcaccgtgatcaaggtgcccctgaaggtggagcaggccaacaacgccagagacgccctggccaagaccgtgtacagccacctgttcgaccacgtggtgaacagagtgaaccagtgcttccccttcgagaccagcagctacttcatcggcgtgctggacatcgccggcttcgagtacttcgagcacaacagcttcgagcagttctgcatcaactactgcaacgagaagctgcagcagttcttcaacgagagaatcctgaaggaggagcaggagctgtaccagaaggagggcctgggcgtgaacgaggtgcactacgtggacaaccaggactgcatcgacctgatcgaggccaagctggtgggcatcctggacatcctggacgaggagaacagactgccccagcccagcgaccagcacttcaccagcgccgtgcaccagaagcacaaggaccacttcagactgaccatccccagaaagagcaagctggccgtgcacagaaacatcagagacgacgagggcttcatcatcagacacttcgccggcgccgtgtgctacgagaccacccagttcgtggagaagaacaacgacgccctgcacatgagcctggagagcctgatctgcgagagcagagacaagttcatcagagagctgttcgagagcagcaccaacaacaacaaggacaccaagcagaaggccggcaagctgagcttcatcagcgtgggcaacaagttcaagacccagctgaacctgctgctggacaagctgagaagcaccggcgccagcttcatcagatgcatcaagcccaacctgaagatgaccagccaccacttcgagggcgcccagatcctgagccagctgcagtgcagcggcatggtgagcgtgctggacctgatgcagggcggctaccccagcagagccagcttccacgagctgtacaacatgtacaagaagtacatgcccgacaagctggccagactggaccccagactgttctgcaaggccctgttcaaggccctgggcctgaacgagaacgactacaagttcggcctgaccaaggtgttcttcagacccggcaagttcgccgagttcgaccagatcatgaagagcgaccccgaccacctggccgagctggtgaagagagtgaaccactggctgacctgcagcagatggaagaaggtgcagtggtgcagcctgagcgtgatcaagctgaagaacaagatcaagtacagagccgaggcctgcatcaagatgcagaagaccatcagaatgtggctgtgcaagagaagacacaagcccagaatcgacggcctggtgaaggtgggcaccctgaagaagagactggacaagttcaacgaggtggtgagcgtgctgaaggacggcaagcccgagatgaacaagcagatcaagaacctggagatcagcatcgacaccctgatggccaagatcaagagcaccatgatgacccaggagcagatccagaaggagtacgacgccctggtgaagagcagcgaggagctgctgagcgccctgcagaagaagaagcagcaggaggaggaggccgagagactgagaagaatccaggaggagatggagaaggagagaaagagaagagaggaggacgagaagagaagaagaaaggaggaggaggagagaagaatgaagctggagatggaggccaagagaaagcaggaggaggaggagagaaagaagagagaggacgacgagaagagaatccaggccgaggtggaggcccagctggccagacagaaggaggaggagagccagcagcaggccgtgctggagcaggagagaagagacagagagctggccctgagaatcgcccagagcgaggccgagctgatcagcgacgaggcccaggccgacctggccctgagaagaggccccgccgtgctggccaccaaggccgccgccggcaccaagaagtacgacctgagcaagtggaagtacgccgagctgagagacaccatcaacaccagctgcgacatcgagctgctggccgcctgcagagaggagttccacagaagactgaaggtgtaccacgcctggaagagcaagaacaagaagagaaacaccgagaccgagcagagagcccccaagagcgtgaccgactacgacttcgcccccttcctgaacaacagcccccagcagaaccccgccgcccagatccccgccagacagagagagatcgagatgaacagacagcagagattcttcagaatccccttcatcagacccgccgaccagtacaaggacccccagagcaagaagaagggctggtggtacgcccacttcgacggcccctggatcgccagacagatggagctgcaccccgacaagccccccatcctgctggtggccggcaaggacgacatggagatgtgcgagctgaacctggaggagaccggcctgaccagaaagagaggcgccgagatcctgcccagacagttcgaggagatctgggagagatgcggcggcatccagtacctgcagaacgccatcgagagcagacaggccagacccacctacgccaccgccatgctgcagagcctgctgaagtag

SEQ ID NO: 90053 - DNA, 3888 bp, Artificial Sequence
  Description of Artificial Sequence: Synthetic coding sequence
atggaggacggcaagcccgtgtgggccccccaccccaccgacggcttccagatgggcaacatcgtggacatcggccccgacagcctgaccatcgagcccctgaaccagaagggcaagaccttcctggccctgatcaaccaggtgttccccgccgaggaggacagcaagaaggacgtggaggacaactgcagcctgatgtacctgaacgaggccaccctgctgcacaacatcaaggtgagatacagcaaggacagaatctacacctacgtggccaacatcctgatcgccgtgaacccctacttcgacatccccaagatctacagcagcgaggccatcaagagctaccagggcaagagcctgggcaccagacccccccacgtgttcgccatcgccgacaaggccttcagagacatgaaggtgctgaagatgagccagagcatcatcgtgagcggcgagagcggcgccggcaagaccgagaacaccaagttcgtgctgagatacctgaccgagagctacggcaccggccaggacatcgacgacagaatcgtggaggccaaccccctgctggaggccttcggcaacgccaagaccgtgagaaacaacaacagcagcagattcggcaagttcgtggagatccacttcaacgagaagagcagcgtggtgggcggcttcgtgagccactacctgctggagaagagcagaatctgcgtgcagggcaaggaggagagaaactaccacatcttctacagactgtgcgccggcgccagcgaggacatcagagagaagctgcacctgagcagccccgacaacttcagatacctgaacagaggctgcaccagatacttcgccaacaaggagaccgacaagcagatcctgcagaacagaaagagccccgagtacctgaaggccggcagcatgaaggaccccctgctggacgaccacggcgacttcatcagaatgtgcaccgccatgaagaagatcggcctggacgacgaggagaagctggacctgttcagagtggtggccggcgtgctgcacctgggcaacatcgacttcgaggaggccggcagcaccagcggcggctgcaacctgaagaacaagagcgcccagagcctggagtactgcgccgagctgctgggcctggaccaggacgacctgagagtgagcctgaccaccagagtgatgctgaccaccgccggcggcaccaagggcaccgtgatcaaggtgcccctgaaggtggagcaggccaacaacgccagagacgccctggccaagaccgtgtacagccacctgttcgaccacgtggtgaacagagtgaaccagtgcttccccttcgagaccagcagctacttcatcggcgtgctggacatcgccggcttcgagtacttcgagcacaacagcttcgagcagttctgcatcaactactgcaacgagaagctgcagcagttcttcaacgagagaatcctgaaggaggagcaggagctgtaccagaaggagggcctgggcgtgaacgaggtgcactacgtggacaaccaggactgcatcgacctgatcgaggccaagctggtgggcatcctggacatcctggacgaggagaacagactgccccagcccagcgaccagcacttcaccagcgccgtgcaccagaagcacaaggaccacttcagactgaccatccccagaaagagcaagctggccgtgcacagaaacatcagagacgacgagggcttcatcatcagacacttcgccggcgccgtgtgctacgagaccacccagttcgtggagaagaacaacgacgccctgcacatgagcctggagagcctgatctgcgagagcagagacaagttcatcagagagctgttcgagagcagcaccaacaacaacaaggacaccaagcagaaggccggcaagctgagcttcatcagcgtgggcaacaagttcaagacccagctgaacctgctgctggacaagctgagaagcaccggcgccagcttcatcagatgcatcaagcccaacctgaagatgaccagccaccacttcgagggcgcccagatcctgagccagctgcagtgcagcggcatggtgagcgtgctggacctgatgcagggcggctaccccagcagagccagcttccacgagctgtacaacatgtacaagaagtacatgcccgacaagctggccagactggaccccagactgttctgcaaggccctgttcaaggccctgggcctgaacgagaacgactacaagttcggcctgaccaaggtgttcttcagacccggcaagttcgccgagttcgaccagatcatgaagagcgaccccgaccacctggccgagctggtgaagagagtgaaccactggctgacctgcagcagatggaagaaggtgcagtggtgcagcctgagcgtgatcaagctgaagaacaagatcaagtacagagccgaggcctgcatcaagatgcagaagaccatcagaatgtggctgtgcaagagaagacacaagcccagaatcgacggcctggtgaaggtgggcaccctgaagaagagactggacaagttcaacgaggtggtgagcgtgctgaaggacggcaagcccgagatgaacaagcagatcaagaacctggagatcagcatcgacaccctgatggccaagatcaagagcaccatgatgacccaggagcagatccagaaggagtacgacgccctggtgaagagcagcgaggagctgctgagcgccctgcagaagaagaagcagcaggaggaggaggccgagagactgagaagaatccaggaggagatggagaaggagagaaagagaagagaggaggacgagaagagaagaagaaaggaggaggaggagagaagaatgaagctggagatggaggccaagagaaagcaggaggaggaggagagaaagaagagagaggacgacgagaagagaatccaggccgaggtggaggcccagctggccagacagaaggaggaggagagccagcagcaggccgtgctggagcaggagagaagagacagagagctggccctgagaatcgcccagagcgaggccgagctgatcagcgacgaggcccaggccgacctggccctgagaagatacctggacagctaccccgtgaccagcaagaacgacggcaccagacccaagatgacccccgagcagatggccaaggagatgagcgagttcctgagcagaggccccgccgtgctggccaccaaggccgccgccggcaccaagaagtacgacctgagcaagtggaagtacgccgagctgagagacaccatcaacaccagctgcgacatcgagctgctggccgcctgcagagaggagttccacagaagactgaaggtgtaccacgcctggaagagcaagaacaagaagagaaacaccgagaccgagcagagagcccccaagagcgtgaccgactacgacttcgcccccttcctgaacaacagcccccagcagaaccccgccgcccagatccccgccagacagagagagatcgagatgaacagacagcagagattcttcagaatccccttcatcagacccgccgaccagtacaaggacccccagagcaagaagaagggctggtggtacgcccacttcgacggcccctggatcgccagacagatggagctgcaccccgacaagccccccatcctgctggtggccggcaaggacgacatggagatgtgcgagctgaacctggaggagaccggcctgaccagaaagagaggcgccgagatcctgcccagacagttcgaggagatctgggagagatgcggcggcatccagtacctgcagaacgccatcgagagcagacaggccagacccacctacgccaccgccatgctgcagagcctgctgaagtag

SEQ ID NO: 90054 - DNA, 525 bp, Artificial Sequence
  Description of Artificial Sequence: Synthetic coding sequence
aagagaagagaggaggacgagaagagaagaagaaaggaggaggaggagagaagaatgaagctggagatggaggccaagagaaagcaggaggaggaggagagaaagaagagagaggacgacgagaagagaatccaggccgaggtggaggcccagctggccagacagaaggaggaggagagccagcagcaggccgtgctggagcaggagagaagagacagagagctggccctgagaatcgcccagagcgaggccgagctgatcagcgacgaggcccaggccgacctggccctgagaagcctggacagctaccccgtgaccagcaagaacgacggcaccagacccaagatgacccccggccccgccgtgctggccaccaaggccgccgccggcaccaagaagtacgacctgagcaagtggaagtacgccgagctgagagacaccatcaacaccagctgcgacatcgagctgctggccgcctgcagagaggagttccacagaagactgaaggtgtaccacgcctggtag

SEQ ID NO: 90055 - DNA, 6276 bp, Artificial Sequence
  Description of Artificial Sequence: Synthetic coding sequence
gccctgctgcagaagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagagacgagatctactgccagatcagcaagcagctgacccacaaccccagcaagagcagctacgccagaggctggatcctggtgagcctgtgcgtgggctgcttcgcccccagcgagaagttcgtgaagtacctgagaaacttcatccacggcggcccccccggctacgccccctactgcgaggagagactgagaagaaccttcgtgaacggcaccagaacccagccccccagctggctggagctgcaggccaccaagagcaagaagcccatcatgctgcccgtgaccttcatggacggcaccaccaagaccctgctgaccgacagcgccaccaccgccaaggagctgtgcaacgccctggccgacaagatcagcctgaaggacagattcggcttcagcctgtacatcgccctgttcgacaaggtgagcagcctgggcagcggcagcgaccacgtgatggacgccatcagccagtgcgagcagtacgccaaggagcagggcgcccaggagagaaacgccccctggagactgttcttcagaaaggaggtgttcaccccctggcacagccccagcgaggacaacgtggccaccaacctgatctaccagcaggtggtgagaggcgtgaagttcggcgagtacagatgcgagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagagagtgcagagtgtggctgagcctgggctgcagcgacctgggctgcgccgccccccacagcggctgggccggcctgacccccgccggcccctgcagcccctgctggagctgcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgaggtgaagcagaccaccgagcccaacttccccgagatcctgctgatcgccatcaacaagtacggcgtgagcctgatcgaccccaagaccaaggacatcctgaccacccaccccttcaccaagatcagcaactggagcagcggcaacacctacttccacatcaccatcggcaacctggtgagaggcagcaagctgctgtgcgagaccagcctgggctacaagatggacgacctgctgaccagctacatcagccagatgctgaccgccatgagcaagcagagaggcagcagaagcggcaagtag

SEQ ID NO: 90056 - DNA, 6555 bp, Artificial Sequence
  Description of Artificial Sequence: Synthetic coding sequence
gccctgctgcagaagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatgggcaactgcatcacctgcgagggcagagtggacagccaggagtacgccaacatcagaagcgccatgaaggtgctgatgttcaccgacaccgagaactgggagatcagcaagctgctggccgccatcctgcacctgggcaacctgcagtacgaggccagaaccttcgagaacctggacgcctgcgaggtgctgttcagccccagcctggccaccgccgccagcctgctggaggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagggcaccgacaccaccatgctgcacaagctgaacagccagcacaagctgaacgccaactacatcccccccaagaacaaccacgagacccagttcggcatcaaccacttcgccggcatcgtgtactacgagacccagggcttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggtgaccaagagactgcacgacggcgagagcaccgtgcagggcaacagcatgctggaggacagacccaccagcaacctggagaagctgcacttcatcatcggcaacggcatcctgagacccgccctgagagacgagatctactgccagatcagcaagcagctgacccacaaccccagcaagagcagctacgccagaggctggatcctggtgagcctgtgcgtgggctgcttcgcccccagcgagaagttcgtgaagtacctgagaaacttcatccacggcggcccccccggctacgccccctactgcgaggagagactgagaagaaccttcgtgaacggcaccagaacccagccccccagctggctggagctgcaggccaccaagagcaagaagcccatcatgctgcccgtgaccttcatggacggcaccaccaagaccctgctgaccgacagcgccaccaccgccaaggagctgtgcaacgccctggccgacaagatcagcctgaaggacagattcggcttcagcctgtacatcgccctgttcgacaaggtgagcagcctgggcagcggcagcgaccacgtgatggacgccatcagccagtgcgagcagtacgccaaggagcagggcgcccaggagagaaacgccccctggagactgttcttcagaaaggaggtgttcaccccctggcacagccccagcgaggacaacgtggccaccaacctgatctaccagcaggtggtgagaggcgtgaagttcggcgagtacagatgcgagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagagagtgcagagtgtggctgagcctgggctgcagcgacctgggctgcgccgccccccacagcggctgggccggcctgacccccgccggcccctgcagcccctgctggagctgcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgaggtgaagcagaccaccgagcccaacttccccgagatcctgctgatcgccatcaacaagtacggcgtgagcctgatcgaccccaagaccaaggacatcctgaccacccaccccttcaccaagatcagcaactggagcagcggcaacacctacttccacatcaccatcggcaacctggtgagaggcagcaagctgctgtgcgagaccagcctgggctacaagatggacgacctgctgaccagctacatcagccagatgctgaccgccatgagcaagcagagaggcagcagaagcggcaagtag

SEQ ID NO: 90057 - DNA, 3609 bp, Artificial Sequence
  Description of Artificial Sequence: Synthetic coding sequence
gccctgctgcagaagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatgggcaactgcatcacctgcgagggcagagtggacagccaggagtacgccaacatcagaagcgccatgaaggtgctgatgttcaccgacaccgagaactgggagatcagcaagctgctggccgccatcctgcacctgggcaacctgcagtacgaggccagaaccttcgagaacctggacgcctgcgaggtgctgttcagccccagcctggccaccgccgccagcctgctggaggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagggcaccgacaccaccatgctgcacaagctgaacagccagcacaagctgaacgccaactacatcccccccaagaacaaccacgagacccagttcggcatcaaccacttcgccggcatcgtgtactacgagacccagggcttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggtgctgcaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagaagcgtgccccccgagagcctgctggtggccgagtggtgcctgtgccagcccagcaagagactgagccaggcccccggcttcggcttcgccgccagctag

SEQ ID NO: 90058 - DNA, 6645 bp, Artificial Sequence
  Description of Artificial Sequence: Synthetic coding sequence
gccctgctgcagaagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatgggcaactgcatcacctgcgagggcagagtggacagccaggagtacgccaacatcagaagcgccatgaaggtgctgatgttcaccgacaccgagaactgggagatcagcaagctgctggccgccatcctgcacctgggcaacctgcagtacgaggccagaaccttcgagaacctggacgcctgcgaggtgctgttcagccccagcctggccaccgccgccagcctgctggaggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagggcaccgacaccaccatgctgcacaagctgaacagccagcacaagctgaacgccaactacatcccccccaagaacaaccacgagacccagttcggcatcaaccacttcgccggcatcgtgtactacgagacccagggcttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagagacgagatctactgccagatcagcaagcagctgacccacaaccccagcaagagcagctacgccagaggctggatcctggtgagcctgtgcgtgggctgcttcgcccccagcgagaagttcgtgaagtacctgagaaacttcatccacggcggcccccccggctacgccccctactgcgaggagagactgagaagaaccttcgtgaacggcaccagaacccagccccccagctggctggagctgcaggccaccaagagcaagaagcccatcatgctgcccgtgaccttcatggacggcaccaccaagaccctgctgaccgacagcgccaccaccgccaaggagctgtgcaacgccctggccgacaagatcagcctgaaggacagattcggcttcagcctgtacatcgccctgttcgacaaggtgagcagcctgggcagcggcagcgaccacgtgatggacgccatcagccagtgcgagcagtacgccaaggagcagggcgcccaggagagaaacgccccctggagactgttcttcagaaaggaggtgttcaccccctggcacagccccagcgaggacaacgtggccaccaacctgatctaccagcaggtggtgagaggcgtgaagttcggcgagtacagatgcgagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagagagtgcagagtgtggctgagcctgggctgcagcgacctgggctgcgccgccccccacagcggctgggccggcctgacccccgccggcccctgcagcccctgctggagctgcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgaggtgaagcagaccaccgagcccaacttccccgagatcctgctgatcgccatcaacaagtacggcgtgagcctgatcgaccccaagaccaaggacatcctgaccacccaccccttcaccaagatcagcaactggagcagcggcaacacctacttccacatcaccatcggcaacctggtgagaggcagcaagctgctgtgcgagaccagcctgggctacaagatggacgacctgctgaccagctacatcagccagatgctgaccgccatgagcaagcagagaggcagcagaagcggcaagtag

SEQ ID NO: 90059 - DNA, 6648 bp, Artificial Sequence
  Description of Artificial Sequence: Synthetic coding sequence
atggtgatcctgcagcagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatgggcaactgcatcacctgcgagggcagagtggacagccaggagtacgccaacatcagaagcgccatgaaggtgctgatgttcaccgacaccgagaactgggagatcagcaagctgctggccgccatcctgcacctgggcaacctgcagtacgaggccagaaccttcgagaacctggacgcctgcgaggtgctgttcagccccagcctggccaccgccgccagcctgctggaggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagggcaccgacaccaccatgctgcacaagctgaacagccagcacaagctgaacgccaactacatcccccccaagaacaaccacgagacccagttcggcatcaaccacttcgccggcatcgtgtactacgagacccagggcttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagagacgagatctactgccagatcagcaagcagctgacccacaaccccagcaagagcagctacgccagaggctggatcctggtgagcctgtgcgtgggctgcttcgcccccagcgagaagttcgtgaagtacctgagaaacttcatccacggcggcccccccggctacgccccctactgcgaggagagactgagaagaaccttcgtgaacggcaccagaacccagccccccagctggctggagctgcaggccaccaagagcaagaagcccatcatgctgcccgtgaccttcatggacggcaccaccaagaccctgctgaccgacagcgccaccaccgccaaggagctgtgcaacgccctggccgacaagatcagcctgaaggacagattcggcttcagcctgtacatcgccctgttcgacaaggtgagcagcctgggcagcggcagcgaccacgtgatggacgccatcagccagtgcgagcagtacgccaaggagcagggcgcccaggagagaaacgccccctggagactgttcttcagaaaggaggtgttcaccccctggcacagccccagcgaggacaacgtggccaccaacctgatctaccagcaggtggtgagaggcgtgaagttcggcgagtacagatgcgagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagagagtgcagagtgtggctgagcctgggctgcagcgacctgggctgcgccgccccccacagcggctgggccggcctgacccccgccggcccctgcagcccctgctggagctgcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgaggtgaagcagaccaccgagcccaacttccccgagatcctgctgatcgccatcaacaagtacggcgtgagcctgatcgaccccaagaccaaggacatcctgaccacccaccccttcaccaagatcagcaactggagcagcggcaacacctacttccacatcaccatcggcaacctggtgagaggcagcaagctgctgtgcgagaccagcctgggctacaagatggacgacctgctgaccagctacatcagccagatgctgaccgccatgagcaagcagagaggcagcagaagcggcaagtag

SEQ ID NO: 90060 - DNA, 3537 bp, Artificial Sequence
  Description of Artificial Sequence: Synthetic coding sequence
atggtgatcctgcagcagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatgggcaactgcatcacctgcgagggcagagtggacagccaggagtacgccaacatcagaagcgccatgaaggtgctgatgttcaccgacaccgagaactgggagatcagcaagctgctggccgccatcctgcacctgggcaacctgcagtacgaggccagaaccttcgagaacctggacgcctgcgaggtgctgttcagccccagcctggccaccgccgccagcctgctggaggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagggcaccgacaccaccatgctgcacaagctgaacagccagcacaagctgaacgccaactacatcccccccaagaacaaccacgagacccagttcggcatcaaccacttcgccggcatcgtgtactacgagacccagggcttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagaagcgtgcccggcggcggcgacaccagagcctag

SEQ ID NO: 90061 - DNA, 6528 bp, Artificial Sequence
  Description of Artificial Sequence: Synthetic coding sequence
atggtgatcctgcagcagggcgaccacgtgtggatggacctgagactgggccaggagttcgacgtgcccatcggcgccgtggtgaagctgtgcgacagcggccaggtgcaggtggtggacgacgaggacaacgagcactggatcagcccccagaacgccacccacatcaagcccatgcaccccaccagcgtgcacggcgtggaggacatgatcagactgggcgacctgaacgaggccggcatcctgagaaacctgctgatcagatacagagaccacctgatctacacctacaccggcagcatcctggtggccgtgaacccctaccagctgctgagcatctacagccccgagcacatcagacagtacaccaacaagaagatcggcgagatgcccccccacatcttcgccatcgccgacaactgctacttcaacatgaagagaaacagcagagaccagtgctgcatcatcagcggcgagagcggcgccggcaagaccgagagcaccaagctgatcctgcagttcctggccgccatcagcggccagcacagctggatcgagcagcaggtgctggaggccacccccatcctggaggccttcggcaacgccaagaccatcagaaacgacaacagcagcagattcggcaagtacatcgacatccacttcaacaagagaggcgccatcgagggcgccaagatcgagcagtacctgctggagaagagcagagtgtgcagacaggccctggacgagagaaactaccacgtgttctactgcatgctggagggcatgagcgaggaccagaagaagaagctgggcctgggccaggccagcgactacaactacctggccatgggcaactgcatcacctgcgagggcagagtggacagccaggagtacgccaacatcagaagcgccatgaaggtgctgatgttcaccgacaccgagaactgggagatcagcaagctgctggccgccatcctgcacctgggcaacctgcagtacgaggccagaaccttcgagaacctggacgcctgcgaggtgctgttcagccccagcctggccaccgccgccagcctgctggaggtgaacccccccgacctgatgagctgcctgaccagcagaaccctgatcaccagaggcgagaccgtgagcacccccctgagcagagagcaggccctggacgtgagagacgccttcgtgaagggcatctacggcagactgttcgtgtggatcgtggacaagatcaacgccgccatctacaagccccccagccaggacgtgaagaacagcagaagaagcatcggcctgctggacatcttcggcttcgagaacttcgccgtgaacagcttcgagcagctgtgcatcaacttcgccaacgagcacctgcagcagttcttcgtgagacacgtgttcaagctggagcaggaggagtacgacctggagagcatcgactggctgcacatcgagttcaccgacaaccaggacgccctggacatgatcgccaacaagcccatgaacatcatcagcctgatcgacgaggagagcaagttccccaagggcaccgacaccaccatgctgcacaagctgaacagccagcacaagctgaacgccaactacatcccccccaagaacaaccacgagacccagttcggcatcaaccacttcgccggcatcgtgtactacgagacccagggcttcctggagaagaacagagacaccctgcacggcgacatcatccagctggtgcacagcagcagaaacaagttcatcaagcagatcttccaggccgacgtggccatgggcgccgagaccagaaagagaagccccaccctgagcagccagttcaagagaagcctggagctgctgatgagaaccctgggcgcctgccagcccttcttcgtgagatgcatcaagcccaacgagttcaagaagcccatgctgttcgacagacacctgtgcgtgagacagctgagatacagcggcatgatggagaccatcagaatcagaagagccggctaccccatcagatacagcttcgtggagttcgtggagagatacagagtgctgctgcccggcgtgaagcccgcctacaagcagggcgacctgagaggcacctgccagagaatggccgaggccgtgctgggcacccacgacgactggcagatcggcaagaccaagatcttcctgaaggaccaccacgacatgctgctggaggtggagagagacaaggccatcaccgacagagtgatcctgctgcagaaggtgatcagaggcttcaaggacagaagcaacttcctgaagctgaagaacgccgccaccctgatccagagacactggagaggccacaactgcagaaagaactacggcctgatgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagagacgagatctactgccagatcagcaagcagctgacccacaaccccagcaagagcagctacgccagaggctggatcctggtgagcctgtgcgtgggctgcttcgcccccagcgagaagttcgtgaagtacctgagaaacttcatccacggcggcccccccggctacgccccctactgcgaggagagactgagaagaaccttcgtgaacggcaccagaacccagccccccagctggctggagctgcaggccaccaagagcaagaagcccatcatgctgcccgtgaccttcatggacggcaccaccaagaccctgctgaccgacagcgccaccaccgccaaggagctgtgcaacgccctggccgacaagatcagcctgaaggacagattcggcttcagcctgtacatcgccctgttcgacaaggtgagcagcctgggcagcggcagcgaccacgtgatggacgccatcagccagtgcgagcagtacgccaaggagcagggcgcccaggagagaaacgccccctggagactgttcttcagaaaggaggtgttcaccccctggcacagccccagcgaggacaacgtggccaccaacctgatctaccagcaggtggtgagaggcgtgaagttcggcgagtacagatgcgagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgagcagaccaccgagcccaacttccccgagatcctgctgatcgccatcaacaagtacggcgtgagcctgatcgaccccaagaccaaggacatcctgaccacccaccccttcaccaagatcagcaactggagcagcggcaacacctacttccacatcaccatcggcaacctggtgagaggcagcaagctgctgtgcgagaccagcctgggctacaagatggacgacctgctgaccagctacatcagccagatgctgaccgccatgagcaagcagagaggcagcagaagcggcaagtag

SEQ ID NO: 90062 - DNA, 2532 bp, Artificial Sequence
  Description of Artificial Sequence: Synthetic coding sequence
ggcctgagcgtgcagtggctgctggacggcctggcctgcttcttcgccagcctgcacgtgcccctgggcagagtgcagctgcacgccagcgccagaggcatccaggagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgaggtgaaggtgcaccacggcctgctgagagccgaggaggagggcaacagagccctgatcaagcacagagacagcagcctgggcctgtgggagagagccatggccctggacacctgccccggcgagggcagaagagccgcccccagcgccctgagccagctgagcgtgctggccggcgtgagccccggcgacagaggcaccagaagaagcagcgcctggcagtggagacagacctgcaagcaggccggcgtgatggaggacggcctgtgcagcgacaccggcgagcccagccccagatggcagagcagcggcggcagcgccggctgcgagaaggccagctag

SEQ ID NO: 90063 - DNA, 4167 bp, Artificial Sequence
  Description of Artificial Sequence: Synthetic coding sequence
atgagactgggcttcctgagactgcaggccctgcacagaagcagaaagctgcaccagcagtacagactggccagacagagaatcatccagttccaggccagatgcagagcctacctggtgagaaaggccttcagacacagactgtgggccgtgctgaccgtgcaggcctacgccagaggcatgatcgccagaagactgcaccagagactgagagccgagtacctgtggagactggaggccgagaagatgagactggccgaggaggagaagctgagaaaggagatgagcgccaagaaggccaaggaggaggccgagagaaagcaccaggagagactggcccagctggccagagaggacgccgagagagagctgaaggagaaggaggccgccagaagaaagaaggagctgctggagcagatggagagagccagacacgagcccgtgaaccacagcgacatggtggacaagatgttcggcttcctgggcaccagcggcggcctgcccggccaggagggccaggcccccagcggcttcgaggacctggagagaggcagaagagagatggtggaggaggacctggacgccgccctgcccctgcccgacgaggacgaggaggacctgagcgagtacaagttcgccaagttcgccgccacctacttccagggcaccaccacccacagctacaccagaagacccctgaagcagcccctgctgtaccacgacgacgagggcgaccagctggccgccctggccgtgtggatcaccatcctgagattcatgggcgacctgcccgagcccaagtaccacaccgccatgagcgacggcagcgagaagatccccgtgatgaccaagatctacgagaccctgggcaagaagacctacaagagagagctgcaggccctgcagggcgagggcgaggcccagctgcccgagggccagaagaagagcagcgtgagacacaagctggtgcacctgaccctgaagaagaagagcaagctgaccgaggaggtgaccaagagactgcacgacggcgagagcaccgtgcagggcaacagcatgctggaggacagacccaccagcaacctggagaagctgcacttcatcatcggcaacggcatcctgagacccgccctgagagacgagatctactgccagatcagcaagcagctgacccacaaccccagcaagagcagctacgccagaggctggatcctggtgagcctgtgcgtgggctgcttcgcccccagcgagaagttcgtgaagtacctgagaaacttcatccacggcggcccccccggctacgccccctactgcgaggagagactgagaagaaccttcgtgaacggcaccagaacccagccccccagctggctggagctgcaggccaccaagagcaagaagcccatcatgctgcccgtgaccttcatggacggcaccaccaagaccctgctgaccgacagcgccaccaccgccaaggagctgtgcaacgccctggccgacaagatcagcctgaaggacagattcggcttcagcctgtacatcgccctgttcgacaaggtgagcagcctgggcagcggcagcgaccacgtgatggacgccatcagccagtgcgagcagtacgccaaggagcagggcgcccaggagagaaacgccccctggagactgttcttcagaaaggaggtgttcaccccctggcacagccccagcgaggacaacgtggccaccaacctgatctaccagcaggtggtgagaggcgtgaagttcggcgagtacagatgcgagaaggaggacgacctggccgagctggccagccagcagtacttcgtggactacggcagcgagatgatcctggagagactgctgaacctggtgcccacctacatccccgacagagagatcacccccctgaagaccctggagaagtgggcccagctggccatcgccgcccacaagaagggcatctacgcccagagaagaaccgacgcccagaaggtgaaggaggacgtggtgagctacgccagattcaagtggcccctgctgttcagcagattctacgaggcctacaagttcagcggccccagcctgcccaagaacgacgtgatcgtggccgtgaactggaccggcgtgtacttcgtggacgagcaggagcaggtgctgctggagctgagcttccccgagatcatggccgtgagcagcagcagaggcgccaagaccaccgcccccagcttcaccctggccaccatcaagggcgacgagtacaccttcaccagcagcaacgccgaggacatcagagacctggtggtgaccttcctggagggcctgagaaagagaagcaagtacgtggtggccctgcaggacaaccccaaccccgccggcgaggagagcggcttcctgagcttcgccaagggcgacctgatcatcctggaccacgacaccggcgagcaggtgatgaacagcggctgggccaacggcatcaacgagagaaccaagcagagaggcgacttccccaccgacagcgtgtacgtgatgcccaccgtgaccatgccccccagagagatcgtggccctggtgaccatgacccccgaccagagacaggacgtggtgagactgctgcagctgagaaccgccgagcccgaggtgagagccaagccctacaccctggaggagttcagctacgactacttcagacccccccccaagcacaccctgagcagagtgatggtgagcaaggccagaggcaaggacagactgtggagccacaccagagagcccctgaagcaggccctgctgaagaagctgctgggcagcgaggagctgagccaggaggcctgcctggccttcatcgccgtgctgaagtacatgggcgactaccccagcaagagaaccagaagcgtgaacgagctgaccgaccagatcttcgagggccccctgaaggccgagcccctgaaggacgaggcctacgtgcagatcctgaagcagctgaccgacaaccacatcagatacagcgaggagagaggctgggagctgctgtggctgtgcaccggcctgttcccccccagcaacatcctgctgccccacgtgcagagattcctgcagagcagaaagcactgccccctggccatcgactgcctgcagagactgcagaaggccctgagaaacggcagcagaaagtaccccccccacctggtggaggtggaggccatccagcacaagaccacccagatcttccacaaggtgtacttccccgacgacaccgacgaggccttcgaggtggagagcagcaccaaggccaaggacttctgccagaacatcgccaccagactgctgctgaagagcagcgagggcttcagcctgttcgtgaagatcgccgacaaggtgctgagcgtgcccgagaacgacttcttcttcgacttcgtgagacacctgaccgactggatcaagaaggccagacccatcaaggacggcatcgtgcccagcctgacctaccaggtgttcttcatgaagaagctgtggaccaccaccgtgcccggcaaggaccccatggccgacagcatcttccactactaccaggagctgcccaagtacctgagaggctaccacaagtgcaccagagaggaggtgctgcagctgggcgccctgatctacagagtgaagttcgaggaggacaagagctacttccccagcatccccaagctgctgagagagctggtgccccaggacctgatcagacaggtgagccccgacgactggaagagaagcatcgtggcctacttcaacaagcacgccggcaagagcaaggaggaggccaagctggccttcctgaagctgatcttcaagtggcccaccttcggcagcgccttcttcgaggtgaagcagaccaccgagcccaacttccccgagatcctgctgatcgccatcaacaagtacggcgtgagcctgatcgaccccaagaccaaggacatcctgaccacccaccccttcaccaagatcagcaactggagcagcggcaacacctacttccacatcaccatcggcaacctggtgagaggcagcaagctgctgtgcgagaccagcctgggctacaagatggacgacctgctgaccagctacatcagccagatgctgaccgccatgagcaagcagagaggcagcagaagcggcaagtag

SEQ ID NO: 90064 - DNA, 2580 bp, Artificial Sequence
  Description of Artificial Sequence: Synthetic coding sequence
atgggcagaaagctggacctgagcggcctgaccgacgacgagaccgagcacgtgctgcaggtggtgcagagagacttcaacctgagaaagaaggaggaggagagactgagcgagctgaagcagaagctggacgaggagggcagcaagtgcagcatcctgagcaagcaccagcagttcgtggagcactgctgcatgagatgctgcagccccttcaccttcctggtgaacaccaagagacagtgcggcgactgcaagttcaacgtgtgcaagagctgctgcagctaccagaagcacgagaaggcctgggtgtgctgcgtgtgccagcaggccagactgctgagagcccagagcctggagtggttctacaacaacgtgaagagcagattcaagagattcggcagcgccaaggtgctgaagaacctgtacagaaagcacagactggagagcggcgcctgcttcgacatcctgggcggcagcctgttcgagagcaacctggagaacgagggcagcatcagcggcagcgacagcaccttctacagacagagcgagggccacagcgtgatggacaccctggccgtggccctgagagtggccgaggaggccatcgaggaggccatcagcaaggccgaggcctacggcgacagcctggacaagcagaacgaggccagctacctgagagaccacaaggaggagctgaccgaggagctggccaccaccatcctgcagaagatcatcagaaagcagaagagcaagagcgagcagcaggtggaggaggagcccggctggccccacccccagagctgcagcaccaaggtggccgacgagggcaccagcgccagccccggcggctacagagcccccgccgccctgtggagaagccagagcgccttcagcatcaccggcgaggaggccctgaagaccccccccgtggaggcccccagcagacagcccagagaccagggccagcaccccagagccgagagcgccctgcccagctggaagagcgtggacagactggacgagaccaacctggcccccgtgctgcagagccccgacggcaactgggtggccctgaaggacggcgcccccccccccaccagactgctggccaagcccaagagcggcaccttccaggccctggaggtggccagcagcgtggccagcgcctacgacgagatgggcagcgacagcgaggaggacttcgactggagcgaggccctgagcaagctgtgccccagaagcagagccctgcccagaaacccccagccccagcccacccaggcccagagcagcgaccagggccccatcgccgccagccccagcagcgccctgagccccaaccccgaggccatgtgcagcgacagcgagaccagcagcgccggcagcagcagagaggtgggccaccaggccagactgagctggctgcagagaaaggcccccagaaaccccgccgccgagaagatgagactgcacggcgagctggacgtgaacttcaacccccagctggccagcagagagaccagcgacagcagcgagcccgaggaggccccccacaccaccgacagaagagccagaagatggagaagagccagactgggcagcgaggagcccagcaaggagcccagcagccccagcgcccagctgagagacctggacacccaccaggtgagcgacgacctgagcgagaccgacatcagcaacgaggccagagacccccagaccctgaccgacaccaccgaggagaagagaagaaacagactgtacgagctggccatgaagatgagcgagaaggagaccagcagcggcgaggaccaggagagcgagcccaagaccgagagcgagaaccagaaggagagcctgagcagcgaggacaacagccagagcgtgcaggaggagctgaagaagaagttcagcgccgtgagcctgtgcaacatcagcaccgaggtgctgaaggtgatcaacgccaccgaggagctgatcgccggcagcaccggcccctgggagagcccccaggtgccccccgacagacagaagggcatgttccccagaggcaccgaccaggtgagactggacgagcagctgaccagcctggaggagaacgtgtacctggccgccggcaccgtgtacggcctggagacccagctgaccgagctggaggacgccgccagatgcatccacagcggcaccgacgagacccacctggccgacctggaggaccaggtggccaccgccgccgcccaggtgcaccacgccgagctgcagatcagcgacatcgagagcagaatcagcgccctgaccatcgccggcctgaacatcgccccctgcgtgagattcaccagaagaagagaccagaagcagagaacccaggtgcagaccatcgacaccagcagacagcagagaagaaagctgcccgccccccccgtgaaggccgagaagatcgagaccagcagcgtgaccaccatcaagaccttcaaccacaacttcatcctgcagggcagcagcaccaacagaaccaaggagagaaagggcaccaccaaggacctgatggagcccgccctggagagcgccgtgatgtactag

SEQ ID NO: 90065 - DNA, 2313 bp, Artificial Sequence
  Description of Artificial Sequence: Synthetic coding sequence
atgagaaaggccgccagcgccgccagcagcagaagcaccagcagcctgtggagcaccgccgcctgcgccgccgccagacccagccccagcagcagcacccccagcgccagcgtggagatcgccaacagcatgagcgccagagccgccgcccccaccagaagcaccaagagacccggcagcgccgccagcgccagcaagagaggcggcagcctgttcgagagcaacctggagaacgagggcagcatcagcggcagcgacagcaccttctacagacagagcgagggccacagcgtgatggacaccctggccgtggccctgagagtggccgaggaggccatcgaggaggccatcagcaaggccgaggcctacggcgacagcctggacaagcagaacgaggccagctacctgagagaccacaaggaggagctgaccgaggagctggccaccaccatcctgcagaagatcatcagaaagcagaagagcaagagcgagcagcaggtggaggaggagcccggctggccccacccccagagctgcagcaccaaggtggccgacgagggcaccagcgccagccccggcggctacagagcccccgccgccctgtggagaagccagagcgccttcagcatcaccggcgaggaggccctgaagaccccccccgtggaggcccccagcagacagcccagagaccagggccagcaccccagagccgagagcgccctgcccagctggaagagcgtggacagactggacgagaccaacctggcccccgtgctgcagagccccgacggcaactgggtggccctgaaggacggcgcccccccccccaccagactgctggccaagcccaagagcggcaccttccaggccctggaggtggccagcagcgtggccagcgcctacgacgagatgggcagcgacagcgaggaggacttcgactggagcgaggccctgagcaagctgtgccccagaagcagagccctgcccagaaacccccagccccagcccacccaggcccagagcagcgaccagggccccatcgccgccagccccagcagcgccctgagccccaaccccgaggccatgtgcagcgacagcgagaccagcagcgccggcagcagcagagaggtgggccaccaggccagactgagctggctgcagagaaaggcccccagaaaccccgccgccgagaagatgagactgcacggcgagctggacgtgaacttcaacccccagctggccagcagagagaccagcgacagcagcgagcccgaggaggccccccacaccaccgacagaagagccagaagatggagaagagccagactgggcagcgaggagcccagcaaggagcccagcagccccagcgcccagctgagagacctggacacccaccaggtgagcgacgacctgagcgagaccgacatcagcaacgaggccagagacccccagaccctgaccgacaccaccgaggagaagagaagaaacagactgtacgagctggccatgaagatgagcgagaaggagaccagcagcggcgaggaccaggagagcgagcccaagaccgagagcgagaaccagaaggagagcctgagcagcgaggacaacagccagagcgtgcaggaggagctgaagaagaagttcagcgccgtgagcctgtgcaacatcagcaccgaggtgctgaaggtgatcaacgccaccgaggagctgatcgccggcagcaccggcccctgggagagcccccaggtgccccccgacagacagaagggcatgttccccagaggcaccgaccaggtgagactggacgagcagctgaccagcctggaggagaacgtgtacctggccgccggcaccgtgtacggcctggagacccagctgaccgagctggaggacgccgccagatgcatccacagcggcaccgacgagacccacctggccgacctggaggaccaggtggccaccgccgccgcccaggtgcaccacgccgagctgcagatcagcgacatcgagagcagaatcagcgccctgaccatcgccggcctgaacatcgccccctgcgtgagattcaccagaagaagagaccagaagcagagaacccaggtgcagaccatcgacaccagcagacagcagagaagaaagctgcccgccccccccgtgaaggccgagaagatcgagaccagcagcgtgaccaccatcaagaccttcaaccacaacttcatcctgcagggcagcagcaccaacagaaccaaggagagaaagggcaccaccaaggacctgatggagcccgccctggagagcgccgtgatgtactag

SEQ ID NO: 90066 - DNA, 2580 bp, Artificial Sequence; identical to SEQ ID NO: 90064
  Description of Artificial Sequence: Synthetic coding sequence

SEQ ID NO: 90067 - DNA, 2019 bp, Artificial Sequence
  Description of Artificial Sequence: Synthetic coding sequence
atggacaccctggccgtggccctgagagtggccgaggaggccatcgaggaggccatcagcaaggccgaggcctacggcgacagcctggacaagcagaacgaggccagctacctgagagaccacaaggaggagctgaccgaggagctggccaccaccatcctgcagaagatcatcagaaagcagaagagcaagagcgagcagcaggtggaggaggagcccggctggccccacccccagagctgcagcaccaaggtggccgacgagggcaccagcgccagccccggcggctacagagcccccgccgccctgtggagaagccagagcgccttcagcatcaccggcgaggaggccctgaagaccccccccgtggaggcccccagcagacagcccagagaccagggccagcaccccagagccgagagcgccctgcccagctggaagagcgtggacagactggacgagaccaacctggcccccgtgctgcagagccccgacggcaactgggtggccctgaaggacggcgcccccccccccaccagactgctggccaagcccaagagcggcaccttccaggccctggaggtggccagcagcgtggccagcgcctacgacgagatgggcagcgacagcgaggaggacttcgactggagcgaggccctgagcaagctgtgccccagaagcagagccctgcccagaaacccccagccccagcccacccaggcccagagcagcgaccagggccccatcgccgccagccccagcagcgccctgagccccaaccccgaggccatgtgcagcgacagcgagaccagcagcgccggcagcagcagagaggtgggccaccaggccagactgagctggctgcagagaaaggcccccagaaaccccgccgccgagaagatgagactgcacggcgagctggacgtgaacttcaacccccagctggccagcagagagaccagcgacagcagcgagcccgaggaggccccccacaccaccgacagaagagccagaagatggagaagagccagactgggcagcgaggagcccagcaaggagcccagcagccccagcgcccagctgagagacctggacacccaccaggtgagcgacgacctgagcgagaccgacatcagcaacgaggccagagacccccagaccctgaccgacaccaccgaggagaagagaagaaacagactgtacgagctggccatgaagatgagcgagaaggagaccagcagcggcgaggaccaggagagcgagcccaagaccgagagcgagaaccagaaggagagcctgagcagcgaggacaacagccagagcgtgcaggaggagctgaagaagaagttcagcgccgtgagcctgtgcaacatcagcaccgaggtgctgaaggtgatcaacgccaccgaggagctgatcgccggcagcaccggcccctgggagagcccccaggtgccccccgacagacagaagggcatgttccccagaggcaccgaccaggtgagactggacgagcagctgaccagcctggaggagaacgtgtacctggccgccggcaccgtgtacggcctggagacccagctgaccgagctggaggacgccgccagatgcatccacagcggcaccgacgagacccacctggccgacctggaggaccaggtggccaccgccgccgcccaggtgcaccacgccgagctgcagatcagcgacatcgagagcagaatcagcgccctgaccatcgccggcctgaacatcgccccctgcgtgagattcaccagaagaagagaccagaagcagagaacccaggtgcagaccatcgacaccagcagacagcagagaagaaagctgcccgccccccccgtgaaggccgagaagatcgagaccagcagcgtgaccaccatcaagaccttcaaccacaacttcatcctgcagggcagcagcaccaacagaaccaaggagagaaagggcaccaccaaggacctgatggagcccgccctggagagcgccgtgatgtactag

SEQ ID NO: 90068 - DNA, 2886 bp, Artificial Sequence
  Description of Artificial Sequence: Synthetic coding sequence
atgaagtacctgctgaacttcatcggccagggccccgccacctacggccccttctgcgccgagagactgagaagaacctacgccaacggcgtgagagccgagccccccacctggctggagctgcaggccgtgaagagcaagaagcacatccccatccaggtgatcctggccaccggcgagagcctgaccgtgcccgtggacagcgccagcaccagcagagagatgtgcatgcacatcgcccacaagcagggcctgagcgaccacctgggcttcagcctgcaggtggccgtgtacgacaagttctggagcctgggcagcggcagagaccacatgatggacgccatcgccagatgcgagcagatggcccaggagagaggcgagagccagagacagagcccctggagaatctacttcagaaaggagttcttcaccccctggcacgacagcagagaggaccccgtgagcaccgagctgatctacagacaggtgctgagaggcgtgtggagcggcgagtacagcttcgagaaggaggaggagctggtggagctgctggccagacactgctacgtgcagctgggcgccagcgccgagagcaaggccgtgcaggagctgctgcccagctgcatcccccacaagctgtacagaaccaagccccccgacagatgggccagcctggtgaccgccgcctgcgccaaggccccctacacccagaagcaggtgacccccctggccgtgagagagcaggtggtggacgccgccagactgcagtggcccctgctgttcagcagactgttcgaggtgatcaccctgagcgccttcaccctgcccagcctgctggccagacccccccccgcccaggacgccggccccgccggcgaggacgccgccggcaccctgttccccagaggccacggcagcggccaccagcaggtgagagccctgagagaggacctgttcctgcacaccgagccccacccccccgcccccggcagaaccgcccacgaggtgctgcactggggcatcaccagatgcaccggcagcttcagcctgaagcccagaagcaccagaaagggccagggcagcgtgcagcccctggccggcacctacctggagggcagcttcctgtgccacggcagagagctggtggcctggagagtgcaggtggtgtgggagggcgacaagggccagtgcctggccggcgccgacccccacagccacggcagcccctggatcagcctgaccggcaacttcagcatgcccttcggcaagagcacccagcagagcggcacctgcatcagcggcctgtgccaggtgtacagcggccaccacagccccctggccaccagccccagaagcaccgacagcatcacccacagcgccgacgagagaatgagcaagctgaagcacgccgaggtgagatggctgagagtgagcacctggcagagcagacagctgatcagcgccctgaccttcgccgtgagcctgagatgccactgcacccccgccaccagcctgagcgcccacagccagccccacacctgggccgcccccctgagcgccagcgagagacccaccgtggtgagcggcctggtgctggccctggccgagcagctgtgcgtgctgatcagatggagaggcctgctggtgaccctgagcttcatcagcagagaggcccagggcggccagagactgctgctgagcaccatgcacgaggagtacgagttcgtgagccccagcagcgtggccatcgccgagctggtggccctgttcctggagggcctgaaggagagaagcatcttcgccatggccctgcaggacagaaaggccaccgacgacaccaccctgctggccttcaagaagggcgacctgctggtgctgaccaagaagcagggcctgctggccagcgagaactggaccctgggccagaacgacagaaccggcaagaccggcctggtgcccatggcctgcctgtacaccatccccaccgtgaccaagcccagcgcccagctgctgagcctgctggccatgagccccgagaagagaaagctggccgcccaggagggccagttcaccgagcccagacccgaggagccccccaaggagaagctgcacaccctggaggagttcagctacgagttcttcagagcccccgagaaggacatggtgagcatggccgtgctgcccctggccagagccagaggccacctgtgggcctacagctgcgagcccctgagacagcccctgctgaagagagtgcacgccaacgtggacctgtgggacatcgcctgccagatcttcgccacccccatcctgagatacatgggcgactaccccagcagacaggcctggcccaccctggagctgaccgaccagatcttcaccctggccctgcagcaccccgccctgcaggacgaggtgtactgccagatcctgaagcagctgacccacaacagcaacagacacagcgaggagagaggctggcagctgctgtggctgtgcaccggcctgttcccccccagcaagggcctgctgccccacgcccagaagttcatcgacaccagaagaggcaagctgctggcccccgactgcagcagaagaatccagaaggtgctgagaaccggccccagaaagcagcccccccaccaggtggaggtggaggccgccgagcagaacgtgagcagaatctgccacaagatctacttccccaacgacaccagcgagatgctggaggtggtggccaacaccagagtgagagacgtgtgcgacagcatcgccaccagactgcagctggccagctgggagggctgcagcctgttcatcaagatcagcgacaaggtgatcagccagaaggagggcgacttcttcttcgacagcctgagagagtag

SEQ ID NO: 90069 - DNA, 6354 bp, Artificial Sequence
  Description of Artificial Sequence: Synthetic coding sequence
atgagcggcttcagactgggcgaccacgtgtggctggagccccccagcacccacaagaccggcgtggccatcggcggcatcatcaaggaggccaagcccggcaaggtgctggtggaggacgacgagggcaaggagcactggatcagagccgaggacttcggcgtgctgagccccatgcaccccaacagcgtgcagggcgtggacgacatgatcagactgggcgacctgaacgaggccggcatggtgcacaacctgctgatcagataccagcagcacaagatctacacctacaccggcagcatcctggtggccgtgaaccccttccaggtgctgcccctgtacaccctggagcaggtgcagctgtactacagcagacacatgggcgagctgcccccccacgtgttcgccatcgccaacaactgctacttcagcatgaagagaaacaagagagaccagtgctgcatcatcagcggcgagagcggcgccggcaagaccgagaccaccaagctgatcctgcagttcctggccaccatcagcggccagcacagctggatcgagcagcaggtgctggaggccaaccccatcctggaggccttcggcaacgccaagaccatcagaaacgacaacagcagcagattcggcaagtacatcgacatctacttcaaccccagcggcgtgatcgagggcgccagaatcgagcagttcctgctggagaagagcagagtgtgcagacaggcccccgaggagagaaactaccacatcttctactgcatgctgatgggcgtgagcgccgaggacaagcagctgctgagcctgggcacccccagcgagtaccactacctgaccatgggcaactgcaccagctgcgagggcctgaacgacgccaaggactacgcccacatcagaagcgccatgaagatcctgcagttcagcgacagcgagagctgggacgtgatcaagctgctggccgccatcctgcacctgggcaacgtgggcttcatggccagcgtgttcgagaacctggacgccagcgacgtgatggagacccccgccttccccaccgtgatgaagctgctggaggtgcagcaccaggagctgagagactgcctgatcaagcacaccatcctgatcagaggcgagttcgtgaccagaagcctgaacatcgcccaggccgccgacagaagagacgccttcgtgaagggcatctacggccacctgttcctgtggatcgtgaagaagatcaacgccgccatcttcaccccccccgcccaggaccccaagaacgtgagaagagccatcggcctgctggacatcttcggcttcgagaacttcgagaacaacagcttcgagcagctgtgcatcaacttcgccaacgagcacctgcagcagttcttcgtgcagcacgtgttcaccatggagcaggaggagtacagaagcgagaacatcagctgggactacatccactacaccgacaacagacccaccctggacctgctggccctgaagcccatgagcatcatcagcctgctggacgaggagagcagattcccccagggcaccgacctgaccatgctgcagaagctgaacagcgtgcacgccaacaacaaggccttcctgcagcccaagaacatccacgacgccagattcggcatcgcccacttcgccggcgaggtgtactaccaggccgagggcttcctggagaagaacagagacgtgctgagcaccgacatcctgaccctggtgtacagcagcaagaacaagttcctgagagagatcttcaacctggagctggccgagaccaagctgggccacggcaccatcagacaggccaaggccggcaaccacctgttcaagagcgccgacagcaacaagagacccagcaccctgggcagccagttcaagcagagcctggaccagctgatgaagatcctgaccaactgccagccctacttcatcagatgcatcaagcccaacgagtacaagaagcccctgctgttcgacagagagctgtgcctgagacagctgagatacagcggcatgatggagaccgtgcacatcagaaagagcggcttccccatcagatacaccttcgaggagttcagccagagattcggcgtgctgctgcccaacgccatgagaatgcagctgcagggcaagctgagacagatgaccctgggcatcaccgacgtgtggctgagaaccgacaaggactggaaggccggcaagaccaagatcttcctgagagaccaccaggacaccctgctggaggtgcagagaagccaggtgctggacagagccgccctgagcatccagaaggtgctgagaggctacagatacagaaaggagttcctgagacagagaagagccgccgtgaccctgcaggcctggtggagaggctactgcaacagaagaaacttcaagctgatcctggtgggcttcgagagactgcaggccatcgccagaagccagcccctggccagacagtaccaggccatgagacagagaaccgtgcagctgcaggccctgtgcagaggctacctggtgagacagcaggtgcaggccaagagaagagccgtggtggtgatccaggcccacgccagaggcatggccgccagaagaaacttccagcagagaaaggccaacgcccccctggtgatccccgccgagggccagaagagccagggcgccctgcccgccaagaagagaagaagcatctacgacaccgtgaccgacaccgagatggtggagaaggtgttcggcttcctgcccgccatgatcggcggccaggagggccaggccagcccccacttcgaggacctggagagcaagacccagaagctgctggaggtggacctggacaccgtgcccatggccgaggagcccgaggaggacgtggacggcctggccgagtacaccttccccaagttcgccgtgacctacttccagaagagcgccagccacacccacatcagaagacccctgagataccccctgctgtaccacgaggacgacaccgactgcctggccgccctggtgatctggaacgtgatcctgagattcatgggcgacctgcccgagcccgtgctgtacgccagaagcagccagcagggcagcagcgtgatgagacagatccacgacaccctgggcagagagcacggcgcccaggtgccccagcacagcagaagcgcccaggtggccagccagctgaacatcggcgaggaggccctggagcccgacggcctgggcgccgacagacccatgagcaacctggagaaggtgcacttcatcgtgggctacgccatcctgagacccagcctgagagacgagatctactgccagatctgcaagcagctgagcgagaacttcaagaccagcagcctggccagaggctggatcctgctgagcctgtgcctgggctgcttcccccccagcgagagattcatgaagtacctgctgaacttcatcggccagggccccgccacctacggccccttctgcgccgagagactgagaagaacctacgccaacggcgtgagagccgagccccccacctggctggagctgcaggccgtgaagagcaagaagcacatccccatccaggtgatcctggccaccggcgagagcctgaccgtgcccgtggacagcgccagcaccagcagagagatgtgcatgcacatcgcccacaagcagggcctgagcgaccacctgggcttcagcctgcaggtggccgtgtacgacaagttctggagcctgggcagcggcagagaccacatgatggacgccatcgccagatgcgagcagatggcccaggagagaggcgagagccagagacagagcccctggagaatctacttcagaaaggagttcttcaccccctggcacgacagcagagaggaccccgtgagcaccgagctgatctacagacaggtgctgagaggcgtgtggagcggcgagtacagcttcgagaaggaggaggagctggtggagctgctggccagacactgctacgtgcagctgggcgccagcgccgagagcaaggccgtgcaggagctgctgcccagctgcatcccccacaagctgtacagaaccaagccccccgacagatgggccagcctggtgaccgccgcctgcgccaaggccccctacacccagaagcaggtgacccccctggccgtgagagagcaggtggtggacgccgccagactgcagtggcccctgctgttcagcagactgttcgaggtgatcaccctgagcggccccagactgcccaagacccagctgatcctggccgtgaactggaagggcctgtgcttcctggaccagcaggagaagatgctgctggagctgagcttccccgaggtgatgggcctggccaccaacagagaggcccagggcggccagagactgctgctgagcaccatgcacgaggagtacgagttcgtgagccccagcagcgtggccatcgccgagctggtggccctgttcctggagggcctgaaggagagaagcatcttcgccatggccctgcaggacagaaaggccaccgacgacaccaccctgctggccttcaagaagggcgacctgctggtgctgaccaagaagcagggcctgctggccagcgagaactggaccctgggccagaacgacagaaccggcaagaccggcctggtgcccatggcctgcctgtacaccatccccaccgtgaccaagcccagcgcccagctgctgagcctgctggccatgagccccgagaagagaaagctggccgcccaggagggccagttcaccgagcccagacccgaggagccccccaaggagaagctgcacaccctggaggagttcagctacgagttcttcagagcccccgagaaggacatggtgagcatggccgtgctgcccctggccagagccagaggccacctgtgggcctacagctgcgagcccctgagacagcccctgctgaagagagtgcacgccaacgtggacctgtgggacatcgcctgccagatcttcgccacccccatcctgagatacatgggcgactaccccagcagacaggcctggcccaccctggagctgaccgaccagatcttcaccctggccctgcagcaccccgccctgcaggacgaggtgtactgccagatcctgaagcagctgacccacaacagcaacagacacagcgaggagagaggctggcagctgctgtggctgtgcaccggcctgttcccccccagcaagggcctgctgccccacgcccagaagttcatcgacaccagaagaggcaagctgctggcccccgactgcagcagaagaatccagaaggtgctgagaaccggccccagaaagcagcccccccaccaggtggaggtggaggccgccgagcagaacgtgagcagaatctgccacaagatctacttccccaacgacaccagcgagatgctggaggtggtggccaacaccagagtgagagacgtgtgcgacagcatcgccaccagactgcagctggccagctgggagggctgcagcctgttcatcaagatcagcgacaaggtgatcagccagaaggagggcgacttcttcttcgacagcctgagagaggtgagcgactgggtgaagaagaacaagccccagaaggagggcgcccccgtgaccctgccctaccaggtgtacttcatgagaaagctgtggctgaacatcagccccggcaaggacgtgaacgccgacaccatcctgcactaccaccaggagctgcccaagtacctgagaggcttccacaagtgcagcagagaggacgccatccacctggccggcctgatctacaaggcccagttcaacaacgacagaagccagctggccagcgtgcccaagatcctgagagagctggtgcccgagaacctgaccagactgatgagcagcgaggagtggaagaagagcatcctgctggcctacgacaagcacaaggacaagaccgtggaggaggccaaggtggccttcctgaagtggatctgcagatggcccaccttcggcagcgccttcttcgaggtgaagcagaccagcgagcccagctaccccgacgtgatcctgatcgccatcaacagacacggcgtgctgctgatccaccccaagaccaaggacctgctgaccacctaccccttcaccaagatcagcagctggagcagcggcagcacctacttccacatggccctgggcagcctgggcagaggcagcagactgctgtgcgagaccagcctgggctacaagatggacgacctgctgaccagctacgtgcagcagctgctgagcgccatgaacaagcagagaggcagcaaggcccccgccctggccagcacctag

SEQ ID NO: 90070 - DNA, 6351 bp, Artificial Sequence
  Description of Artificial Sequence: Synthetic coding sequence
atgagcggcttcagactgggcgaccacgtgtggctggagccccccagcacccacaagaccggcgtggccatcggcggcatcatcaaggaggccaagcccggcaaggtgctggtggaggacgacgagggcaaggagcactggatcagagccgaggacttcggcgtgctgagccccatgcaccccaacagcgtgcagggcgtggacgacatgatcagactgggcgacctgaacgaggccggcatggtgcacaacctgctgatcagataccagcagcacaagatctacacctacaccggcagcatcctggtggccgtgaaccccttccaggtgctgcccctgtacaccctggagcaggtgcagctgtactacagcagacacatgggcgagctgcccccccacgtgttcgccatcgccaacaactgctacttcagcatgaagagaaacaagagagaccagtgctgcatcatcagcggcgagagcggcgccggcaagaccgagaccaccaagctgatcctgcagttcctggccaccatcagcggccagcacagctggatcgagcagcaggtgctggaggccaaccccatcctggaggccttcggcaacgccaagaccatcagaaacgacaacagcagcagattcggcaagtacatcgacatctacttcaaccccagcggcgtgatcgagggcgccagaatcgagcagttcctgctggagaagagcagagtgtgcagacaggcccccgaggagagaaactaccacatcttctactgcatgctgatgggcgtgagcgccgaggacaagcagctgctgagcctgggcacccccagcgagtaccactacctgaccatgggcaactgcaccagctgcgagggcctgaacgacgccaaggactacgcccacatcagaagcgccatgaagatcctgcagttcagcgacagcgagagctgggacgtgatcaagctgctggccgccatcctgcacctgggcaacgtgggcttcatggccagcgtgttcgagaacctggacgccagcgacgtgatggagacccccgccttccccaccgtgatgaagctgctggaggtgcagcaccaggagctgagagactgcctgatcaagcacaccatcctgatcagaggcgagttcgtgaccagaagcctgaacatcgcccaggccgccgacagaagagacgccttcgtgaagggcatctacggccacctgttcctgtggatcgtgaagaagatcaacgccgccatcttcaccccccccgcccaggaccccaagaacgtgagaagagccatcggcctgctggacatcttcggcttcgagaacttcgagaacaacagcttcgagcagctgtgcatcaacttcgccaacgagcacctgcagcagttcttcgtgcagcacgtgttcaccatggagcaggaggagtacagaagcgagaacatcagctgggactacatccactacaccgacaacagacccaccctggacctgctggccctgaagcccatgagcatcatcagcctgctggacgaggagagcagattcccccagggcaccgacctgaccatgctgcagaagctgaacagcgtgcacgccaacaacaaggccttcctgcagcccaagaacatccacgacgccagattcggcatcgcccacttcgccggcgaggtgtactaccaggccgagggcttcctggagaagaacagagacgtgctgagcaccgacatcctgaccctggtgtacagcagcaagaacaagttcctgagagagatcttcaacctggagctggccgagaccaagctgggccacggcaccatcagacaggccaaggccggcaaccacctgttcaagagcgccgacagcaacaagagacccagcaccctgggcagccagttcaagcagagcctggaccagctgatgaagatcctgaccaactgccagccctacttcatcagatgcatcaagcccaacgagtacaagaagcccctgctgttcgacagagagctgtgcctgagacagctgagatacagcggcatgatggagaccgtgcacatcagaaagagcggcttccccatcagatacaccttcgaggagttcagccagagattcggcgtgctgctgcccaacgccatgagaatgcagctgcagggcaagctgagacagatgaccctgggcatcaccgacgtgtggctgagaaccgacaaggactggaaggccggcaagaccaagatcttcctgagagaccaccaggacaccctgctggaggtgcagagaagccaggtgctggacagagccgccctgagcatccagaaggtgctgagaggctacagatacagaaaggagttcctgagacagagaagagccgccgtgaccctgcaggcctggtggagaggctactgcaacagaagaaacttcaagctgatcctggtgggcttcgagagactgcaggccatcgccagaagccagcccctggccagacagtaccaggccatgagacagagaaccgtgcagctgcaggccctgtgcagaggctacctggtgagacagcaggtgcaggccaagagaagagccgtggtggtgatccaggcccacgccagaggcatggccgccagaagaaacttccagcagagaaaggccaacgcccccctggtgatccccgccgagggccagaagagccagggcgccctgcccgccaagaagagaagaagcatctacgacaccgtgaccgacaccgagatggtggagaaggtgttcggcttcctgcccgccatgatcggcggccaggagggccaggccagcccccacttcgaggacctggagagcaagacccagaagctgctggaggtggacctggacaccgtgcccatggccgaggagcccgaggaggacgtggacggcctggccgagtacaccttccccaagttcgccgtgacctacttccagaagagcgccagccacacccacatcagaagacccctgagataccccctgctgtaccacgaggacgacaccgactgcctggccgccctggtgatctggaacgtgatcctgagattcatgggcgacctgcccgagcccgtgctgtacgccagaagcagccagcagggcagcagcgtgatgagacagatccacgacaccctgggcagagagcacggcgcccaggtgccccagcacagcagaagcgcccaggtggccagccagctgaacatcggcgaggaggccctggagcccgacggcctgggcgccgacagacccatgagcaacctggagaaggtgcacttcatcgtgggctacgccatcctgagacccagcctgagagacgagatctactgccagatctgcaagcagctgagcgagaacttcaagaccagcagcctggccagaggctggatcctgctgagcctgtgcctgggctgcttcccccccagcgagagattcatgaagtacctgctgaacttcatcggccagggccccgccacctacggccccttctgcgccgagagactgagaagaacctacgccaacggcgtgagagccgagccccccacctggctggagctgcaggccgtgaagagcaagaagcacatccccatccaggtgatcctggccaccggcgagagcctgaccgtgcccgtggacagcgccagcaccagcagagagatgtgcatgcacatcgcccacaagcagggcctgagcgaccacctgggcttcagcctgcaggtggccgtgtacgacaagttctggagcctgggcagcggcagagaccacatgatggacgccatcgccagatgcgagcagatggcccaggagagaggcgagagccagagacagagcccctggagaatctacttcagaaaggagttcttcaccccctggcacgacagcagagaggaccccgtgagcaccgagctgatctacagacaggtgctgagaggcgtgtggagcggcgagtacagcttcgagaaggaggaggagctggtggagctgctggccagacactgctacgtgcagctgggcgccagcgccgagagcaaggccgtgcaggagctgctgcccagctgcatcccccacaagctgtacagaaccaagccccccgacagatgggccagcctggtgaccgccgcctgcgccaaggccccctacacccagaagcaggtgacccccctggccgtgagagagcaggtggtggacgccgccagactgcagtggcccctgctgttcagcagactgttcgaggtgatcaccctgagcggccccagactgcccaagacccagctgatcctggccgtgaactggaagggcctgtgcttcctggaccagcaggagaagatgctgctggagctgagcttccccgaggtgatgggcctggccaccaacagagaggcccagggcggccagagactgctgctgagcaccatgcacgaggagtacgagttcgtgagccccagcagcgtggccatcgccgagctggtggccctgttcctggagggcctgaaggagagaagcatcttcgccatggccctgcaggacagaaaggccaccgacgacaccaccctgctggccttcaagaagggcgacctgctggtgctgaccaagaagcagggcctgctggccagcgagaactggaccctgggccagaacgacagaaccggcaagaccggcctggtgcccatggcctgcctgtacaccatccccaccgtgaccaagcccagcgcccagctgctgagcctgctggccatgagccccgagaagagaaagctggccgcccaggagggccagttcaccgagcccagacccgaggagccccccaaggagaagctgcacaccctggaggagttcagctacgagttcttcagagcccccgagaaggacatggtgagcatggccgtgctgcccctggccagagccagaggccacctgtgggcctacagctgcgagcccctgagacagcccctgctgaagagagtgcacgccaacgtggacctgtgggacatcgcctgccagatcttcgtggccatcctgagatacatgggcgactaccccagcagacaggcctggcccaccctggagctgaccgaccagatcttcaccctggccctgcagcaccccgccctgcaggacgaggtgtactgccagatcctgaagcagctgacccacaacagcaacagacacagcgaggagagaggctggcagctgctgtggctgtgcaccggcctgttcccccccagcaagggcctgctgccccacgcccagaagttcatcgacaccagaagaggcaagctgctggcccccgactgcagcagaagaatccagaaggtgctgagaaccggccccagaaagcagcccccccaccaggtggaggtggaggccgccgagcagaacgtgagcagaatctgccacaagatctacttccccaacgacaccagcgagatgctggaggtggtggccaacaccagagtgagagacgtgtgcgacagcatcgccaccagactgcagctggccagctgggagggctgcagcctgttcatcaagatcagcgacaaggtgatcagccagaaggagggcgacttcttcttcgacagcctgagagaggtgagcgactgggtgaagaagaacaagccccagaaggagggcgcccccgtgaccctgccctaccaggtgtacttcatgagaaagctgtggctgaacatcagccccggcaaggacgtgaacgccgacaccatcctgcactaccaccaggagctgcccaagtacctgagaggcttccacaagtgcagcagagaggacgccatccacctggccggcctgatctacaaggcccagttcaacaacgacagaagccagctggccagcgtgcccaagatcctgagagagctggtgcccgagaacctgaccagactgatgagcagcgaggagtggaagaagagcatcctgctggcctacgacaagcacaaggacaagaccgtggaggaggccaaggtggccttcctgaagtggatctgcagatggcccaccttcggcagcgccttcttcgaggtgaagcagaccagcgagcccagctaccccgacgtgatcctgatcgccatcaacagacacggcgtgctgctgatccaccccaagaccaaggacctgctgaccacctaccccttcaccaagatcagcagctggagcagcggcagcacctacttccacatggccctgggcagcctgggcagaggcagcagactgctgtgcgagaccagcctgggctacaagatggacgacctgctgaccagctacgtgcagcagctgctgagcgccatgaacaagcagagaggcagcaaggcccccgccctggccagcacctag

SEQ ID NO: 90071 - DNA, 6351 bp, Artificial Sequence; identical to SEQ ID NO: 90070
  Description of Artificial Sequence: Synthetic coding sequence

SEQ ID NO: 90072 - DNA, 4248 bp, Artificial Sequence
  Description of Artificial Sequence: Synthetic coding sequence
atgcccgaccagttcgaccaggccgtggtgctgaaccagctgagatacagcggcatgctggagaccgtgagaatcagaaaggccggctacgccgtgagaagacccttccaggacttctacaagagatacaaggtgctgatgagaaacctggccctgcccgaggacgtgagaggcaagtgcaccagcctgctgcagctgtacgacgccagcaacagcgagtggcagctgggcaagaccaaggtgttcctgagagagagcctggagcagaagctggagaagagaagagaggaggaggtgagccacgccgccatggtgatcagagcccacgtgctgggcttcctggccagaaagcagtacagaaaggtgctgtactgcgtggtgatcatccagaagaactacagagccttcctgctgagaagaagattcctgcacctgaagaaggccgccatcgtgttccagaagcagctgagaggccagatcgccagaagagtgtacagacagctgctggccgagaagagagagcaggaggagaagaagaagcaggaggaggaggagaagaagaagagagaggaggaggagagagagagagagagagagagaagagaggccgagctgagagcccagcaggaggaggagaccagaaagcagcaggagctggaggccctgcagaagagccagaaggaggccgagctgaccagagagctggagaagcagaaggagaacaagcaggtggaggagatcctgagactggagaaggagatcgaggacctgcagagaatgaaggagcagcaggagctgagcctgaccgaggccagcctgcagaagctgcaggagagaagagaccaggagctgagaagactggaggaggaggcctgcagagccgcccaggagttcctggagagcctgaacttcgacgagatcgacgagtgcgtgagaaacatcgagagaagcctgagcgtgggcagcgagttcagcagcgagctggccgagagcgcctgcgaggagaagcccaacttcaacttcagccagccctaccccgaggaggaggtggacgagggcttcgaggccgacgacgacgccttcaaggacagccccaaccccagcgagcacggccacagcgaccagagaaccagcggcatcagaaccagcgacgacagcagcgaggaggacccctacatgaacgacaccgtggtgcccaccagccccagcgccgacagcaccgtgctgctggcccccagcgtgcaggacagcggcagcctgcacaacagcagcagcggcgagagcacctactgcatgccccagaacgccggcgacctgcccagccccgacggcgactacgactacgaccaggacgactacgaggacggcgccatcaccagcggcagcagcgtgaccttcagcaacagctacggcagccagtggagccccgactacagatgcagcgtgggcacctacaacagcagcggcgcctacagattcagcagcgagggcgcccagagcagcttcgaggacagcgaggaggacttcgacagcagattcgacaccgacgacgagctgagctacagaagagacagcgtgtacagctgcgtgaccctgccctacttccacagcttcctgtacatgaagggcggcctgatgaacagctggaagagaagatggtgcgtgctgaaggacgagaccttcctgtggttcagaagcaagcaggaggccctgaagcagggctggctgcacaagaagggcggcggcagcagcaccctgagcagaagaaactggaagaagagatggttcgtgctgagacagagcaagctgatgtacttcgagaacgacagcgaggagaagctgaagggcaccgtggaggtgagaaccgccaaggagatcatcgacaacaccaccaaggagaacggcatcgacatcatcatggccgacagaaccttccacctgatcgccgagagccccgaggacgccagccagtggttcagcgtgctgagccaggtgcacgccagcaccgaccaggagatccaggagatgcacgacgagcaggccaacccccagaacgccgtgggcaccctggacgtgggcctgatcgacagcgtgtgcgccagcgacagccccgacagacccaacagcttcgtgatcatcaccgccaacagagtgctgcactgcaacgccgacacccccgaggagatgcaccactggatcaccctgctgcagagaagcaagggcgacaccagagtggagggccaggagttcatcgtgagaggctggctgcacaaggaggtgaagaacagccccaagatgagcagcctgaagctgaagaagagatggttcgtgctgacccacaacagcctggactactacaagagcagcgagaagaacgccctgaagctgggcaccctggtgctgaacagcctgtgcagcgtggtgccccccgacgagaagatcttcaaggagaccggctactggaacgtgaccgtgtacggcagaaagcactgctacagactgtacaccaagctgctgaacgaggccaccagatggagcagcgccatccagaacgtgaccgacaccaaggcccccatcgacacccccacccagcagctgatccaggacatcaaggagaactgcctgaacagcgacgtggtggagcagatctacaagagaaaccccatcctgagatacacccaccaccccctgcacagccccctgctgcccctgccctacggcgacatcaacctgaacctgctgaaggacaagggctacaccaccctgcaggacgaggccatcaagatcttcaacagcctgcagcagctggagagcatgagcgaccccatccccatcatccagggcatcctgcagaccggccacgacctgagacccctgagagacgagctgtactgccagctgatcaagcagaccaacaaggtgccccaccccggcagcgtgggcaacctgtacagctggcagatcctgacctgcctgagctgcaccttcctgcccagcagaggcatcctgaagtacctgaagttccacctgaagagaatcagagagcagttccccggcagcgagatggagaagtacgccctgttcacctacgagagcctgaagaagaccaagtgcagagagttcgtgcccagcagagacgagatcgaggccctgatccacagacaggagatgaccagcaccgtgtactgccacggcggcggcagctgcaagatcaccatcaacagccacaccaccgccggcgaggtggtggagaagctgatcagaggcctggccatggaggacagcagaaacatgttcgccctgttcgagtacaacggccacgtggacaaggccatcgagagcagaaccgtggtggccgacgtgctggccaagttcgagaagctggccgccaccagcgaggtgggcgacctgccctggaagttctacttcaagctgtactgcttcctggacaccgacaacgtgcccaaggacagcgtggagttcgccttcatgttcgagcaggcccacgaggccgtgatccacggccaccaccccgcccccgaggagaacctgcaggtgctggccgccctgagactgcagtacctgcagggcgactacaccctgcacgccgccatcccccccctggaggaggtgtacagcctgcagagactgaaggccagaatcagccagagcaccaagaccttcaccccctgcgagagactggagaagagaagaaccagcttcctggagggcaccctgagaagaagcttcagaaccggcagcgtggtgagacagaaggtggaggaggagcagatgctggacatgtggatcaaggaggaggtgagcagcgccagagccagcatcatcgacaagtggagaaagttccagggcatgaaccaggagcaggccatggccaagtacatggccctgatcaaggagtggcccggctacggcagcaccctgttcgacgtggagtgcaaggagggcggcttcccccaggagctgtggctgggcgtgagcgccgacgccgtgagcgtgtacaagagaggcgagggcagacccctggaggtgttccagtacgagcacatcctgagcttcggcgcccccctggccaacacctacaagatcgtggtggacgagagagagctgctgttcgagaccagcgaggtggtggacgtggccaagctgatgaaggcctacatcagcatgatcgtgaagaagagatacagcaccaccagaagcgccagcagccagggcagcagcagatag

SEQ ID NO: 90073 - DNA, 4248 bp, Artificial Sequence; identical to SEQ ID NO: 90072
  Description of Artificial Sequence: Synthetic coding sequence

SEQ ID NO: 90074 - DNA, 4194 bp, Artificial Sequence
  Description of Artificial Sequence: Synthetic coding sequence
atgctggagaccgtgagaatcagaaaggccggctacgccgtgagaagacccttccaggacttctacaagagatacaaggtgctgatgagaaacctggccctgcccgaggacgtgagaggcaagtgcaccagcctgctgcagctgtacgacgccagcaacagcgagtggcagctgggcaagaccaaggtgttcctgagagagagcctggagcagaagctggagaagagaagagaggaggaggtgagccacgccgccatggtgatcagagcccacgtgctgggcttcctggccagaaagcagtacagaaaggtgctgtactgcgtggtgatcatccagaagaactacagagccttcctgctgagaagaagattcctgcacctgaagaaggccgccatcgtgttccagaagcagctgagaggccagatcgccagaagagtgtacagacagctgctggccgagaagagagagcaggaggagaagaagaagcaggaggaggaggagaagaagaagagagaggaggaggagagagagagagagagagagagaagagaggccgagctgagagcccagcaggaggaggagaccagaaagcagcaggagctggaggccctgcagaagagccagaaggaggccgagctgaccagagagctggagaagcagaaggagaacaagcaggtggaggagatcctgagactggagaaggagatcgaggacctgcagagaatgaaggagcagcaggagctgagcctgaccgaggccagcctgcagaagctgcaggagagaagagaccaggagctgagaagactggaggaggaggcctgcagagccgcccaggagttcctggagagcctgaacttcgacgagatcgacgagtgcgtgagaaacatcgagagaagcctgagcgtgggcagcgagttcagcagcgagctggccgagagcgcctgcgaggagaagcccaacttcaacttcagccagccctaccccgaggaggaggtggacgagggcttcgaggccgacgacgacgccttcaaggacagccccaaccccagcgagcacggccacagcgaccagagaaccagcggcatcagaaccagcgacgacagcagcgaggaggacccctacatgaacgacaccgtggtgcccaccagccccagcgccgacagcaccgtgctgctggcccccagcgtgcaggacagcggcagcctgcacaacagcagcagcggcgagagcacctactgcatgccccagaacgccggcgacctgcccagccccgacggcgactacgactacgaccaggacgactacgaggacggcgccatcaccagcggcagcagcgtgaccttcagcaacagctacggcagccagtggagccccgactacagatgcagcgtgggcacctacaacagcagcggcgcctacagattcagcagcgagggcgcccagagcagcttcgaggacagcgaggaggacttcgacagcagattcgacaccgacgacgagctgagctacagaagagacagcgtgtacagctgcgtgaccctgccctacttccacagcttcctgtacatgaagggcggcctgatgaacagctggaagagaagatggtgcgtgctgaaggacgagaccttcctgtggttcagaagcaagcaggaggccctgaagcagggctggctgcacaagaagggcggcggcagcagcaccctgagcagaagaaactggaagaagagatggttcgtgctgagacagagcaagctgatgtacttcgagaacgacagcgaggagaagctgaagggcaccgtggaggtgagaaccgccaaggagatcatcgacaacaccaccaaggagaacggcatcgacatcatcatggccgacagaaccttccacctgatcgccgagagccccgaggacgccagccagtggttcagcgtgctgagccaggtgcacgccagcaccgaccaggagatccaggagatgcacgacgagcaggccaacccccagaacgccgtgggcaccctggacgtgggcctgatcgacagcgtgtgcgccagcgacagccccgacagacccaacagcttcgtgatcatcaccgccaacagagtgctgcactgcaacgccgacacccccgaggagatgcaccactggatcaccctgctgcagagaagcaagggcgacaccagagtggagggccaggagttcatcgtgagaggctggctgcacaaggaggtgaagaacagccccaagatgagcagcctgaagctgaagaagagatggttcgtgctgacccacaacagcctggactactacaagagcagcgagaagaacgccctgaagctgggcaccctggtgctgaacagcctgtgcagcgtggtgccccccgacgagaagatcttcaaggagaccggctactggaacgtgaccgtgtacggcagaaagcactgctacagactgtacaccaagctgctgaacgaggccaccagatggagcagcgccatccagaacgtgaccgacaccaaggcccccatcgacacccccacccagcagctgatccaggacatcaaggagaactgcctgaacagcgacgtggtggagcagatctacaagagaaaccccatcctgagatacacccaccaccccctgcacagccccctgctgcccctgccctacggcgacatcaacctgaacctgctgaaggacaagggctacaccaccctgcaggacgaggccatcaagatcttcaacagcctgcagcagctggagagcatgagcgaccccatccccatcatccagggcatcctgcagaccggccacgacctgagacccctgagagacgagctgtactgccagctgatcaagcagaccaacaaggtgccccaccccggcagcgtgggcaacctgtacagctggcagatcctgacctgcctgagctgcaccttcctgcccagcagaggcatcctgaagtacctgaagttccacctgaagagaatcagagagcagttccccggcagcgagatggagaagtacgccctgttcacctacgagagcctgaagaagaccaagtgcagagagttcgtgcccagcagagacgagatcgaggccctgatccacagacaggagatgaccagcaccgtgtactgccacggcggcggcagctgcaagatcaccatcaacagccacaccaccgccggcgaggtggtggagaagctgatcagaggcctggccatggaggacagcagaaacatgttcgccctgttcgagtacaacggccacgtggacaaggccatcgagagcagaaccgtggtggccgacgtgctggccaagttcgagaagctggccgccaccagcgaggtgggcgacctgccctggaagttctacttcaagctgtactgcttcctggacaccgacaacgtgcccaaggacagcgtggagttcgccttcatgttcgagcaggcccacgaggccgtgatccacggccaccaccccgcccccgaggagaacctgcaggtgctggccgccctgagactgcagtacctgcagggcgactacaccctgcacgccgccatcccccccctggaggaggtgtacagcctgcagagactgaaggccagaatcagccagagcaccaagaccttcaccccctgcgagagactggagaagagaagaaccagcttcctggagggcaccctgagaagaagcttcagaaccggcagcgtggtgagacagaaggtggaggaggagcagatgctggacatgtggatcaaggaggaggtgagcagcgccagagccagcatcatcgacaagtggagaaagttccagggcatgaaccaggagcaggccatggccaagtacatggccctgatcaaggagtggcccggctacggcagcaccctgttcgacgtggagtgcaaggagggcggcttcccccaggagctgtggctgggcgtgagcgccgacgccgtgagcgtgtacaagagaggcgagggcagacccctggaggtgttccagtacgagcacatcctgagcttcggcgcccccctggccaacacctacaagatcgtggtggacgagagagagctgctgttcgagaccagcgaggtggtggacgtggccaagctgatgaaggcctacatcagcatgatcgtgaagaagagatacagcaccaccagaagcgccagcagccagggcagcagcagatag

SEQ ID NO: 90075 - DNA, 6177 bp, Artificial Sequence
  Description of Artificial Sequence: Synthetic coding sequence
atggacaacttcttcaccgagggcaccagagtgtggctgagagagaacggccagcacttccccagcaccgtgaacagctgcgccgagggcatcgtggtgttcagaaccgactacggccaggtgttcacctacaagcagagcaccatcacccaccagaaggtgaccgccatgcaccccaccaacgaggagggcgtggacgacatggccagcctgaccgagctgcacggcggcagcatcatgtacaacctgttccagagatacaagagaaaccagatctacacctacatcggcagcatcctggccagcgtgaacccctaccagcccatcgccggcctgtacgagcccgccaccatggagcagtacagcagaagacacctgggcgagctgcccccccacatcttcgccatcgccaacgagtgctacagatgcctgtggaagagacacgacaaccagtgcatcctgatcagcggcgagagcggcgccggcaagaccgagagcaccaagctgatcctgaagttcctgagcgtgatcagccagcagagcctggagctgagcctgaaggagaagaccagctgcgtggagagagccatcctggagagcagccccatcatggaggccttcggcaacgccaagaccgtgtacaacaacaacagcagcagattcggcaagttcgtgcagctgaacatctgccagaagggcaacatccagggcggcagaatcgtggactacctgctggagaagaacagagtggtgagacagaaccccggcgagagaaactaccacatcttctacgccctgctggccggcctggagcacgaggagagagaggagttctacctgagcacccccgagaactaccactacctgaaccagagcggctgcgtggaggacaagaccatcagcgaccaggagagcttcagagaggtgatcaccgccatggacgtgatgcagttcagcaaggaggaggtgagagaggtgagcagactgctggccggcatcctgcacctgggcaacatcgagttcatcaccgccggcggcgcccaggtgagcttcaagaccgccctgggcagaagcgccgagctgctgggcctggaccccacccagctgaccgacgccctgacccagagaagcatgttcctgagaggcgaggagatcctgacccccctgaacgtgcagcaggccgtggacagcagagacagcctggccatggccctgtacgcctgctgcttcgagtgggtgatcaagaagatcaacagcagaatcaagggcaacgaggacttcaagagcatcggcatcctggacatcttcggcttcgagaacttcgaggtgaaccacttcgagcagttcaacatcaactacgccaacgagaagctgcaggagtacttcaacaagcacatcttcagcctggagcagctggagtacagcagagagggcctggtgtgggaggacatcgactggatcgacaacggcgagtgcctggacctgatcgagaagaagctgggcctgctggccctgatcaacgaggagagccacttcccccaggccaccgacagcaccctgctggagaagctgcacagccagcacgccaacaaccacttctacgtgaagcccagagtggccgtgaacaacttcggcgtgaagcactacgccggcgaggtgcagtacgacgtgagaggcatcctggagaagaacagagacaccttcagagacgacctgctgaacctgctgagagagagcagattcgacttcatctacgacctgttcgagcacgtgagcagcagaaacaaccaggacaccctgaagtgcggcagcaagcacagaagacccaccgtgagcagccagttcaaggacagcctgcacagcctgatggccaccctgagcagcagcaaccccttcttcgtgagatgcatcaagcccaacatgcagaagatgcccgaccagttcgaccaggccgtggtgctgaaccagctgagatacagcggcatgctggagaccgtgagaatcagaaaggccggctacgccgtgagaagacccttccaggacttctacaagagatacaaggtgctgatgagaaacctggccctgcccgaggacgtgagaggcaagtgcaccagcctgctgcagctgtacgacgccagcaacagcgagtggcagctgggcaagaccaaggtgttcctgagagagagcctggagcagaagctggagaagagaagagaggaggaggtgagccacgccgccatggtgatcagagcccacgtgctgggcttcctggccagaaagcagtacagaaaggtgctgtactgcgtggtgatcatccagaagaactacagagccttcctgctgagaagaagattcctgcacctgaagaaggccgccatcgtgttccagaagcagctgagaggccagatcgccagaagagtgtacagacagctgctggccgagaagagagagcaggaggagaagaagaagcaggaggaggaggagaagaagaagagagaggaggaggagagagagagagagagagagagaagagaggccgagctgagagcccagcaggaggaggagaccagaaagcagcaggagctggaggccctgcagaagagccagaaggaggccgagctgaccagagagctggagaagcagaaggagaacaagcaggtggaggagatcctgagactggagaaggagatcgaggacctgcagagaatgaaggagcagcaggagctgagcctgaccgaggccagcctgcagaagctgcaggagagaagagaccaggagctgagaagactggaggaggaggcctgcagagccgcccaggagttcctggagagcctgaacttcgacgagatcgacgagtgcgtgagaaacatcgagagaagcctgagcgtgggcagcgagttcagcagcgagctggccgagagcgcctgcgaggagaagcccaacttcaacttcagccagccctaccccgaggaggaggtggacgagggcttcgaggccgacgacgacgccttcaaggacagccccaaccccagcgagcacggccacagcgaccagagaaccagcggcatcagaaccagcgacgacagcagcgaggaggacccctacatgaacgacaccgtggtgcccaccagccccagcgccgacagcaccgtgctgctggcccccagcgtgcaggacagcggcagcctgcacaacagcagcagcggcgagagcacctactgcatgccccagaacgccggcgacctgcccagccccgacggcgactacgactacgaccaggacgactacgaggacggcgccatcaccagcggcagcagcgtgaccttcagcaacagctacggcagccagtggagccccgactacagatgcagcgtgggcacctacaacagcagcggcgcctacagattcagcagcgagggcgcccagagcagcttcgaggacagcgaggaggacttcgacagcagattcgacaccgacgacgagctgagctacagaagagacagcgtgtacagctgcgtgaccctgccctacttccacagcttcctgtacatgaagggcggcctgatgaacagctggaagagaagatggtgcgtgctgaaggacgagaccttcctgtggttcagaagcaagcaggaggccctgaagcagggctggctgcacaagaagggcggcggcagcagcaccctgagcagaagaaactggaagaagagatggttcgtgctgagacagagcaagctgatgtacttcgagaacgacagcgaggagaagctgaagggcaccgtggaggtgagaaccgccaaggagatcatcgacaacaccaccaaggagaacggcatcgacatcatcatggccgacagaaccttccacctgatcgccgagagccccgaggacgccagccagtggttcagcgtgctgagccaggtgcacgccagcaccgaccaggagatccaggagatgcacgacgagcaggccaacccccagaacgccgtgggcaccctggacgtgggcctgatcgacagcgtgtgcgccagcgacagccccgacagacccaacagcttcgtgatcatcaccgccaacagagtgctgcactgcaacgccgacacccccgaggagatgcaccactggatcaccctgctgcagagaagcaagggcgacaccagagtggagggccaggagttcatcgtgagaggctggctgcacaaggaggtgaagaacagccccaagatgagcagcctgaagctgaagaagagatggttcgtgctgacccacaacagcctggactactacaagagcagcgagaagaacgccctgaagctgggcaccctggtgctgaacagcctgtgcagcgtggtgccccccgacgagaagatcttcaaggagaccggctactggaacgtgaccgtgtacggcagaaagcactgctacagactgtacaccaagctgctgaacgaggccaccagatggagcagcgccatccagaacgtgaccgacaccaaggcccccatcgacacccccacccagcagctgatccaggacatcaaggagaactgcctgaacagcgacgtggtggagcagatctacaagagaaaccccatcctgagatacacccaccaccccctgcacagccccctgctgcccctgccctacggcgacatcaacctgaacctgctgaaggacaagggctacaccaccctgcaggacgaggccatcaagatcttcaacagcctgcagcagctggagagcatgagcgaccccatccccatcatccagggcatcctgcagaccggccacgacctgagacccctgagagacgagctgtactgccagctgatcaagcagaccaacaaggtgccccaccccggcagcgtgggcaacctgtacagctggcagatcctgacctgcctgagctgcaccttcctgcccagcagaggcatcctgaagtacctgaagttccacctgaagagaatcagagagcagttccccggcagcgagatggagaagtacgccctgttcacctacgagagcctgaagaagaccaagtgcagagagttcgtgcccagcagagacgagatcgaggccctgatccacagacaggagatgaccagcaccgtgtactgccacggcggcggcagctgcaagatcaccatcaacagccacaccaccgccggcgaggtggtggagaagctgatcagaggcctggccatggaggacagcagaaacatgttcgccctgttcgagtacaacggccacgtggacaaggccatcgagagcagaaccgtggtggccgacgtgctggccaagttcgagaagctggccgccaccagcgaggtgggcgacctgccctggaagttctacttcaagctgtactgcttcctggacaccgacaacgtgcccaaggacagcgtggagttcgccttcatgttcgagcaggcccacgaggccgtgatccacggccaccaccccgcccccgaggagaacctgcaggtgctggccgccctgagactgcagtacctgcagggcgactacaccctgcacgccgccatcccccccctggaggaggtgtacagcctgcagagactgaaggccagaatcagccagagcaccaagaccttcaccccctgcgagagactggagaagagaagaaccagcttcctggagggcaccctgagaagaagcttcagaaccggcagcgtggtgagacagaaggtggaggaggagcagatgctggacatgtggatcaaggaggaggtgagcagcgccagagccagcatcatcgacaagtggagaaagttccagggcatgaaccaggagcaggccatggccaagtacatggccctgatcaaggagtggcccggctacggcagcaccctgttcgacgtggagtgcaaggagggcggcttcccccaggagctgtggctgggcgtgagcgccgacgccgtgagcgtgtacaagagaggcgagggcagacccctggaggtgttccagtacgagcacatcctgagcttcggcgcccccctggccaacacctacaagatcgtggtggacgagagagagctgctgttcgagaccagcgaggtggtggacgtggccaagctgatgaaggcctacatcagcatgatcgtgaagaagagatacagcaccaccagaagcgccagcagccagggcagcagcagatag

SEQ ID NO: 90076 - DNA, 4194 bp, Artificial Sequence; identical to SEQ ID NO: 90074
  Description of Artificial Sequence: Synthetic coding sequence

SEQ ID NO: 90077 - DNA, 552 bp, Artificial Sequence
  Description of Artificial Sequence: Synthetic coding sequence
atggagaacggcgccgtgtacagccccaccaccgaggaggaccccggccccgccagaggccccagaagcggcctggccgcctacttcttcatgggcagactgcccctgctgagaagagtgctgaagggcctgcagctgctgctgagcctgctggccttcatctgcgaggaggtggtgagccagtgcaccctgtgcggcggcctgtacttcttcgagttcgtgagctgcagcgccttcctgctgagcctgctgatcctgatcgtgtactgcacccccttctacgagagagtggacaccaccaaggtgaagagcagcgacttctacatcaccctgggcaccggctgcgtgttcctgctggccagcatcatcttcgtgagcacccacgacagaaccagcgccgagatcgccgccatcgtgttcggcttcatcgccagcttcatgttcctgctggacttcatcaccatgctgtacgagaagagacaggagagccagctgagaaagcccgagaacaccaccagagccgaggccctgaccgagcccctgaacgcctag

SEQ ID NO: 90078 - DNA, 1437 bp, Artificial Sequence
  Description of Artificial Sequence: Synthetic coding sequence
atgctggagttcgcccagaagtacttcagagacccccagagaagaccccaggacggcctgagactgaagagcaaggagcccagagagagcagaaccctggaggacatgctgtgcttcaccaagacccccctgcaggagagcctgatcgagctgagcgacagcagcctgagcaagatggccaccgacatgttcctggccgtgatgagattcatgggcgacgcccccctgaagggccagagcgacctggacgtgctgtgcaacctgctgaagctgtgcggcgaccacgaggtgatgagagacgagtgctactgccaggtggtgaagcagatcaccgacaacaccagcagcaagcaggacagctgccagagaggctggagactgctgtacatcgtgaccgcctaccacagctgcagcgaggtgctgcacccccacctgaccagattcctgcaggacgtgagcagaacccccggcctgcccttccagggcatcgccaaggcctgcgagcagaacctgcagaagaccctgagattcggcggcagactggagctgcccagcagcatcgagctgagagccatgctggccggcagaagcagcaagagacagctgttcctgctgcccggcggcctggagagacacctgaagatcaagacctgcaccgtggccctggacgtggtggaggagatctgcgccgagatggccctgaccagacccgaggccttcaacgagtacgtgatcttcgtggtgaccaacagaggccagcacgtgtgccccctgagcagaagagcctacatcctggacgtggccagcgagatggagcaggtggacggcggctacatgctgtggttcagaagagtgctgtgggaccagcccctgaagttcgagaacgagctgtacgtgaccatgcactacaaccaggtgctgcccgactacctgaagggcctgttcagcagcgtgcccgccagcagacccagcgagcagctgctgcagcaggtgagcaagctggccagcctgcagcacagagccaaggaccacttctacctgcccagcgtgagagaggtgcaggagtacatccccgcccagctgtacagaaccaccgccggcagcacctggctgaacctggtgagccagcacagacagcagacccaggccctgagcccccaccaggccagagcccagttcctgggcctgctgagcgccctgcccatgttcggcagcagcttcttcttcatccagagctgcagcaacatcgccgtgcccgccccctgcatcctggccatcaaccacaacggcctgaacttcctgagcaccgagacccacgtgagcggcctgagcctggccctgcccagcccccccagcgtgccctggagccccacccccagcaagagacccagaccccccgccgccgaggcccagttccactgcctgccccccagctag

SEQ ID NO: 90079 - DNA, 555 bp, Artificial Sequence
  Description of Artificial Sequence: Synthetic coding sequence
atgaacatgctgagcagcctgagccccaccgtggtgctgcccgactacctgaagggcctgttcagcagcgtgcccgccagcagacccagcgagcagctgctgcagcaggtgagcaagctggccagcctgcagcacagagccaaggaccacttctacctgcccagcgtgagagaggtgcaggagtacatccccgcccagctgtacagaaccaccgccggcagcacctggctgaacctggtgagccagcacagacagcagacccaggccctgagcccccaccaggccagagcccagttcctgggcctgctgagcgccctgcccatgttcggcagcagcttcttcttcatccagagctgcagcaacatcgccgtgcccgccccctgcatcctggccatcaaccacaacggcctgaacttcctgagcaccgagacccacgtgagcggcctgagcctggccctgcccagcccccccagcgtgccctggagccccacccccagcaagagacccagaccccccgccgccgaggcccagttccactgcctgccccccagctag

SEQ ID NO: 90080 - DNA, 735 bp, Artificial Sequence
  Description of Artificial Sequence: Synthetic coding sequence
atgagagacgagtgctactgccaggtggtgaagcagatcaccgacaacaccagcagcaagcaggacagctgccagagaggctggagactgctgtacatcgtgaccgcctaccacagctgcagcgaggtgctgcacccccacctgaccagattcctgcaggacgtgagcagaacccccggcctgcccttccagggcatcgccaaggcctgcgagcagaacctgcagaagaccctgagattcggcggcagactggagctgcccagcagcatcgagctgagagccatgctggccggcagaagcagcaagagacagctgttcctgctgcccggcggcctggagagacacctgaagatcaagacctgcaccgtggccctggacgtggtggaggagatctgcgccgagatggccctgaccagacccgaggccttcaacgagtacgtgatcttcgtggtgaccaacagaggcggcaagagcagaagcaccagccagcccagcagcaccgtgcagagacaggccagacccggcagcacctggagcgccagcaccggcagcagacacagaagaagcgcccccaccagacccgtgcccagcttctgggccagcagcgccccctacctgtgcagcgccccccccagcagcagcagcagagccgccgccaccctgctgtgccagcccctggccagcctgcccagcaccaccatggccagcaccttcagcgcccagagactgatgtag

SEQ ID NO: 90081 - DNA, 429 bp, Artificial Sequence
  Description of Artificial Sequence: Synthetic coding sequence
atggtgaagggcggccaggaggccggcggccagctgagagtgctgagagcctacagcttcgccgacatcctgttcgtgaccatgcccagccagaacatgctggagttcaacctggccagcgagaaggtgatcctgttcagcgccagagcccaccaggtgaagaccctggtggacgacttcatcctggagctgaagaaggacagcgactacgtggtggccgtgagaaacttcctgcccgaggaccccgccctgctggccttccacaagggcgacatcatccacctgcagcccctggagccccccagagtgggctacagcgccggctgcgtggtgagaagaaaggtggtgtacctggaggagctgagaagaagaggccccgacttcggcgtgtgccccagaacctggaaccccatcagaggcgccagctag

SEQ ID NO: 90082 - DNA, 6165 bp, Artificial Sequence
  Description of Artificial Sequence: Synthetic coding sequence
atgttcaacctgatgaagaaggacaaggacaaggacggcggcagaaaggagaagaaggagaagaaggagaagaaggagagaatgagcgccgccgagctgagaagcctggaggagatgagcctgagaagaggcttcttcaacctgaacagaagcagcaagagagagagcaagaccagactggagatcagcaaccccatccccatcaaggtggccagcggcagcgacctgcacctgaccgacatcgacagcgacagcaacagaggcagcgtgatcctggacagcggccacctgagcaccgccagcagcagcgacgacctgaagggcgaggagggcagcttcagaggcagcgtgctgcagagagccgccaagttcggcagcctggccaagcagaacagccagatgatcgtgaagagattcagcttcagccagagaagcagagacgagagcgccagcgagaccagcacccccagcgagcacagcgccgcccccagcccccaggtggaggtgagaaccctggagggccagctggtgcagcaccccggccccggcatccccagacccggccacagaagcagagcccccgagctggtgaccaagaagttccccgtggacctgagactgccccccgtggtgcccctgcccccccccaccctgagagagctggagctgcagagaagacccaccggcgacttcggcttcagcctgagaagaaccaccatgctggacagaggccccgagggccaggcctgcagaagagtggtgcacttcgccgagcccggcgccggcaccaaggacctggccctgggcctggtgcccggcgacagactggtggagatcaacggccacaacgtggagagcaagagcagagacgagatcgtggagatgatcagacagagcggcgacagcgtgagactgaaggtgcagcccatccccgagctgagcgagctgagcagaagctggctgagaagcggcgagggccccagaagagagcccagcgacgccaagaccgaggagcagatcgccgccgaggaggcctggaacgagaccgagaaggtgtggctggtgcacagagacggcttcagcctggccagccagctgaagagcgaggagctgaacctgcccgagggcaaggtgagagtgaagctggaccacgacggcgccatcctggacgtggacgaggacgacgtggagaaggccaacgcccccagctgcgacagactggaggacctggccagcctggtgtacctgaacgagagcagcgtgctgcacaccctgagacagagatacggcgccagcctgctgcacacctacgccggccccagcctgctggtgctgggccccagaggcgcccccgccgtgtacagcgagaaggtgatgcacatgttcaagggctgcagaagagaggacatggccccccacatctacgccgtggcccagaccgcctacagagccatgctgatgagcagacaggaccagagcatcatcctgctgggcagcagcggcagcggcaagaccaccagctgccagcacctggtgcagtacctggccaccatcgccggcatcagcggcaacaaggtgttcagcgtggagaagtggcaggccctgtacaccctgctggaggccttcggcaacagccccaccatcatcaacggcaacgccaccagattcagccagatcctgagcctggacttcgaccaggccggccaggtggccagcgccagcatccagaccatgctgctggagaagctgagagtggccagaagacccgccagcgaggccaccttcaacgtgttctactacctgctggcctgcggcgacggcaccctgagaaccgagctgcacctgaaccacctggccgagaacaacgtgttcggcatcgtgcccctggccaagcccgaggagaagcagaaggccgcccagcagttcagcaagctgcaggccgccatgaaggtgctgggcatcagccccgacgagcagaaggcctgctggttcatcctggccgccatctaccacctgggcgccgccggcgccaccaaggtgcacagcaccgccggcagaaagcagttcgccagacacgagtgggcccagaaggccgcctacctgctgggctgcagcctggaggagctgagcagcgccatcttcaagcaccagcacaagggcggcaccctgcagagaagcaccagcttcagacagggccccgaggagagcggcctgggcgacggcaccggccccaagctgagcgccctggagtgcctggagggcatggccgccggcctgtacagcgagctgttcaccctgctggtgagcctggtgaacagagccctgaagagcagccagcacagcctgtgcagcatgatgatcgtggacacccccggcttccagaaccccgagcagggcggcagcgccagaggcgccagcttcgaggagctgtgccacaactacacccaggacagactgcagagactgttccacgagagaaccttcgtgcaggagctggagagatacaaggaggagaacatcgagctggccttcgacgacctggagccccccaccgacgacagcgtggccgccgtggaccaggccagccaccagagcctggtgagaagcctggccagaaccgacgaggccagaggcctgctgtggctgctggaggaggaggccctggtgcccggcgccagcgaggacaccctgctggagagactgttcagctactacggcccccaggagggcgacaagaagggccagagccccctgctgcacagcagcaagccccaccacttcctgctgggccacagccacggcaccaactgggtggagtacaacgtgaccggctggctgaactacaccaagcagaaccccgccacccagaacgcccccagactgctgcaggacagccagaagaagatcatcagcaacctgttcctgggcagagccggcagcgccaccgtgctgagcggcagcatcgccggcctggagggcggcagccagctggccctgagaagagccaccagcatgagaaagaccttcaccaccggcatggccgccgtgaagaagaagagcctgtgcatccagatgaagctgcaggtggacgccctgatcgacaccatcaagaagagcaagctgcacttcgtgcactgcttcctgcccgtggccgagggctgggccggcgagcccagaagcgccagcagcagaagagtgagcagcagcagcgagctggacctgcccagcggcgaccactgcgaggccggcctgctgcagctggacgtgcccctgctgagaacccagctgagaggcagcagactgctggacgccatgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccggcaccatccagatgctggagcaggccaagctgagactggagatggagatggagagaatgagacagacccacagcaaggagatggagagcagagacgaggaggtggaggaggccagacagagctgccagaagaagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcctgcaggacatggtgaccaagtaccagaagagaaagaacaagctggagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90083 - DNA, 6009 bp, Artificial Sequence
  Description of Artificial Sequence: Synthetic coding sequence
atgttcaacctgatgaagaaggacaaggacaaggacggcggcagaaaggagaagaaggagaagaaggagaagaaggagagaatgagcgccgccgagctgagaagcctggaggagatgagcctgagaagaggcttcttcaacctgaacagaagcagcaagagagagagcaagaccagactggagatcagcaaccccatccccatcaaggtggccagcggcagcgacctgcacctgaccgacatcgacagcgacagcaacagaggcagcgtgatcctggacagcggccacctgagcaccgccagcagcagcgacgacctgaagggcgaggagggcagcttcagaggcagcgtgctgcagagagccgccaagttcggcagcctggccaagcagaacagccagatgatcgtgaagagattcagcttcagccagagaagcagagacgagagcgccagcgagaccagcacccccagcgagcacagcgccgcccccagcccccaggtggaggtgagaaccctggagggccagctggtgcagcaccccggccccggcatccccagacccggccacagaagcagagcccccgagctggtgaccaagaagttccccgtggacctgagactgccccccgtggtgcccctgcccccccccaccctgagagagctggagctgcagagaagacccaccggcgacttcggcttcagcctgagaagaaccaccatgctggacagaggccccgagggccaggcctgcagaagagtggtgcacttcgccgagcccggcgccggcaccaaggacctggccctgggcctggtgcccggcgacagactggtggagatcaacggccacaacgtggagagcaagagcagagacgagatcgtggagatgatcagacagagcggcgacagcgtgagactgaaggtgcagcccatccccgagctgagcgagctgagcagaagctggctgagaagcggcgagggccccagaagagagcccagcgacgccaagaccgaggagcagatcgccgccgaggaggcctggaacgagaccgagaaggtgtggctggtgcacagagacggcttcagcctggccagccagctgaagagcgaggagctgaacctgcccgagggcaaggtgagagtgaagctggaccacgacggcgccatcctggacgtggacgaggacgacgtggagaaggccaacgcccccagctgcgacagactggaggacctggccagcctggtgtacctgaacgagagcagcgtgctgcacaccctgagacagagatacggcgccagcctgctgcacacctacgccggccccagcctgctggtgctgggccccagaggcgcccccgccgtgtacagcgagaaggtgatgcacatgttcaagggctgcagaagagaggacatggccccccacatctacgccgtggcccagaccgcctacagagccatgctgatgagcagacaggaccagagcatcatcctgctgggcagcagcggcagcggcaagaccaccagctgccagcacctggtgcagtacctggccaccatcgccggcatcagcggcaacaaggtgttcagcgtggagaagtggcaggccctgtacaccctgctggaggccttcggcaacagccccaccatcatcaacggcaacgccaccagattcagccagatcctgagcctggacttcgaccaggccggccaggtggccagcgccagcatccagaccatgctgctggagaagctgagagtggccagaagacccgccagcgaggccaccttcaacgtgttctactacctgctggcctgcggcgacggcaccctgagaaccgagctgcacctgaaccacctggccgagaacaacgtgttcggcatcgtgcccctggccaagcccgaggagaagcagaaggccgcccagcagttcagcaagctgcaggccgccatgaaggtgctgggcatcagccccgacgagcagaaggcctgctggttcatcctggccgccatctaccacctgggcgccgccggcgccaccaaggtgcacagcaccgccggcagaaagcagttcgccagacacgagtgggcccagaaggccgcctacctgctgggctgcagcctggaggagctgagcagcgccatcttcaagcaccagcacaagggcggcaccctgcagagaagcaccagcttcagacagggccccgaggagagcggcctgggcgacggcaccggccccaagctgagcgccctggagtgcctggagggcatggccgccggcctgtacagcgagctgttcaccctgctggtgagcctggtgaacagagccctgaagagcagccagcacagcctgtgcagcatgatgatcgtggacacccccggcttccagaaccccgagcagggcggcagcgccagaggcgccagcttcgaggagctgtgccacaactacacccaggacagactgcagagactgttccacgagagaaccttcgtgcaggagctggagagatacaaggaggagaacatcgagctggccttcgacgacctggagccccccaccgacgacagcgtggccgccgtggaccaggccagccaccagagcctggtgagaagcctggccagaaccgacgaggccagaggcctgctgtggctgctggaggaggaggccctggtgcccggcgccagcgaggacaccctgctggagagactgttcagctactacggcccccaggagggcgacaagaagggccagagccccctgctgcacagcagcaagccccaccacttcctgctgggccacagccacggcaccaactgggtggagtacaacgtgaccggctggctgaactacaccaagcagaaccccgccacccagaacgcccccagactgctgcaggacagccagaagaagatcatcagcaacctgttcctgggcagagccggcagcgccaccgtgctgagcggcagcatcgccggcctggagggcggcagccagctggccctgagaagagccaccagcatgagaaagaccttcaccaccggcatggccgccgtgaagaagaagagcctgtgcatccagatgaagctgcaggtggacgccctgatcgacaccatcaagaagagcaagctgcacttcgtgcactgcttcctgcccgtggccgagggctgggccggcgagcccagaagcgccagcagcagaagagtgagcagcagcagcgagctggacctgcccagcggcgaccactgcgaggccggcctgctgcagctggacgtgcccctgctgagaacccagctgagaggcagcagactgctggacgccatgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccggcaccatccagatgctggagcagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcgagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90084 - DNA, 4929 bp, Artificial Sequence
  Description of Artificial Sequence: Synthetic coding sequence
atggagggccccagaaccaccaagctggagggcagcagcaaggagggcagcggccccagcagaagcccccagccccccaccagccccatcccccccgagaccagccagagagccagaagccccgcccccaccctggccatgaacggccccggcgccgccaccgccgagggcctgagcgaggaggcccccgccgtgtacagcgagaaggtgatgcacatgttcaagggctgcagaagagaggacatggccccccacatctacgccgtggcccagaccgcctacagagccatgctgatgagcagacaggaccagagcatcatcctgctgggcagcagcggcagcggcaagaccaccagctgccagcacctggtgcagtacctggccaccatcgccggcatcagcggcaacaaggtgttcagcgtggagaagtggcaggccctgtacaccctgctggaggccttcggcaacagccccaccatcatcaacggcaacgccaccagattcagccagatcctgagcctggacttcgaccaggccggccaggtggccagcgccagcatccagaccatgctgctggagaagctgagagtggccagaagacccgccagcgaggccaccttcaacgtgttctactacctgctggcctgcggcgacggcaccctgagaaccgagctgcacctgaaccacctggccgagaacaacgtgttcggcatcgtgcccctggccaagcccgaggagaagcagaaggccgcccagcagttcagcaagctgcaggccgccatgaaggtgctgggcatcagccccgacgagcagaaggcctgctggttcatcctggccgccatctaccacctgggcgccgccggcgccaccaaggaggccgccgaggccggcagaaagcagttcgccagacacgagtgggcccagaaggccgcctacctgctgggctgcagcctggaggagctgagcagcgccatcttcaagcaccagcacaagggcggcaccctgcagagaagcaccagcttcagacagggccccgaggagagcggcctgggcgacggcaccggccccaagctgagcgccctggagtgcctggagggcatggccgccggcctgtacagcgagctgttcaccctgctggtgagcctggtgaacagagccctgaagagcagccagcacagcctgtgcagcatgatgatcgtggacacccccggcttccagaaccccgagcagggcggcagcgccagaggcgccagcttcgaggagctgtgccacaactacacccaggacagactgcagagactgttccacgagagaaccttcgtgcaggagctggagagatacaaggaggagaacatcgagctggccttcgacgacctggagccccccaccgacgacagcgtggccgccgtggaccaggccagccaccagagcctggtgagaagcctggccagaaccgacgaggccagaggcctgctgtggctgctggaggaggaggccctggtgcccggcgccagcgaggacaccctgctggagagactgttcagctactacggcccccaggagggcgacaagaagggccagagccccctgctgcacagcagcaagccccaccacttcctgctgggccacagccacggcaccaactgggtggagtacaacgtgaccggctggctgaactacaccaagcagaaccccgccacccagaacgcccccagactgctgcaggacagccagaagaagatcatcagcaacctgttcctgggcagagccggcagcgccaccgtgctgagcggcagcatcgccggcctggagggcggcagccagctggccctgagaagagccaccagcatgagaaagaccttcaccaccggcatggccgccgtgaagaagaagagcctgtgcatccagatgaagctgcaggtggacgccctgatcgacaccatcaagaagagcaagctgcacttcgtgcactgcttcctgcccgtggccgagggctgggccggcgagcccagaagcgccagcagcagaagagtgagcagcagcagcgagctggacctgcccagcggcgaccactgcgaggccggcctgctgcagctggacgtgcccctgctgagaacccagctgagaggcagcagactgctggacgccatgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccaagctgagactggagatggagatggagagaatgagacagacccacagcaaggagatggagagcagagacgaggaggtggaggaggccagacagagctgccagaagaagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcgagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90085 - DNA, 6165 bp, Artificial Sequence
  Description of Artificial Sequence: Synthetic coding sequence
atgttcaacctgatgaagaaggacaaggacaaggacggcggcagaaaggagaagaaggagaagaaggagaagaaggagagaatgagcgccgccgagctgagaagcctggaggagatgagcctgagaagaggcttcttcaacctgaacagaagcagcaagagagagagcaagaccagactggagatcagcaaccccatccccatcaaggtggccagcggcagcgacctgcacctgaccgacatcgacagcgacagcaacagaggcagcgtgatcctggacagcggccacctgagcaccgccagcagcagcgacgacctgaagggcgaggagggcagcttcagaggcagcgtgctgcagagagccgccaagttcggcagcctggccaagcagaacagccagatgatcgtgaagagattcagcttcagccagagaagcagagacgagagcgccagcgagaccagcacccccagcgagcacagcgccgcccccagcccccaggtggaggtgagaaccctggagggccagctggtgcagcaccccggccccggcatccccagacccggccacagaagcagagcccccgagctggtgaccaagaagttccccgtggacctgagactgccccccgtggtgcccctgcccccccccaccctgagagagctggagctgcagagaagacccaccggcgacttcggcttcagcctgagaagaaccaccatgctggacagaggccccgagggccaggcctgcagaagagtggtgcacttcgccgagcccggcgccggcaccaaggacctggccctgggcctggtgcccggcgacagactggtggagatcaacggccacaacgtggagagcaagagcagagacgagatcgtggagatgatcagacagagcggcgacagcgtgagactgaaggtgcagcccatccccgagctgagcgagctgagcagaagctggctgagaagcggcgagggccccagaagagagcccagcgacgccaagaccgaggagcagatcgccgccgaggaggcctggaacgagaccgagaaggtgtggctggtgcacagagacggcttcagcctggccagccagctgaagagcgaggagctgaacctgcccgagggcaaggtgagagtgaagctggaccacgacggcgccatcctggacgtggacgaggacgacgtggagaaggccaacgcccccagctgcgacagactggaggacctggccagcctggtgtacctgaacgagagcagcgtgctgcacaccctgagacagagatacggcgccagcctgctgcacacctacgccggccccagcctgctggtgctgggccccagaggcgcccccgccgtgtacagcgagaaggtgatgcacatgttcaagggctgcagaagagaggacatggccccccacatctacgccgtggcccagaccgcctacagagccatgctgatgagcagacaggaccagagcatcatcctgctgggcagcagcggcagcggcaagaccaccagctgccagcacctggtgcagtacctggccaccatcgccggcatcagcggcaacaaggtgttcagcgtggagaagtggcaggccctgtacaccctgctggaggccttcggcaacagccccaccatcatcaacggcaacgccaccagattcagccagatcctgagcctggacttcgaccaggccggccaggtggccagcgccagcatccagaccatgctgctggagaagctgagagtggccagaagacccgccagcgaggccaccttcaacgtgttctactacctgctggcctgcggcgacggcaccctgagaaccgagctgcacctgaaccacctggccgagaacaacgtgttcggcatcgtgcccctggccaagcccgaggagaagcagaaggccgcccagcagttcagcaagctgcaggccgccatgaaggtgctgggcatcagccccgacgagcagaaggcctgctggttcatcctggccgccatctaccacctgggcgccgccggcgccaccaaggaggccgccgaggccggcagaaagcagttcgccagacacgagtgggcccagaaggccgcctacctgctgggctgcagcctggaggagctgagcagcgccatcttcaagcaccagcacaagggcggcaccctgcagagaagcaccagcttcagacagggccccgaggagagcggcctgggcgacggcaccggccccaagctgagcgccctggagtgcctggagggcatggccgccggcctgtacagcgagctgttcaccctgctggtgagcctggtgaacagagccctgaagagcagccagcacagcctgtgcagcatgatgatcgtggacacccccggcttccagaaccccgagcagggcggcagcgccagaggcgccagcttcgaggagctgtgccacaactacacccaggacagactgcagagactgttccacgagagaaccttcgtgcaggagctggagagatacaaggaggagaacatcgagctggccttcgacgacctggagccccccaccgacgacagcgtggccgccgtggaccaggccagccaccagagcctggtgagaagcctggccagaaccgacgaggccagaggcctgctgtggctgctggaggaggaggccctggtgcccggcgccagcgaggacaccctgctggagagactgttcagctactacggcccccaggagggcgacaagaagggccagagccccctgctgcacagcagcaagccccaccacttcctgctgggccacagccacggcaccaactgggtggagtacaacgtgaccggctggctgaactacaccaagcagaaccccgccacccagaacgcccccagactgctgcaggacagccagaagaagatcatcagcaacctgttcctgggcagagccggcagcgccaccgtgctgagcggcagcatcgccggcctggagggcggcagccagctggccctgagaagagccaccagcatgagaaagaccttcaccaccggcatggccgccgtgaagaagaagagcctgtgcatccagatgaagctgcaggtggacgccctgatcgacaccatcaagaagagcaagctgcacttcgtgcactgcttcctgcccgtggccgagggctgggccggcgagcccagaagcgccagcagcagaagagtgagcagcagcagcgagctggacctgcccagcggcgaccactgcgaggccggcctgctgcagctggacgtgcccctgctgagaacccagctgagaggcagcagactgctggacgccatgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccggcaccatccagatgctggagcaggccaagctgagactggagatggagatggagagaatgagacagacccacagcaaggagatggagagcagagacgaggaggtggaggaggccagacagagctgccagaagaagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcctgcaggacatggtgaccaagtaccagaagagaaagaacaagctggagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90086 - DNA, 2808 bp, Artificial Sequence
  Description of Artificial Sequence: Synthetic coding sequence
atgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccggcaccatccagatgctggagcaggccaagctgagactggagatggagatggagagaatgagacagacccacagcaaggagatggagagcagagacgaggaggtggaggaggccagacagagctgccagaagaagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcgagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90087 - DNA, 6120 bp, Artificial Sequence
  Description of Artificial Sequence: Synthetic coding sequence
atgttcaacctgatgaagaaggacaaggacaaggacggcggcagaaaggagaagaaggagaagaaggagaagaaggagagaatgagcgccgccgagctgagaagcctggaggagatgagcctgagaagaggcttcttcaacctgaacagaagcagcaagagagagagcaagaccagactggagatcagcaaccccatccccatcaaggtggccagcggcagcgacctgcacctgaccgacatcgacagcgacagcaacagaggcagcgtgatcctggacagcggccacctgagcaccgccagcagcagcgacgacctgaagggcgaggagggcagcttcagaggcagcgtgctgcagagagccgccaagttcggcagcctggccaagcagaacagccagatgatcgtgaagagattcagcttcagccagagaagcagagacgagagcgccagcgagaccagcacccccagcgagcacagcgccgcccccagcccccaggtggaggtgagaaccctggagggccagctggtgcagcaccccggccccggcatccccagacccggccacagaagcagagcccccgagctggtgaccaagaagttccccgtggacctgagactgccccccgtggtgcccctgcccccccccaccctgagagagctggagctgcagagaagacccaccggcgacttcggcttcagcctgagaagaaccaccatgctggacagaggccccgagggccaggcctgcagaagagtggtgcacttcgccgagcccggcgccggcaccaaggacctggccctgggcctggtgcccggcgacagactggtggagatcaacggccacaacgtggagagcaagagcagagacgagatcgtggagatgatcagacagagcggcgacagcgtgagactgaaggtgcagcccatccccgagctgagcgagctgagcagaagctggctgagaagcggcgagggccccagaagagagcccagcgacgccaagaccgaggagcagatcgccgccgaggaggcctggaacgagaccgagaaggtgtggctggtgcacagagacggcttcagcctggccagccagctgaagagcgaggagctgaacctgcccgagggcaaggtgagagtgaagctggaccacgacggcgccatcctggacgtggacgaggacgacgtggagaaggccaacgcccccagctgcgacagactggaggacctggccagcctggtgtacctgaacgagagcagcgtgctgcacaccctgagacagagatacggcgccagcctgctgcacacctacgccggccccagcctgctggtgctgggccccagaggcgcccccgccgtgtacagcgagaaggtgatgcacatgttcaagggctgcagaagagaggacatggccccccacatctacgccgtggcccagaccgcctacagagccatgctgatgagcagacaggaccagagcatcatcctgctgggcagcagcggcagcggcaagaccaccagctgccagcacctggtgcagtacctggccaccatcgccggcatcagcggcaacaaggtgttcagcgtggagaagtggcaggccctgtacaccctgctggaggccttcggcaacagccccaccatcatcaacggcaacgccaccagattcagccagatcctgagcctggacttcgaccaggccggccaggtggccagcgccagcatccagaccatgctgctggagaagctgagagtggccagaagacccgccagcgaggccaccttcaacgtgttctactacctgctggcctgcggcgacggcaccctgagaaccgagctgcacctgaaccacctggccgagaacaacgtgttcggcatcgtgcccctggccaagcccgaggagaagcagaaggccgcccagcagttcagcaagctgcaggccgccatgaaggtgctgggcatcagccccgacgagcagaaggcctgctggttcatcctggccgccatctaccacctgggcgccgccggcgccaccaaggaggccgccgaggccggcagaaagcagttcgccagacacgagtgggcccagaaggccgcctacctgctgggctgcagcctggaggagctgagcagcgccatcttcaagcaccagcacaagggcggcaccctgcagagaagcaccagcttcagacagggccccgaggagagcggcctgggcgacggcaccggccccaagctgagcgccctggagtgcctggagggcatggccgccggcctgtacagcgagctgttcaccctgctggtgagcctggtgaacagagccctgaagagcagccagcacagcctgtgcagcatgatgatcgtggacacccccggcttccagaaccccgagcagggcggcagcgccagaggcgccagcttcgaggagctgtgccacaactacacccaggacagactgcagagactgttccacgagagaaccttcgtgcaggagctggagagatacaaggaggagaacatcgagctggccttcgacgacctggagccccccaccgacgacagcgtggccgccgtggaccaggccagccaccagagcctggtgagaagcctggccagaaccgacgaggccagaggcctgctgtggctgctggaggaggaggccctggtgcccggcgccagcgaggacaccctgctggagagactgttcagctactacggcccccaggagggcgacaagaagggccagagccccctgctgcacagcagcaagccccaccacttcctgctgggccacagccacggcaccaactgggtggagtacaacgtgaccggctggctgaactacaccaagcagaaccccgccacccagaacgcccccagactgctgcaggacagccagaagaagatcatcagcaacctgttcctgggcagagccggcagcgccaccgtgctgagcggcagcatcgccggcctggagggcggcagccagctggccctgagaagagccaccagcatgagaaagaccttcaccaccggcatggccgccgtgaagaagaagagcctgtgcatccagatgaagctgcaggtggacgccctgatcgacaccatcaagaagagcaagctgcacttcgtgcactgcttcctgcccgtggccgagggctgggccggcgagcccagaagcgccagcagcagaagagtgagcagcagcagcgagctggacctgcccagcggcgaccactgcgaggccggcctgctgcagctggacgtgcccctgctgagaacccagctgagaggcagcagactgctggacgccatgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccggcaccatccagatgctggagcaggccaagctgagactggagatggagatggagagaatgagacagacccacagcaaggagatggagagcagagacgaggaggtggaggaggccagacagagctgccagaagaagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcgagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90088 - DNA, 6009 bp, Artificial Sequence
  Description of Artificial Sequence: Synthetic coding sequence
atgttcaacctgatgaagaaggacaaggacaaggacggcggcagaaaggagaagaaggagaagaaggagaagaaggagagaatgagcgccgccgagctgagaagcctggaggagatgagcctgagaagaggcttcttcaacctgaacagaagcagcaagagagagagcaagaccagactggagatcagcaaccccatccccatcaaggtggccagcggcagcgacctgcacctgaccgacatcgacagcgacagcaacagaggcagcgtgatcctggacagcggccacctgagcaccgccagcagcagcgacgacctgaagggcgaggagggcagcttcagaggcagcgtgctgcagagagccgccaagttcggcagcctggccaagcagaacagccagatgatcgtgaagagattcagcttcagccagagaagcagagacgagagcgccagcgagaccagcacccccagcgagcacagcgccgcccccagcccccaggtggaggtgagaaccctggagggccagctggtgcagcaccccggccccggcatccccagacccggccacagaagcagagcccccgagctggtgaccaagaagttccccgtggacctgagactgccccccgtggtgcccctgcccccccccaccctgagagagctggagctgcagagaagacccaccggcgacttcggcttcagcctgagaagaaccaccatgctggacagaggccccgagggccaggcctgcagaagagtggtgcacttcgccgagcccggcgccggcaccaaggacctggccctgggcctggtgcccggcgacagactggtggagatcaacggccacaacgtggagagcaagagcagagacgagatcgtggagatgatcagacagagcggcgacagcgtgagactgaaggtgcagcccatccccgagctgagcgagctgagcagaagctggctgagaagcggcgagggccccagaagagagcccagcgacgccaagaccgaggagcagatcgccgccgaggaggcctggaacgagaccgagaaggtgtggctggtgcacagagacggcttcagcctggccagccagctgaagagcgaggagctgaacctgcccgagggcaaggtgagagtgaagctggaccacgacggcgccatcctggacgtggacgaggacgacgtggagaaggccaacgcccccagctgcgacagactggaggacctggccagcctggtgtacctgaacgagagcagcgtgctgcacaccctgagacagagatacggcgccagcctgctgcacacctacgccggccccagcctgctggtgctgggccccagaggcgcccccgccgtgtacagcgagaaggtgatgcacatgttcaagggctgcagaagagaggacatggccccccacatctacgccgtggcccagaccgcctacagagccatgctgatgagcagacaggaccagagcatcatcctgctgggcagcagcggcagcggcaagaccaccagctgccagcacctggtgcagtacctggccaccatcgccggcatcagcggcaacaaggtgttcagcgtggagaagtggcaggccctgtacaccctgctggaggccttcggcaacagccccaccatcatcaacggcaacgccaccagattcagccagatcctgagcctggacttcgaccaggccggccaggtggccagcgccagcatccagaccatgctgctggagaagctgagagtggccagaagacccgccagcgaggccaccttcaacgtgttctactacctgctggcctgcggcgacggcaccctgagaaccgagctgcacctgaaccacctggccgagaacaacgtgttcggcatcgtgcccctggccaagcccgaggagaagcagaaggccgcccagcagttcagcaagctgcaggccgccatgaaggtgctgggcatcagccccgacgagcagaaggcctgctggttcatcctggccgccatctaccacctgggcgccgccggcgccaccaaggaggccgccgaggccggcagaaagcagttcgccagacacgagtgggcccagaaggccgcctacctgctgggctgcagcctggaggagctgagcagcgccatcttcaagcaccagcacaagggcggcaccctgcagagaagcaccagcttcagacagggccccgaggagagcggcctgggcgacggcaccggccccaagctgagcgccctggagtgcctggagggcatggccgccggcctgtacagcgagctgttcaccctgctggtgagcctggtgaacagagccctgaagagcagccagcacagcctgtgcagcatgatgatcgtggacacccccggcttccagaaccccgagcagggcggcagcgccagaggcgccagcttcgaggagctgtgccacaactacacccaggacagactgcagagactgttccacgagagaaccttcgtgcaggagctggagagatacaaggaggagaacatcgagctggccttcgacgacctggagccccccaccgacgacagcgtggccgccgtggaccaggccagccaccagagcctggtgagaagcctggccagaaccgacgaggccagaggcctgctgtggctgctggaggaggaggccctggtgcccggcgccagcgaggacaccctgctggagagactgttcagctactacggcccccaggagggcgacaagaagggccagagccccctgctgcacagcagcaagccccaccacttcctgctgggccacagccacggcaccaactgggtggagtacaacgtgaccggctggctgaactacaccaagcagaaccccgccacccagaacgcccccagactgctgcaggacagccagaagaagatcatcagcaacctgttcctgggcagagccggcagcgccaccgtgctgagcggcagcatcgccggcctggagggcggcagccagctggccctgagaagagccaccagcatgagaaagaccttcaccaccggcatggccgccgtgaagaagaagagcctgtgcatccagatgaagctgcaggtggacgccctgatcgacaccatcaagaagagcaagctgcacttcgtgcactgcttcctgcccgtggccgagggctgggccggcgagcccagaagcgccagcagcagaagagtgagcagcagcagcgagctggacctgcccagcggcgaccactgcgaggccggcctgctgcagctggacgtgcccctgctgagaacccagctgagaggcagcagactgctggacgccatgagaatgtacagacagggctaccccgaccacatggtgttcagcgagttcagaagaagattcgacgtgctggccccccacctgaccaagaagcacggcagaaactacatcgtggtggacgagagaagagccgtggaggagctgctggagtgcctggacctggagaagagcagctgctgcatgggcctgagcagagtgttcttcagagccggcaccctggccagactggaggagcagagagacgagcagaccagcagaaacctgaccctgttccaggccgcctgcagaggctacctggccagacagcacttcaagaagagaaagatccaggacctggccatcagatgcgtgcagaagaacatcaagaagaacaagggcgtgaaggactggccctggtggaagctgttcaccaccgtgagacccctgatcgaggtgcagctgagcgaggagcagatcagaaacaaggacgaggagatccagcagctgagaagcaagctggagaaggccgagaaggagagaaacgagctgagactgaacagcgacagactggagagcagaatcagcgagctgaccagcgagctgaccgacgagagaaacaccggcgagagcgccagccagctgctggacgccgagaccgccgagagactgagagccgagaaggagatgaaggagctgcagacccagtacgacgccctgaagaagcagatggaggtgatggagatggaggtgatggaggccagactgatcagagccgccgagatcaacggcgaggtggacgacgacgacgccggcggcgagtggagactgaagtacgagagagccgtgagagaggtggacttcaccaagaagagactgcagcaggagttcgaggacaagctggaggtggagcagcagaacaagagacagctggagagaagactgggcgacctgcaggccgacagcgaggagagccagagagccctgcagcagctgaagaagaagtgccagagactgaccgccgagctgcaggacaccaagctgcacctggagggccagcaggtgagaaaccacgagctggagaagaagcagagaagattcgacagcgagctgagccaggcccacgaggaggcccagagagagaagctgcagagagagaagctgcagagagagaaggacatgctgctggccgaggccttcagcctgaagcagcagctggaggagaaggacatggacatcgccggcttcacccagaaggtggtgagcctggaggccgagctgcaggacatcagcagccaggagagcaaggacgaggccagcctggccaaggtgaagaagcagctgagagacctggaggccaaggtgaaggaccaggaggaggagctggacgagcaggccggcaccatccagatgctggagcagctgaagcagatggaggtgcagctggaggaggagtacgaggacaagcagaaggtgctgagagagaagagagagctggagggcaagctggccaccctgagcgaccaggtgaacagaagagacttcgagagcgagaagagactgagaaaggacctgaagagaaccaaggccctgctggccgacgcccagctgatgctggaccacctgaagaacagcgcccccagcaagagagagatcgcccagctgaagaaccagctggaggagagcgagttcacctgcgccgccgccgtgaaggccagaaaggccatggaggtggagatcgaggacctgcacctgcagatcgacgacatcgccaaggccaagaccgccctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcgagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90089 - DNA, 2808 bp, Artificial Sequence; identical to SEQ ID NO: 90086
  Description of Artificial Sequence: Synthetic coding sequence

SEQ ID NO: 90090 - DNA, 963 bp, Artificial Sequence
  Description of Artificial Sequence: Synthetic coding sequence
atgaccttcgtgctgctgagcagcagccagctggaggagcagctgagcagactgcagagagagaagaacgagatccagaacagactggaggaggaccaggaggacatgaacgagctgatgaagaagcacaaggccgccgtggcccaggccagcagagacctggcccagatcaacgacctgcaggcccagctggaggaggccaacaaggagaagcaggagctgcaggagaagctgcaggccctgcagagccaggtggagttcctggagcagagcatggtggacaagagcctggtgagcagacaggaggccaagatcagagagctggagaccagactggagttcgagagaacccaggtgaagagactggagagcctggccagcagactgaaggagaacatggagaagctgaccgaggagagagaccagagaatcgccgccgagaacagagagaaggagcagaacaagagactgcagagacagctgagagacaccaaggaggagatgggcgagctggccagaaaggaggccgaggccagcagaaagaagcacgagctggagatggacctggagagcctggaggccgccaaccagagcctgcaggccgacctgaagctggccttcaagagaatcggcgacctgcaggccgccatcgaggacgagatggagagcgacgagaacgaggacctgatcaacagcgagggcgacagcgacgtggacagcgagctggaggacagagtggacggcgtgaagagctggctgagcaagaacaagggccccagcaaggccgccagcgacgacggcagcctgaagagcagcagccccaccagctactggaagagcctggcccccgacagaagcgacgacgagcacgaccccctggacaacaccagcagacccagatacagccacagctacctgagcgacagcgacaccgaggccaagctgaccgagaccaacgcctag

SEQ ID NO: 90091 - DNA, 7704 bp, Artificial Sequence
  Description of Artificial Sequence: Synthetic coding sequence
atggccatcagcagcagactggccctgtgggagcagaagatcagagaggaggacaagagccccccccccagcagccccccccccctgttcagcgtgatccccggcggcttcatcaagcagctggtgagaggcaccgagaaggaggccaaggaggccagacagagaaagcagctggccgtggccagccccgagagagagatccccgagatcagcatcagccagcccaacagcaagagcagcagcggcaccagaagcggcagccagcagatcagccaggacgaccagagcagcagccccggcagcagcgacatcctgggcaaggagagcgagggcagcagaagccccgaccccgagcagatgaccagcatcaacggcgagaaggcccaggagctgggcagcagcgccacccccaccaagaagaccgtgcccttcaagagaggcgtgagaagaggcgacgtgctgctgatggtggccaagctggaccccgacagcgccaagcccgagaagacccacccccacgacgcccccccctgcaagaccagcccccccgccaccgacaccggcaaggagaagaagggcgagaccagcagaaccccctgcggcagccaggccagcaccgagatcctggcccccaaggccgagaagaccagaaccggcggcctgggcgaccccggccagggcaccgtggccctgaagaagggcgaggagggccagagcatcgtgggcaagggcctgggcacccccaagaccaccgagctgaaggaggccgagccccagggcaaggacagacagggcaccagaccccaggcccagggccccggcgagggcgtgagacccggcaaggccgagaaggagggcgccgagcccaccaacaccgtggagaagggcaacgtgagcaaggacgtgggcagcgagggcaagcacgtgagaccccagatccccggcagaaagtggggcggcttcctgggcagaagaagcaagtgggacggcccccagaacaagaaggacaaggagggcgtgctgctgagcaaggccgagaagaccggcgagccccagacccagatggagaagaccagccaggtgcagggcgagctgggcgacgacctgagaatgggcgagaaggccggcgagctgagaagcaccaccggcaaggccggcgagagctgggacaagaaggagaagatgggccagccccagggcaagagcggcaacgccggcgaggccagaagccagaccgagaagggctgcgaggcccccaaggaggtgagcaccatggtggagagccccgccgcccccggcaagggcggctggcccggcagcagaggccaggaggccgaggagccctgcagcagagccggcgacggcgccggcgccctggagaccgagctggagggccccagccagcccgccctggagaaggacgccgagagacccagaatcagaaaggagaaccaggacggccccgccccccaggaggagggcaagggcggccagagcagagacagcgaccaggcccccgaggacagatggtacgaggccgagaaggtgtggctggcccagaaggacggcttcaccctggccaccgtgctgaagcccgacgagggcaccgccgacctgcccgccggcagagtgagactgtggatcgacgccgacaagaccatcaccgaggtggacgaggagcacgtgcacagagccaacccccccgagctggaccaggtggaggacctggccagcctgatcagcgtgaacgagagcagcgtgctgaacaccctgctgcagagatacaaggcccagctgctgcacacctgcaccggccccgacctgatcgtgctgcagcccagaggccccagcgtgcccagcgccggcaaggtgcccaagggcagaagagacggcctgcccgcccacatcggcagcatggcccagagagcctactgggccctgctgaaccagagaagagaccagagcatcgtggccctgggctggagcggcgccggcaagaccacctgctgcgagcaggtgctggagcacctggtgggcatggccggcagcgtggacggcagagtgagcgtggagaagatcagagccaccttcaccgtgctgagagccttcggcagcgtgagcatggcccacagcagaagcgccaccagattcagcatggtgatgagcctggacttcaacgccaccggcagaatcaccgccgcccagctgcagaccatgctgctggagaagagcagagtggccagacagcccgagggcgagagcaacttcctggtgttcagccagatgctggccggcctggacctggacctgagaaccgagctgaacctgcaccagatggccgacagcagcagcttcggcatgggcgtgtggagcaagcccgaggacaagcagaaggccgccgccgccttcgcccagctgcagggcgccatggagatgctgggcatcagcgagagcgagcagagagccgtgtggagagtgctggccgccatctaccacctgggcgccgccggcgcctgcaaggtgggcagaaagcagttcatgagattcgagtgggccaactacgccgccgaggccctgggctgcgagtacgaggagctgaacaccgccaccttcaagcaccacctgagacagatcatccagcagatgaccttcggccccagcagatggggcctggaggacgaggagaccagcagcggcctgaagatgaccggcgtggactgcgtggagggcatggccagcggcctgtaccaggagctgttcgccgccgtggtgagcctgatcaacagaagcttcagcagccaccacctgagcatggccagcatcatggtggtggacagccccggcttccagaaccccagacaccagggcaaggacagagccgccaccttcgaggagctgtgccacaactacgcccacgagagactgcagctgctgttctaccagagaaccttcgtgagcaccctgcagagataccaggaggagggcgtgcccgtgcagttcgacctgcccgaccccagccccggcaccaccgtggccgtggtggaccagaaccccagccaggtgagactgcccgccggcggcggcgcccaggacgccagaggcctgttctgggtgctggacgaggaggtgcacgtggagggcagcagcgacagcgtggtgctggagagactgtgcgccgccttcgagaagaagggcgccggcaccgagggcagcagcgccctgagaacctgcgagcagcccctgcagtgcgagatcttccaccagctgggctgggaccccgtgagatacgacctgaccggctggctgcacagagccaagcccaacctgagcgccctggacgccccccaggtgctgcaccagagcaagagagaggagctgagaagcctgttccaggccagagccaagctgccccccgtgtgcagagccgtggccggcctggagggcaccagccagcaggccctgcagagaagcagaatggtgagaagaaccttcgccagcagcctggccgccgtgagaagaaaggccccctgcagccagatcaagctgcagatggacgccctgaccagcatgatcaagagaagcagactgcacttcatccactgcctggtgcccaaccccgtggtggagagcagaagcggccaggagagccccccccccccccagcccggcagagacaagcccggcgccggcggccccctggccctggacatccccgccctgagagtgcagctggccggcttccacatcctggaggccctgagactgcacagaaccggctacgccgaccacatgggcctgaccagattcagaagacagttccaggtgctggacgcccccctgctgaagaagctgatgagcaccagcgagggcatcgacgagagaaaggccgtggaggagctgctggagaccctggacctggagaagaaggccgtggccgtgggccacagccaggtgttcctgaaggccggcgtgatcagcagactggagaagcagagagagaagctggtgagccagagcatcgtgctgttccaggccgcctgcaagggcttcctgagcagacaggagttcaagaagctgaagatcagaagactggccgcccagtgcatccagaagaacgtggccgtgttcctggccgtgaaggactggccctggtggcagctgctgggcagcctgcagcccctgctgagcgccaccatcggcaccgagcagctgagagccaaggaggaggagctgaccaccctgagaagaaagctggagaagagcgagaagctgagaaacgagctgagacagaacaccgacctgctggagagcaagatcgccgacctgaccagcgacctggccgacgagagattcaagggcgacgtggcctgccaggtgctggagagcgagagagccgagagactgcaggccttcagagaggtgcaggagctgaagagcaagcacgagcaggtgcagaagaagctgggcgacgtgaacaagcagctggaggaggcccagcagaagatccagctgaacgacctggagagaaaccccaccggcggcgccgacgagtggcagatgagattcgactgcgcccagatggagaacgagttcctgagaaagagactgcagcagtgcgaggagagactggacagcgagctgaccgccagaaaggagctggagcagaagctgggcgagctgcagagcgcctacgacggcgccaagaagatggcccaccagctgaagagaaagtgccaccacctgacctgcgacctggaggacacctgcgtgctgctggagaaccagcagagcagaaaccacgagctggagaagaagcagaagaagttcgacctgcagctggcccaggccctgggcgagagcgtgttcgagaagggcctgagagagaaggtgacccaggagaacaccagcgtgagatgggagctgggccagctgcagcagcagctgaagcagaaggagcaggaggccagccagctgaagcagcaggtggagatgctgcaggaccacaagagagagctgctgggcagccccagcctgggcgagaactgcgtggccggcctgaaggagagactgtggaagctggagagcagcgccctggagcagcagaagatccagagccagcaggagaacaccatcaagcagctggagcagctgagacagagattcgagctggagatcgagagaatgaagcagatgcaccagaaggacagagaggaccaggaggaggagctggaggacgtgagacagagctgccagaagagactgcaccagctggagatgcagctggagcaggagtacgaggagaagcagatggtgctgcacgagaagcaggacctggagggcctgatcggcaccctgtgcgaccagatcggccacagagacttcgacgtggagaagagactgagaagagacctgagaagaacccacgccctgctgagcgacgtgcagctgctgctgggcaccatggaggacggcaagaccagcgtgagcaaggaggagctggagaaggtgcacagccagctggagcagagcgaggccaagtgcgaggaggccctgaagacccagaaggtgctgaccgccgacctggagagcatgcacagcgagctggagaacatgaccagaaacaagagcctggtggacgagcagctgtacagactgcagttcgagaaggccgacctgctgaagagaatcgacgaggaccaggacgacctgaacgagctgatgcagaagcacaaggacctgatcgcccagagcgccgccgacatcggccagatccaggagctgcagctgcagctggaggaggccaagaaggagaagcacaagctgcaggagcagctgcaggtggcccagatgagaatcgagtacctggagcagagcaccgtggacagagccatcgtgagcagacaggaggccgtgatctgcgacctggagaacaagaccgagttccagaaggtgcagatcaagagattcgaggtgctggtgatcagactgagagacagcctgatcaagatgggcgaggagctgagccaggccgccaccagcgagagccagcagagagagagcagccagtactaccagagaagactggaggagctgaaggccgacatggaggagctggtgcagagagaggccgaggccagcagaagatgcatggagctggagaagtacgtggaggagctggccgccgtgagacagaccctgcagaccgacctggagaccagcatcagaagaatcgccgacctgcaggccgccctggaggaggtggccagcagcgacagcgacaccgagagcgtgcagaccgccgtggactgcggcagcagcggcagaaaggagatggacaacgtgagcatcctgagcagccagcccgagggcagcctgcagagctggctgagctgcaccctgagcctggccaccgacaccatgagaacccccagcagacagagcgccaccagcagcagaatcctgagccccagaatcaacgaggaggccggcgacaccgagagaacccagagcgccctggccctgagcagagccagaagcaccaacgtgcacagcaagaccagcggcgacaagcccgtgagcccccacttcgtgagaagacagaagtactgccacttcggcgacggcgaggtgctggccgtgcagagaaagagcaccgagagactggagcccgccagcagccccctggccagcagaagcaccaacaccagccccctgagcagagagaagctgcccagccccagcgccgccctgagcgagttcgtggagggcctgagaagaaagagagcccagagaggccagggcagcaccctgggcctggaggactggcccaccctgcccatctaccagaccaccggcgccagcaccctgagaagaggcagagccggcagcgacgagggcaacctgagcctgagagtgggcgccaagagccccctggagatcgagggcgccgccggcggcctgctgagaagcaccagcctgaagtgcatcagcagcgacggcgtgggcggcaccaccctgctgcccgagaagagcaagacccagttcagcagctgcgagagcctgctggagagcagacccagcatgggcagaaagctgagcagccccaccacccccagagacatgctgctgagccccaccctgagacccagaagaagatgcctggagagcagcgtggacgacgccggctgccccgacctgggcaaggagcccctggtgttccagaacagacagttcgcccacctgatggaggagcccctgggcagcgaccccttcagctggaagctgcccagcctggactacgagagaaagaccaaggtggacttcgacgacttcctgcccgccatcagaaagccccagacccccaccagcctggccggcagcgccaagggcggccaggacggcagccagagaagcagcatccacttcgagaccgaggaggccaacagaagcttcctgagcggcatcaagaccatcctgaagaagagccccgagcccaaggaggaccccgcccacctgagcgacagcagcagcagcagcggcagcatcgtgagcttcaagagcgccgacagcatcaagagcagacccggcatccccagactggccggcgacggcggcgagagaaccagccccgagagaagagagcccggcaccggcagaaaggacgacgacgtggccagcatcatgaagaagtacctgcagaagtag

SEQ ID NO: 90092 - DNA, 7707 bp, Artificial Sequence
  Description of Artificial Sequence: Synthetic coding sequence
atggccatcagcagcagactggccctgtgggagcagaagatcagagaggaggacaagagccccccccccagcagccccccccccctgttcagcgtgatccccggcggcttcatcaagcagctggtgagaggcaccgagaaggaggccaaggaggccagacagagaaagcagctggccgtggccagccccgagagagagatccccgagatcagcatcagccagcccaacagcaagagcagcagcggcaccagaagcggcagccagcagatcagccaggacgaccagagcagcagccccggcagcagcgacatcctgggcaaggagagcgagggcagcagaagccccgaccccgagcagatgaccagcatcaacggcgagaaggcccaggagctgggcagcagcgccacccccaccaagaagaccgtgcccttcaagagaggcgtgagaagaggcgacgtgctgctgatggtggccaagctggaccccgacagcgccaagcccgagaagacccacccccacgacgcccccccctgcaagaccagcccccccgccaccgacaccggcaaggagaagaagggcgagaccagcagaaccccctgcggcagccaggccagcaccgagatcctggcccccaaggccgagaagaccagaaccggcggcctgggcgaccccggccagggcaccgtggccctgaagaagggcgaggagggccagagcatcgtgggcaagggcctgggcacccccaagaccaccgagctgaaggaggccgagccccagggcaaggacagacagggcaccagaccccaggcccagggccccggcgagggcgtgagacccggcaaggccgagaaggagggcgccgagcccaccaacaccgtggagaagggcaacgtgagcaaggacgtgggcagcgagggcaagcacgtgagaccccagatccccggcagaaagtggggcggcttcctgggcagaagaagcaagtgggacggcccccagaacaagaaggacaaggagggcgtgctgctgagcaaggccgagaagaccggcgagccccagacccagatggagaagaccagccaggtgcagggcgagctgggcgacgacctgagaatgggcgagaaggccggcgagctgagaagcaccaccggcaaggccggcgagagctgggacaagaaggagaagatgggccagccccagggcaagagcggcaacgccggcgaggccagaagccagaccgagaagggctgcgaggcccccaaggaggtgagcaccatggtggagagccccgccgcccccggcaagggcggctggcccggcagcagaggccaggaggccgaggagccctgcagcagagccggcgacggcgccggcgccctggagaccgagctggagggccccagccagcccgccctggagaaggacgccgagagacccagaatcagaaaggagaaccaggacggccccgccccccaggaggagggcaagggcggccagagcagagacagcgaccaggcccccgaggacagatggtacgaggccgagaaggtgtggctggcccagaaggacggcttcaccctggccaccgtgctgaagcccgacgagggcaccgccgacctgcccgccggcagagtgagactgtggatcgacgccgacaagaccatcaccgaggtggacgaggagcacgtgcacagagccaacccccccgagctggaccaggtggaggacctggccagcctgatcagcgtgaacgagagcagcgtgctgaacaccctgctgcagagatacaaggcccagctgctgcacacctgcaccggccccgacctgatcgtgctgcagcccagaggccccagcgtgcccagcgccggcaaggtgcccaagggcagaagagacggcctgcccgcccacatcggcagcatggcccagagagcctactgggccctgctgaaccagagaagagaccagagcatcgtggccctgggctggagcggcgccggcaagaccacctgctgcgagcaggtgctggagcacctggtgggcatggccggcagcgtggacggcagagtgagcgtggagaagatcagagccaccttcaccgtgctgagagccttcggcagcgtgagcatggcccacagcagaagcgccaccagattcagcatggtgatgagcctggacttcaacgccaccggcagaatcaccgccgcccagctgcagaccatgctgctggagaagagcagagtggccagacagcccgagggcgagagcaacttcctggtgttcagccagatgctggccggcctggacctggacctgagaaccgagctgaacctgcaccagatggccgacagcagcagcttcggcatgggcgtgtggagcaagcccgaggacaagcagaaggccgccgccgccttcgcccagctgcagggcgccatggagatgctgggcatcagcgagagcgagcagagagccgtgtggagagtgctggccgccatctaccacctgggcgccgccggcgcctgcaaggtgggcagaaagcagttcatgagattcgagtgggccaactacgccgccgaggccctgggctgcgagtacgaggagctgaacaccgccaccttcaagcaccacctgagacagatcatccagcagatgaccttcggccccagcagatggggcctggaggacgaggagaccagcagcggcctgaagatgaccggcgtggactgcgtggagggcatggccagcggcctgtaccaggagctgttcgccgccgtggtgagcctgatcaacagaagcttcagcagccaccacctgagcatggccagcatcatggtggtggacagccccggcttccagaaccccagacaccagggcaaggacagagccgccaccttcgaggagctgtgccacaactacgcccacgagagactgcagctgctgttctaccagagaaccttcgtgagcaccctgcagagataccaggaggagggcgtgcccgtgcagttcgacctgcccgaccccagccccggcaccaccgtggccgtggtggaccagaaccccagccagcaggtgagactgcccgccggcggcggcgcccaggacgccagaggcctgttctgggtgctggacgaggaggtgcacgtggagggcagcagcgacagcgtggtgctggagagactgtgcgccgccttcgagaagaagggcgccggcaccgagggcagcagcgccctgagaacctgcgagcagcccctgcagtgcgagatcttccaccagctgggctgggaccccgtgagatacgacctgaccggctggctgcacagagccaagcccaacctgagcgccctggacgccccccaggtgctgcaccagagcaagagagaggagctgagaagcctgttccaggccagagccaagctgccccccgtgtgcagagccgtggccggcctggagggcaccagccagcaggccctgcagagaagcagaatggtgagaagaaccttcgccagcagcctggccgccgtgagaagaaaggccccctgcagccagatcaagctgcagatggacgccctgaccagcatgatcaagagaagcagactgcacttcatccactgcctggtgcccaaccccgtggtggagagcagaagcggccaggagagccccccccccccccagcccggcagagacaagcccggcgccggcggccccctggccctggacatccccgccctgagagtgcagctggccggcttccacatcctggaggccctgagactgcacagaaccggctacgccgaccacatgggcctgaccagattcagaagacagttccaggtgctggacgcccccctgctgaagaagctgatgagcaccagcgagggcatcgacgagagaaaggccgtggaggagctgctggagaccctggacctggagaagaaggccgtggccgtgggccacagccaggtgttcctgaaggccggcgtgatcagcagactggagaagcagagagagaagctggtgagccagagcatcgtgctgttccaggccgcctgcaagggcttcctgagcagacaggagttcaagaagctgaagatcagaagactggccgcccagtgcatccagaagaacgtggccgtgttcctggccgtgaaggactggccctggtggcagctgctgggcagcctgcagcccctgctgagcgccaccatcggcaccgagcagctgagagccaaggaggaggagctgaccaccctgagaagaaagctggagaagagcgagaagctgagaaacgagctgagacagaacaccgacctgctggagagcaagatcgccgacctgaccagcgacctggccgacgagagattcaagggcgacgtggcctgccaggtgctggagagcgagagagccgagagactgcaggccttcagagaggtgcaggagctgaagagcaagcacgagcaggtgcagaagaagctgggcgacgtgaacaagcagctggaggaggcccagcagaagatccagctgaacgacctggagagaaaccccaccggcggcgccgacgagtggcagatgagattcgactgcgcccagatggagaacgagttcctgagaaagagactgcagcagtgcgaggagagactggacagcgagctgaccgccagaaaggagctggagcagaagctgggcgagctgcagagcgcctacgacggcgccaagaagatggcccaccagctgaagagaaagtgccaccacctgacctgcgacctggaggacacctgcgtgctgctggagaaccagcagagcagaaaccacgagctggagaagaagcagaagaagttcgacctgcagctggcccaggccctgggcgagagcgtgttcgagaagggcctgagagagaaggtgacccaggagaacaccagcgtgagatgggagctgggccagctgcagcagcagctgaagcagaaggagcaggaggccagccagctgaagcagcaggtggagatgctgcaggaccacaagagagagctgctgggcagccccagcctgggcgagaactgcgtggccggcctgaaggagagactgtggaagctggagagcagcgccctggagcagcagaagatccagagccagcaggagaacaccatcaagcagctggagcagctgagacagagattcgagctggagatcgagagaatgaagcagatgcaccagaaggacagagaggaccaggaggaggagctggaggacgtgagacagagctgccagaagagactgcaccagctggagatgcagctggagcaggagtacgaggagaagcagatggtgctgcacgagaagcaggacctggagggcctgatcggcaccctgtgcgaccagatcggccacagagacttcgacgtggagaagagactgagaagagacctgagaagaacccacgccctgctgagcgacgtgcagctgctgctgggcaccatggaggacggcaagaccagcgtgagcaaggaggagctggagaaggtgcacagccagctggagcagagcgaggccaagtgcgaggaggccctgaagacccagaaggtgctgaccgccgacctggagagcatgcacagcgagctggagaacatgaccagaaacaagagcctggtggacgagcagctgtacagactgcagttcgagaaggccgacctgctgaagagaatcgacgaggaccaggacgacctgaacgagctgatgcagaagcacaaggacctgatcgcccagagcgccgccgacatcggccagatccaggagctgcagctgcagctggaggaggccaagaaggagaagcacaagctgcaggagcagctgcaggtggcccagatgagaatcgagtacctggagcagagcaccgtggacagagccatcgtgagcagacaggaggccgtgatctgcgacctggagaacaagaccgagttccagaaggtgcagatcaagagattcgaggtgctggtgatcagactgagagacagcctgatcaagatgggcgaggagctgagccaggccgccaccagcgagagccagcagagagagagcagccagtactaccagagaagactggaggagctgaaggccgacatggaggagctggtgcagagagaggccgaggccagcagaagatgcatggagctggagaagtacgtggaggagctggccgccgtgagacagaccctgcagaccgacctggagaccagcatcagaagaatcgccgacctgcaggccgccctggaggaggtggccagcagcgacagcgacaccgagagcgtgcagaccgccgtggactgcggcagcagcggcagaaaggagatggacaacgtgagcatcctgagcagccagcccgagggcagcctgcagagctggctgagctgcaccctgagcctggccaccgacaccatgagaacccccagcagacagagcgccaccagcagcagaatcctgagccccagaatcaacgaggaggccggcgacaccgagagaacccagagcgccctggccctgagcagagccagaagcaccaacgtgcacagcaagaccagcggcgacaagcccgtgagcccccacttcgtgagaagacagaagtactgccacttcggcgacggcgaggtgctggccgtgcagagaaagagcaccgagagactggagcccgccagcagccccctggccagcagaagcaccaacaccagccccctgagcagagagaagctgcccagccccagcgccgccctgagcgagttcgtggagggcctgagaagaaagagagcccagagaggccagggcagcaccctgggcctggaggactggcccaccctgcccatctaccagaccaccggcgccagcaccctgagaagaggcagagccggcagcgacgagggcaacctgagcctgagagtgggcgccaagagccccctggagatcgagggcgccgccggcggcctgctgagaagcaccagcctgaagtgcatcagcagcgacggcgtgggcggcaccaccctgctgcccgagaagagcaagacccagttcagcagctgcgagagcctgctggagagcagacccagcatgggcagaaagctgagcagccccaccacccccagagacatgctgctgagccccaccctgagacccagaagaagatgcctggagagcagcgtggacgacgccggctgccccgacctgggcaaggagcccctggtgttccagaacagacagttcgcccacctgatggaggagcccctgggcagcgaccccttcagctggaagctgcccagcctggactacgagagaaagaccaaggtggacttcgacgacttcctgcccgccatcagaaagccccagacccccaccagcctggccggcagcgccaagggcggccaggacggcagccagagaagcagcatccacttcgagaccgaggaggccaacagaagcttcctgagcggcatcaagaccatcctgaagaagagccccgagcccaaggaggaccccgcccacctgagcgacagcagcagcagcagcggcagcatcgtgagcttcaagagcgccgacagcatcaagagcagacccggcatccccagactggccggcgacggcggcgagagaaccagccccgagagaagagagcccggcaccggcagaaaggacgacgacgtggccagcatcatgaagaagtacctgcagaagtag

SEQ ID NO: 90093 - DNA, 7704 bp, Artificial Sequence; identical to SEQ ID NO: 90091
  Description of Artificial Sequence: Synthetic coding sequence

SEQ ID NO: 90094 - DNA, 603 bp, Artificial Sequence
  Description of Artificial Sequence: Synthetic coding sequence
atgggcaacagcaagagcggcgccctgagcaaggagatcctggaggagctgcagctgaacaccaagttcagcgaggaggagctgtgcagctggtaccagagcttcctgaaggactgccccaccggcagaatcacccagcagcagttccagagcatctacgccaagttcttccccgacaccgaccccaaggcctacgcccagcacgtgttcagaagcttcgacagcaacctggacggcaccctggacttcaaggagtacgtgatcgccctgcacatgaccaccgccggcaagaccaaccagaagctggagtgggccttcagcctgtacgacgtggacggcaacggcaccatcagcaagaacgaggtgctggagatcgtgatggccatcttcaagatgatcacccccgaggacgtgaagctgctgcccgacgacgagaacacccccgagaagagagccgagaagatctggaagtacttcggcaagaacgacgacgacaagctgaccgagaaggagttcatcgagggcaccctggccaacaaggagatcctgagactgatccagttcgagccccagaaggtgaaggagaagatgaagaacgcctag

SEQ ID NO: 90095 - DNA, 1884 bp, Artificial Sequence
  Description of Artificial Sequence: Synthetic coding sequence
atgagcagcgacagcgagatggccatcttcggcgaggccgcccccttcctgagaaagagcgagagagagagaatcgaggcccagaacaagcccttcgacgccaagaccagcgtgttcgtggtggaccccaaggagagcttcgtgaaggccaccgtgcagagcagagagggcggcaaggtgaccgccaagaccgaggccggcgccaccgtgaccgtgaaggacgaccaggtgttccccatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaacgccgaggtggtgaccgcctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgtgaccggcgagaagaagaaggaggaggtgaccagcggcaagatgcagggcaccctggaggaccagatcatcagcgccaaccccctgctggaggccttcggcaacgccaagaccgtgagaaacgacaacagcagcagattcggcaagttcatcagaatccacttcggcaccaccggcaagctggccagcgccgacatcgagacctacctgctggagaagagcagagtgaccttccagctgaaggccgagagaagctaccacatcttctaccagatcatgagcaacaagaagcccgacctgatcgagatgctgctgatcaccaccaacccctacgactacgccttcgtgagccagggcgagatcaccgtgcccagcatcgacgaccaggaggagctgatggccaccgacagcgccatcgagatcctgggcttcaccagcgacgagagagtgagcatctacaagctgaccggcgccgtgatgcactacggcaacatgaagttcaagcagaagcagagagaggagcaggccgagcccgacggcaccgaggtggccgacaaggccgcctacctgcagaacctgaacagcgccgacctgctgaaggccctgtgctaccccagagtgaaggtgggcaacgagtacgtgaccaagggccagaccgtgcagcaggtgtacaacgccgtgggcgccctggccaaggccgtgtacgacaagatgttcctgtggatggtgaccagaatcaaccagcagctggacaccaagcagcccagagccaacagcgaggtggcccagtggagaaccaagtacgagaccgacgccatccagagaaccgaggagctggaggaggccaagaagaagctggcccagagactgcaggacgccgaggagcacgtggaggccgtgaacgccaagtgcgccagcctggagaagaccaagcagagactgcagaacgaggtggaggacctgatgatcgacgtggagagaaccaacgccgcctgcgccgccctggacaagaagcagagaaacttcgacaagatcctggccgagtggaagcagaagtgcgaggagacccacgccgagctggaggccagccagaaggagagcagaagcctgagcaccgagctgttcaagatcaagaacgcctacgaggagagcctggaccagctggagaccctgaagagagagaacaagaacctgcagcaggagatcagcgacctgaccgagcagatcgccgagggcggcaagagaatccacgagctggagaagatcaagaagcaggtggagtag

SEQ ID NO: 90096 - DNA, 5919 bp, Artificial Sequence
  Description of Artificial Sequence: Synthetic coding sequence
atggcccagaagggccagctgagcgacgacgagaagttcctgttcgtggacaagaacttcatcaacagccccgtggcccaggccgactgggccgccaagagactggtgtgggtgcccagcgagaagcagggcttcgaggccgccagcatcaaggaggagaagggcgacgaggtggtggtggagctggtggagaacggcaagaaggtgaccgtgggcaaggacgacatccagaagatgaacccccccaagttcagcaaggtggaggacatggccgagctgacctgcctgaacgaggccagcgtgctgcacaacctgagagagagatacttcagcggcctgatctacacctacagcggcctgttctgcgtggtggtgaacccctacaagcacctgcccatctacagcgagaagatcgtggacatgtacaagggcaagaagagacacgagatgcccccccacatctacgccatcgccgacaccgcctacagaagcatgctgcaggacagagaggaccagagcatcctgtgcaccggcgagagcggcgccggcaagaccgagaacaccaagaaggtgatccagtacctggccgtggtggccagcagccacaagggcaagaaggacaccagcatcaccggcgagctggagaagcagctgctgcaggccaaccccatcctggaggccttcggcaacgccaagaccgtgaagaacgacaacagcagcagattcggcaagttcatcagaatcaacttcgacgtgaccggctacatcgtgggcgccaacatcgagacctacctgctggagaagagcagagccatcagacaggccagagacgagagaaccttccacatcttctactacatgatcgccggcgccaaggagaagatgagaagcgacctgctgctggagggcttcaacaactacaccttcctgagcaacggcttcgtgcccatccccgccgcccaggacgacgagatgttccaggagaccgtggaggccatggccatcatgggcttcagcgaggaggagcagctgagcatcctgaaggtggtgagcagcgtgctgcagctgggcaacatcgtgttcaagaaggagagaaacaccgaccaggccagcatgcccgacaacaccgccgcccagaaggtgtgccacctgatgggcatcaacgtgaccgacttcaccagaagcatcctgacccccagaatcaaggtgggcagagacgtggtgcagaaggcccagaccaaggagcaggccgacttcgccgtggaggccctggccaaggccacctacgagagactgttcagatggatcctgaccagagtgaacaaggccctggacaagacccacagacagggcgccagcttcctgggcatcctggacatcgccggcttcgagatcttcgaggtgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgagctgatcgagagacccaacaacccccccggcgtgctggccctgctggacgaggagtgctggttccccaaggccaccgacaagagcttcgtggagaagctgtgcaccgagcagggcagccaccccaagttccagaagcccaagcagctgaaggacaagaccgagttcagcatcatccactacgccggcaaggtggactacaacgccagcgcctggctgaccaagaacatggaccccctgaacgacaacgtgaccagcctgctgaacgccagcagcgacaagttcgtggccgacctgtggaaggacgtggacagaatcgtgggcctggaccagatggccaagatgaccgagagcagcctgcccagcgccagcaagaccaagaagggcatgttcagaaccgtgggccagctgtacaaggagcagctgggcaagctgatgaccaccctgagaaacaccacccccaacttcgtgagatgcatcatccccaaccacgagaagagaagcggcaagctggacgccttcctggtgctggagcagctgagatgcaacggcgtgctggagggcatcagaatctgcagacagggcttccccaacagaatcgtgttccaggagttcagacagagatacgagatcctggccgccaacgccatccccaagggcttcatggacggcaagcaggcctgcatcctgatgatcaaggccctggagctggaccccaacctgtacagaatcggccagagcaagatcttcttcagaaccggcgtgctggcccacctggaggaggagagagacctgaagatcaccgacgtgatcatggccttccaggccatgtgcagaggctacctggccagaaaggccttcgccaagagacagcagcagctgaccgccatgaaggtgatccagagaaactgcgccgcctacctgaagctgagaaactggcagtggtggagactgttcaccaaggtgaagcccctgctgcaggtgaccagacaggaggaggagatgcaggccaaggaggacgagctgcagaagaccaaggagagacagcagaaggccgagaacgagctgaaggagctggagcagaagcacagccagctgaccgaggagaagaacctgctgcaggagcagctgcaggccgagaccgagctgtacgccgaggccgaggagatgagagtgagactggccgccaagaagcaggagctggaggagatcctgcacgagatggaggccagactggaggaggaggaggacagaggccagcagctgcaggccgagagaaagaagatggcccagcagatgctggacctggaggagcagctggaggaggaggaggccgccagacagaagctgcagctggagaaggtgaccgccgaggccaagatcaagaagctggaggacgagatcctggtgatggacgaccagaacaacaagctgagcaaggagagaaagctgctggaggagagaatcagcgacctgaccaccaacctggccgaggaggaggagaaggccaagaacctgaccaagctgaagaacaagcacgagagcatgatcagcgagctggaggtgagactgaagaaggaggagaagagcagacaggagctggagaagctgaagagaaagctggagggcgacgccagcgacttccacgagcagatcgccgacctgcaggcccagatcgccgagctgaagatgcagctggccaagaaggaggaggagctgcaggccgccctggccagactggacgacgagatcgcccagaagaacaacgccctgaagaagatcagagagctggagggccacatcagcgacctgcaggaggacctggacagcgagagagccgccagaaacaaggccgagaagcagaagagagacctgggcgaggagctggaggccctgaagaccgagctggaggacaccctggacagcaccgccacccagcaggagctgagagccaagagagagcaggaggtgaccgtgctgaagaaggccctggacgaggagaccagaagccacgaggcccaggtgcaggagatgagacagaagcacgcccaggccgtggaggagctgaccgagcagctggagcagttcaagagagccaaggccaacctggacaagaacaagcagaccctggagaaggagaacgccgacctggccggcgagctgagagtgctgggccaggccaagcaggaggtggagcacaagaagaagaagctggaggcccaggtgcaggagctgcagagcaagtgcagcgacggcgagagagccagagccgagctgaacgacaaggtgcacaagctgcagaacgaggtggagagcgtgaccggcatgctgaacgaggccgagggcaaggccatcaagctggccaaggacgtggccagcctgagcagccagctgcaggacacccaggagctgctgcaggaggagaccagacagaagctgaacgtgagcaccaagctgagacagctggaggaggagagaaacagcctgcaggaccagctggacgaggagatggaggccaagcagaacctggagagacacatcagcaccctgaacatccagctgagcgacagcaagaagaagctgcaggacttcgccagcaccgtggaggccctggaggagggcaagaagagattccagaaggagatcgagaacctgacccagcagtacgaggagaaggccgccgcctacgacaagctggagaagaccaagaacagactgcagcaggagctggacgacctggtggtggacctggacaaccagagacagctggtgagcaacctggagaagaagcagagaaagttcgaccagctgctggccgaggagaagaacatcagcagcaagtacgccgacgagagagacagagccgaggccgaggccagagagaaggagaccaaggccctgagcctggccagagccctggaggaggccctggaggccaaggaggagctggagagaaccaacaagatgctgaaggccgagatggaggacctggtgagcagcaaggacgacgtgggcaagaacgtgcacgagctggagaagagcaagagagccctggagacccagatggaggagatgaagacccagctggaggagctggaggacgagctgcaggccaccgaggacgccaagctgagactggaggtgaacatgcaggccctgaagggccagttcgagagagacctgcaggccagagacgagcagaacgaggagaagagaagacagctgcagagacagctgcacgagtacgagaccgagctggaggacgagagaaagcagagagccctggccgccgccgccaagaagaagctggagggcgacctgaaggacctggagctgcaggccgacagcgccatcaagggcagagaggaggccatcaagcagctgagaaagctgcaggcccagatgaaggacttccagagagagctggaggacgccagagccagcagagacgagatcttcgccaccgccaaggagaacgagaagaaggccaagagcctggaggccgacctgatgcagctgcaggaggacctggccgccgccgagagagccagaaagcaggccgacctggagaaggaggagctggccgaggagctggccagcagcctgagcggcagaaacgccctgcaggacgagaagagaagactggaggccagaatcgcccagctggaggaggagctggaggaggagcagggcaacatggaggccatgagcgacagagtgagaaaggccacccagcaggccgagcagctgagcaacgagctggccaccgagagaagcaccgcccagaagaacgagagcgccagacagcagctggagagacagaacaaggagctgagaagcaagctgcacgagatggagggcgccgtgaagagcaagttcaagagcaccatcgccgccctggaggccaagatcgcccagctggaggagcaggtggagcaggaggccagagagaagcaggccgccaccaagagcctgaagcagaaggacaagaagctgaaggagatcctgctgcaggtggaggacgagagaaagatggccgagcagtacaaggagcaggccgagaagggcaacgccagagtgaagcagctgaagagacagctggaggaggccgaggaggagagccagagaatcaacgccaacagaagaaagctgcagagagagctggacgaggccaccgagagcaacgaggccatgggcagagaggtgaacgccctgaagagcaagctgagaagaggcaacgagaccagcttcgtgcccagcagaagaagcggcggcagaagagtgatcgagaacgccgacggcagcgaggaggagaccgacaccagagacgccgacttcaacggcaccaaggccagcgagtag

SEQ ID NO: 90097 - DNA, 5817 bp, Artificial Sequence
  Description of Artificial Sequence: Synthetic coding sequence
atggcccagaagggccagctgagcgacgacgagaagttcctgttcgtggacaagaacttcatcaacagccccgtggcccaggccgactgggccgccaagagactggtgtgggtgcccagcgagaagcagggcttcgaggccgccagcatcaaggaggagaagggcgacgaggtggtggtggagctggtggagaacggcaagaaggtgaccgtgggcaaggacgacatccagaagatgaacccccccaagttcagcaaggtggaggacatggccgagctgacctgcctgaacgaggccagcgtgctgcacaacctgagagagagatacttcagcggcctgatctacacctacagcggcctgttctgcgtggtggtgaacccctacaagcacctgcccatctacagcgagaagatcgtggacatgtacaagggcaagaagagacacgagatgcccccccacatctacgccatcgccgacaccgcctacagaagcatgctgcaggacagagaggaccagagcatcctgtgcaccggcgagagcggcgccggcaagaccgagaacaccaagaaggtgatccagtacctggccgtggtggccagcagccacaagggcaagaaggacaccagcatcaccggcgagctggagaagcagctgctgcaggccaaccccatcctggaggccttcggcaacgccaagaccgtgaagaacgacaacagcagcagattcggcaagttcatcagaatcaacttcgacgtgaccggctacatcgtgggcgccaacatcgagacctacctgctggagaagagcagagccatcagacaggccagagacgagagaaccttccacatcttctactacatgatcgccggcgccaaggagaagatgagaagcgacctgctgctggagggcttcaacaactacaccttcctgagcaacggcttcgtgcccatccccgccgcccaggacgacgagatgttccaggagaccgtggaggccatggccatcatgggcttcagcgaggaggagcagctgagcatcctgaaggtggtgagcagcgtgctgcagctgggcaacatcgtgttcaagaaggagagaaacaccgaccaggccagcatgcccgacaacaccgccgcccagaaggtgtgccacctgatgggcatcaacgtgaccgacttcaccagaagcatcctgacccccagaatcaaggtgggcagagacgtggtgcagaaggcccagaccaaggagcaggccgacttcgccgtggaggccctggccaaggccacctacgagagactgttcagatggatcctgaccagagtgaacaaggccctggacaagacccacagacagggcgccagcttcctgggcatcctggacatcgccggcttcgagatcttcgaggtgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgagctgatcgagagacccaacaacccccccggcgtgctggccctgctggacgaggagtgctggttccccaaggccaccgacaagagcttcgtggagaagctgtgcaccgagcagggcagccaccccaagttccagaagcccaagcagctgaaggacaagaccgagttcagcatcatccactacgccggcaaggtggactacaacgccagcgcctggctgaccaagaacatggaccccctgaacgacaacgtgaccagcctgctgaacgccagcagcgacaagttcgtggccgacctgtggaaggacgtggacagaatcgtgggcctggaccagatggccaagatgaccgagagcagcctgcccagcgccagcaagaccaagaagggcatgttcagaaccgtgggccagctgtacaaggagcagctgggcaagctgatgaccaccctgagaaacaccacccccaacttcgtgagatgcatcatccccaaccacgagaagagaagcggcaagctggacgccttcctggtgctggagcagctgagatgcaacggcgtgctggagggcatcagaatctgcagacagggcttccccaacagaatcgtgttccaggagttcagacagagatacgagatcctggccgccaacgccatccccaagggcttcatggacggcaagcaggcctgcatcctgatgatcaaggccctggagctggaccccaacctgtacagaatcggccagagcaagatcttcttcagaaccggcgtgctggcccacctggaggaggagagagacctgaagatcaccgacgtgatcatggccttccaggccatgtgcagaggctacctggccagaaaggccttcgccaagagacagcagcagctgaccgccatgaaggtgatccagagaaactgcgccgcctacctgaagctgagaaactggcagtggtggagactgttcaccaaggtgaagcccctgctgcaggtgaccagacaggaggaggagatgcaggccaaggaggacgagctgcagaagaccaaggagagacagcagaaggccgagaacgagctgaaggagctggagcagaagcacagccagctgaccgaggagaagaacctgctgcaggagcagctgcaggccgagaccgagctgtacgccgaggccgaggagatgagagtgagactggccgccaagaagcaggagctggaggagatcctgcacgagatggaggccagactggaggaggaggaggacagaggccagcagctgcaggccgagagaaagaagatggcccagcagatgctggacctggaggagcagctggaggaggaggaggccgccagacagaagctgcagctggagaaggtgaccgccgaggccaagatcaagaagctggaggacgagatcctggtgatggacgaccagaacaacaagctgagcaaggagagaaagctgctggaggagagaatcagcgacctgaccaccaacctggccgaggaggaggagaaggccaagaacctgaccaagctgaagaacaagcacgagagcatgatcagcgagctggaggtgagactgaagaaggaggagaagagcagacaggagctggagaagctgaagagaaagctggagggcgacgccagcgacttccacgagcagatcgccgacctgcaggcccagatcgccgagctgaagatgcagctggccaagaaggaggaggagctgcaggccgccctggccagactggacgacgagatcgcccagaagaacaacgccctgaagaagatcagagagctggagggccacatcagcgacctgcaggaggacctggacagcgagagagccgccagaaacaaggccgagaagcagaagagagacctgggcgaggagctggaggccctgaagaccgagctggaggacaccctggacagcaccgccacccagcaggagctgagagccaagagagagcaggaggtgaccgtgctgaagaaggccctggacgaggagaccagaagccacgaggcccaggtgcaggagatgagacagaagcacgcccaggccgtggaggagctgaccgagcagctggagcagttcaagagagccaaggccaacctggacaagaacaagcagaccctggagaaggagaacgccgacctggccggcgagctgagagtgctgggccaggccaagcaggaggtggagcacaagaagaagaagctggaggcccaggtgcaggagctgcagagcaagtgcagcgacggcgagagagccagagccgagctgaacgacaaggtgcacaagctgcagaacgaggtggagagcgtgaccggcatgctgaacgaggccgagggcaaggccatcaagctggccaaggacgtggccagcctgagcagccagctgcaggacacccaggagctgctgcaggaggagaccagacagaagctgaacgtgagcaccaagctgagacagctggaggaggagagaaacagcctgcaggaccagctggacgaggagatggaggccaagcagaacctggagagacacatcagcaccctgaacatccagctgagcgacagcaagaagaagctgcaggacttcgccagcaccgtggaggccctggaggagggcaagaagagattccagaaggagatcgagaacctgacccagcagtacgaggagaaggccgccgcctacgacaagctggagaagaccaagaacagactgcagcaggagctggacgacctggtggtggacctggacaaccagagacagctggtgagcaacctggagaagaagcagagaaagttcgaccagctgctggccgaggagaagaacatcagcagcaagtacgccgacgagagagacagagccgaggccgaggccagagagaaggagaccaaggccctgagcctggccagagccctggaggaggccctggaggccaaggaggagctggagagaaccaacaagatgctgaaggccgagatggaggacctggtgagcagcaaggacgacgtgggcaagaacgtgcacgagctggagaagagcaagagagccctggagacccagatggaggagatgaagacccagctggaggagctggaggacgagctgcaggccaccgaggacgccaagctgagactggaggtgaacatgcaggccctgaagggccagttcgagagagacctgcaggccagagacgagcagaacgaggagaagagaagacagctgcagagacagctgcacgagtacgagaccgagctggaggacgagagaaagcagagagccctggccgccgccgccaagaagaagctggagggcgacctgaaggacctggagctgcaggccgacagcgccatcaagggcagagaggaggccatcaagcagctgagaaagctgcaggcccagatgaaggacttccagagagagctggaggacgccagagccagcagagacgagatcttcgccaccgccaaggagaacgagaagaaggccaagagcctggaggccgacctgatgcagctgcaggaggacctggccgccgccgagagagccagaaagcaggccgacctggagaaggaggagctggccgaggagctggccagcagcctgagcggcagaaacgccctgcaggacgagaagagaagactggaggccagaatcgcccagctggaggaggagctggaggaggagcagggcaacatggaggccatgagcgacagagtgagaaaggccacccagcaggccgagcagctgagcaacgagctggccaccgagagaagcaccgcccagaagaacgagagcgccagacagcagctggagagacagaacaaggagctgagaagcaagctgcacgagatggagggcgccgtgaagagcaagttcaagagcaccatcgccgccctggaggccaagatcgcccagctggaggagcaggtggagcaggaggccagagagaagcaggccgccaccaagagcctgaagcagaaggacaagaagctgaaggagatcctgctgcaggtggaggacgagagaaagatggccgagcagtacaaggagcaggccgagaagggcaacgccagagtgaagcagctgaagagacagctggaggaggccgaggaggagagccagagaatcaacgccaacagaagaaagctgcagagagagctggacgaggccaccgagagcaacgaggccatgggcagagaggtgaacgccctgaagagcaagctgagaggcccccccccccaggagaccagccagtag

SEQ ID NO: 90098 - DNA, 6090 bp, Artificial Sequence
  Description of Artificial Sequence: Synthetic coding sequence
atggcccagaagggccagctgagcgacgacgagaagttcctgttcgtggacaagaacttcatcaacagccccgtggcccaggccgactgggccgccaagagactggtgtgggtgcccagcgagaagcagggcttcgaggccgccagcatcaaggaggagaagggcgacgaggtggtggtggagctggtggagaacggcaagaaggtgaccgtgggcaaggacgacatccagaagatgaacccccccaagttcagcaaggtggaggacatggccgagctgacctgcctgaacgaggccagcgtgctgcacaacctgagagagagatacttcagcggcctgatctacacctacagcggcctgttctgcgtggtggtgaacccctacaagcacctgcccatctacagcgagaagatcgtggacatgtacaagggcaagaagagacacgagatgcccccccacatctacgccatcgccgacaccgcctacagaagcatgctgcaggacagagaggaccagagcatcctgtgcaccggcgagagcggcgccggcaagaccgagaacaccaagaaggtgatccagtacctggccgtggtggccagcagccacaagggcaagaaggacaccagcatcaccgagggccccagcttctggagaggcgagctggagaagcagctgctgcaggccaaccccatcctggaggccttcggcaacgccaagaccgtgaagaacgacaacagcagcagattcggcaagttcatcagaatcaacttcgacgtgaccggctacatcgtgggcgccaacatcgagacctacctgctggagaagagcagagccatcagacaggccagagacgagagaaccttccacatcttctactacatgatcgccggcgccaaggagaagatgagaagcgacctgctgctggagggcttcaacaactacaccttcctgagcaacggcttcgtgcccatccccgccgcccaggacgacgagatgttccaggagaccgtggaggccatggccatcatgggcttcagcgaggaggagcagctgagcatcctgaaggtggtgagcagcgtgctgcagctgggcaacatcgtgttcaagaaggagagaaacaccgaccaggccagcatgcccgacaacaccgccgcccagaaggtgtgccacctgatgggcatcaacgtgaccgacttcaccagaagcatcctgacccccagaatcaaggtgggcagagacgtggtgcagaaggcccagaccaaggagcaggccgacttcgccgtggaggccctggccaaggccacctacgagagactgttcagatggatcctgaccagagtgaacaaggccctggacaagacccacagacagggcgccagcttcctgggcatcctggacatcgccggcttcgagatcttcgaggtgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgagctgatcgagagacccaacaacccccccggcgtgctggccctgctggacgaggagtgctggttccccaaggccaccgacaagagcttcgtggagaagctgtgcaccgagcagggcagccaccccaagttccagaagcccaagcagctgaaggacaagaccgagttcagcatcatccactacgccggcaaggtggactacaacgccagcgcctggctgaccaagaacatggaccccctgaacgacaacgtgaccagcctgctgaacgccagcagcgacaagttcgtggccgacctgtggaaggacgtggacagaatcgtgggcctggaccagatggccaagatgaccgagagcagcctgcccagcgccagcaagaccaagaagggcatgttcagaaccgtgggccagctgtacaaggagcagctgggcaagctgatgaccaccctgagaaacaccacccccaacttcgtgagatgcatcatccccaaccacgagaagagaagcggcaagctggacgccttcctggtgctggagcagctgagatgcaacggcgtgctggagggcatcagaatctgcagacagggcttccccaacagaatcgtgttccaggagttcagacagagatacgagatcctggccgccaacgccatccccaagggcttcatggacggcaagcaggcctgcatcctgatgatcaaggccctggagctggaccccaacctgtacagaatcggccagagcaagatcttcttcagaaccggcgtgctggcccacctggaggaggagagagacctgaagatcaccgacgtgatcatggccttccaggccatgtgcagaggctacctggccagaaaggccttcgccaagagacagcagcagctgaccgccatgaaggtgatccagagaaactgcgccgcctacctgaagctgagaaactggcagtggtggagactgttcaccaaggtgaagcccctgctgcaggtgaccagacaggaggaggagatgcaggccaaggaggacgagctgcagaagaccaaggagagacagcagaaggccgagaacgagctgaaggagctggagcagaagcacagccagctgaccgaggagaagaacctgctgcaggagcagctgcaggccgagaccgagctgtacgccgaggccgaggagatgagagtgagactggccgccaagaagcaggagctggaggagatcctgcacgagatggaggccagactggaggaggaggaggacagaggccagcagctgcaggccgagagaaagaagatggcccagcagatgctggacctggaggagcagctggaggaggaggaggccgccagacagaagctgcagctggagaaggtgaccgccgaggccaagatcaagaagctggaggacgagatcctggtgatggacgaccagaacaacaagctgagcaaggagagaaagctgctggaggagagaatcagcgacctgaccaccaacctggccgaggaggaggagaaggccaagaacctgaccaagctgaagaacaagcacgagagcatgatcagcgagctggaggtgagactgaagaaggaggagaagagcagacaggagctggagaagctgaagagaaagctggagggcgacgccagcgacttccacgagcagatcgccgacctgcaggcccagatcgccgagctgaagatgcagctggccaagaaggaggaggagctgcaggccgccctggccagactggacgacgagatcgcccagaagaacaacgccctgaagaagatcagagagctggagggccacatcagcgacctgcaggaggacctggacagcgagagagccgccagaaacaaggccgagaagcagaagagagacctgggcgaggagctggaggccctgaagaccgagctggaggacaccctggacagcaccgccacccagcaggagctgagagccaagagagagcaggaggtgaccgtgctgaagaaggccctggacgaggagaccagaagccacgaggcccaggtgcaggagatgagacagaagcacgcccaggccgtggaggagctgaccgagcagctggagcagttcaagagagccaaggccaacctggacaagaacaagcagaccctggagaaggagaacgccgacctggccggcgagctgagagtgctgggccaggccaagcaggaggtggagcacaagaagaagaagctggaggcccaggtgcaggagctgcagagcaagtgcagcgacggcgagagagccagagccgagctgaacgacaaggtgcacaagctgcagaacgaggtggagagcgtgaccggcatgctgaacgaggccgagggcaaggccatcaagctggccaaggacgtggccagcctgagcagccagctgcaggacacccaggagctgctgcaggaggagaccagacagaagctgaacgtgagcaccaagctgagacagctggaggaggagagaaacagcctgcaggaccagctggacgaggagatggaggccaagcagaacctggagagacacatcagcaccctgaacatccagctgagcgacagcaagaagaagctgcaggacttcgccagcaccgtggaggccctggaggagggcaagaagagattccagaaggagatcgagaacctgacccagcagtacgaggagaaggccgccgcctacgacaagctggagaagaccaagaacagactgcagcaggagctggacgacctggtggtggacctggacaaccagagacagctggtgagcaacctggagaagaagcagagaaagttcgaccagctgctggccgaggagaagaacatcagcagcaagtacgccgacgagagagacagagccgaggccgaggccagagagaaggagaccaaggccctgagcctggccagagccctggaggaggccctggaggccaaggaggagctggagagaaccaacaagatgctgaaggccgagatggaggacctggtgagcagcaaggacgacgtgggcaagaacgtgcacgagctggagaagagcaagagagccctggagacccagatggaggagatgaagacccagctggaggagctggaggacgagctgcaggccaccgaggacgccaagctgagactggaggtgaacatgcaggccctgaagggccagttcgagagagacctgcaggccagagacgagcagaacgaggagaagagaagacagctgcagagacagctgcacgagtacgagaccgagctggaggacgagagaaagcagagagccctggccgccgccgccaagaagaagctggagggcgacctgaaggacctggagctgcaggccgacagcgccatcaagggcagagaggaggccatcaagcagctgagaaagctgcaggcccagatgaaggacttccagagagagctggaggacgccagagccagcagagacgagatcttcgccaccgccaaggagaacgagaagaaggccaagagcctggaggccgacctgatgcagctgcaggaggacctggccgccgccgagagagccagaaagcaggccgacctggagaaggaggagctggccgaggagctggccagcagcctgagcggcagaaacgccctgcaggacgagaagagaagactggaggccagaatcgcccagctggaggaggagctggaggaggagcagggcaacatggaggccatgagcgacagagtgagaaaggccacccagcaggccgagcagctgagcaacgagctggccaccgagagaagcaccgcccagaagaacgagagcgccagacagcagctggagagacagaacaaggagctgagaagcaagctgcacgagatggagggcgccgtgaagagcaagttcaagagcaccatcgccgccctggaggccaagatcgcccagctggaggagcaggtggagcaggaggccagagagaagcaggccgccaccaagagcctgaagcagaaggacaagaagctgaaggagatcctgctgcaggtggaggacgagagaaagatggccgagcagtacaaggagcaggccgagaagggcaacgccagagtgaagcagctgaagagacagctggaggaggccgaggaggagagccagagaatcaacgccaacagaagaaagctgcagagagagctggacgaggccaccgagagcaacgaggccatgggcagagaggtgaacgccctgaagagcaagctgagaggccccccccacagaaagctgagaagcgacgcccccggcgaggagaccagacccctgagcttcctgctggagggcctggaggacgtggagctgctgaagatgcagatggtgctgagaagaaagagaaccctggagacccagaccagcatggagcccagacccgtgaacaagcagctgagcaccgtgctgcaccacggcaagaagaccaagaaccagaacaagcagaccaagaagacccagcagcagcccagaaccaagcagaaccccgccgactgcacctag

SEQ ID NO: 90099 - DNA, 5940 bp, Artificial Sequence
  Description of Artificial Sequence: Synthetic coding sequence
atggcccagaagggccagctgagcgacgacgagaagttcctgttcgtggacaagaacttcatcaacagccccgtggcccaggccgactgggccgccaagagactggtgtgggtgcccagcgagaagcagggcttcgaggccgccagcatcaaggaggagaagggcgacgaggtggtggtggagctggtggagaacggcaagaaggtgaccgtgggcaaggacgacatccagaagatgaacccccccaagttcagcaaggtggaggacatggccgagctgacctgcctgaacgaggccagcgtgctgcacaacctgagagagagatacttcagcggcctgatctacacctacagcggcctgttctgcgtggtggtgaacccctacaagcacctgcccatctacagcgagaagatcgtggacatgtacaagggcaagaagagacacgagatgcccccccacatctacgccatcgccgacaccgcctacagaagcatgctgcaggacagagaggaccagagcatcctgtgcaccggcgagagcggcgccggcaagaccgagaacaccaagaaggtgatccagtacctggccgtggtggccagcagccacaagggcaagaaggacaccagcatcacccagggccccagcttcgcctacggcgagctggagaagcagctgctgcaggccaaccccatcctggaggccttcggcaacgccaagaccgtgaagaacgacaacagcagcagattcggcaagttcatcagaatcaacttcgacgtgaccggctacatcgtgggcgccaacatcgagacctacctgctggagaagagcagagccatcagacaggccagagacgagagaaccttccacatcttctactacatgatcgccggcgccaaggagaagatgagaagcgacctgctgctggagggcttcaacaactacaccttcctgagcaacggcttcgtgcccatccccgccgcccaggacgacgagatgttccaggagaccgtggaggccatggccatcatgggcttcagcgaggaggagcagctgagcatcctgaaggtggtgagcagcgtgctgcagctgggcaacatcgtgttcaagaaggagagaaacaccgaccaggccagcatgcccgacaacaccgccgcccagaaggtgtgccacctgatgggcatcaacgtgaccgacttcaccagaagcatcctgacccccagaatcaaggtgggcagagacgtggtgcagaaggcccagaccaaggagcaggccgacttcgccgtggaggccctggccaaggccacctacgagagactgttcagatggatcctgaccagagtgaacaaggccctggacaagacccacagacagggcgccagcttcctgggcatcctggacatcgccggcttcgagatcttcgaggtgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgagctgatcgagagacccaacaacccccccggcgtgctggccctgctggacgaggagtgctggttccccaaggccaccgacaagagcttcgtggagaagctgtgcaccgagcagggcagccaccccaagttccagaagcccaagcagctgaaggacaagaccgagttcagcatcatccactacgccggcaaggtggactacaacgccagcgcctggctgaccaagaacatggaccccctgaacgacaacgtgaccagcctgctgaacgccagcagcgacaagttcgtggccgacctgtggaaggacgtggacagaatcgtgggcctggaccagatggccaagatgaccgagagcagcctgcccagcgccagcaagaccaagaagggcatgttcagaaccgtgggccagctgtacaaggagcagctgggcaagctgatgaccaccctgagaaacaccacccccaacttcgtgagatgcatcatccccaaccacgagaagagaagcggcaagctggacgccttcctggtgctggagcagctgagatgcaacggcgtgctggagggcatcagaatctgcagacagggcttccccaacagaatcgtgttccaggagttcagacagagatacgagatcctggccgccaacgccatccccaagggcttcatggacggcaagcaggcctgcatcctgatgatcaaggccctggagctggaccccaacctgtacagaatcggccagagcaagatcttcttcagaaccggcgtgctggcccacctggaggaggagagagacctgaagatcaccgacgtgatcatggccttccaggccatgtgcagaggctacctggccagaaaggccttcgccaagagacagcagcagctgaccgccatgaaggtgatccagagaaactgcgccgcctacctgaagctgagaaactggcagtggtggagactgttcaccaaggtgaagcccctgctgcaggtgaccagacaggaggaggagatgcaggccaaggaggacgagctgcagaagaccaaggagagacagcagaaggccgagaacgagctgaaggagctggagcagaagcacagccagctgaccgaggagaagaacctgctgcaggagcagctgcaggccgagaccgagctgtacgccgaggccgaggagatgagagtgagactggccgccaagaagcaggagctggaggagatcctgcacgagatggaggccagactggaggaggaggaggacagaggccagcagctgcaggccgagagaaagaagatggcccagcagatgctggacctggaggagcagctggaggaggaggaggccgccagacagaagctgcagctggagaaggtgaccgccgaggccaagatcaagaagctggaggacgagatcctggtgatggacgaccagaacaacaagctgagcaaggagagaaagctgctggaggagagaatcagcgacctgaccaccaacctggccgaggaggaggagaaggccaagaacctgaccaagctgaagaacaagcacgagagcatgatcagcgagctggaggtgagactgaagaaggaggagaagagcagacaggagctggagaagctgaagagaaagctggagggcgacgccagcgacttccacgagcagatcgccgacctgcaggcccagatcgccgagctgaagatgcagctggccaagaaggaggaggagctgcaggccgccctggccagactggacgacgagatcgcccagaagaacaacgccctgaagaagatcagagagctggagggccacatcagcgacctgcaggaggacctggacagcgagagagccgccagaaacaaggccgagaagcagaagagagacctgggcgaggagctggaggccctgaagaccgagctggaggacaccctggacagcaccgccacccagcaggagctgagagccaagagagagcaggaggtgaccgtgctgaagaaggccctggacgaggagaccagaagccacgaggcccaggtgcaggagatgagacagaagcacgcccaggccgtggaggagctgaccgagcagctggagcagttcaagagagccaaggccaacctggacaagaacaagcagaccctggagaaggagaacgccgacctggccggcgagctgagagtgctgggccaggccaagcaggaggtggagcacaagaagaagaagctggaggcccaggtgcaggagctgcagagcaagtgcagcgacggcgagagagccagagccgagctgaacgacaaggtgcacaagctgcagaacgaggtggagagcgtgaccggcatgctgaacgaggccgagggcaaggccatcaagctggccaaggacgtggccagcctgagcagccagctgcaggacacccaggagctgctgcaggaggagaccagacagaagctgaacgtgagcaccaagctgagacagctggaggaggagagaaacagcctgcaggaccagctggacgaggagatggaggccaagcagaacctggagagacacatcagcaccctgaacatccagctgagcgacagcaagaagaagctgcaggacttcgccagcaccgtggaggccctggaggagggcaagaagagattccagaaggagatcgagaacctgacccagcagtacgaggagaaggccgccgcctacgacaagctggagaagaccaagaacagactgcagcaggagctggacgacctggtggtggacctggacaaccagagacagctggtgagcaacctggagaagaagcagagaaagttcgaccagctgctggccgaggagaagaacatcagcagcaagtacgccgacgagagagacagagccgaggccgaggccagagagaaggagaccaaggccctgagcctggccagagccctggaggaggccctggaggccaaggaggagctggagagaaccaacaagatgctgaaggccgagatggaggacctggtgagcagcaaggacgacgtgggcaagaacgtgcacgagctggagaagagcaagagagccctggagacccagatggaggagatgaagacccagctggaggagctggaggacgagctgcaggccaccgaggacgccaagctgagactggaggtgaacatgcaggccctgaagggccagttcgagagagacctgcaggccagagacgagcagaacgaggagaagagaagacagctgcagagacagctgcacgagtacgagaccgagctggaggacgagagaaagcagagagccctggccgccgccgccaagaagaagctggagggcgacctgaaggacctggagctgcaggccgacagcgccatcaagggcagagaggaggccatcaagcagctgagaaagctgcaggcccagatgaaggacttccagagagagctggaggacgccagagccagcagagacgagatcttcgccaccgccaaggagaacgagaagaaggccaagagcctggaggccgacctgatgcagctgcaggaggacctggccgccgccgagagagccagaaagcaggccgacctggagaaggaggagctggccgaggagctggccagcagcctgagcggcagaaacgccctgcaggacgagaagagaagactggaggccagaatcgcccagctggaggaggagctggaggaggagcagggcaacatggaggccatgagcgacagagtgagaaaggccacccagcaggccgagcagctgagcaacgagctggccaccgagagaagcaccgcccagaagaacgagagcgccagacagcagctggagagacagaacaaggagctgagaagcaagctgcacgagatggagggcgccgtgaagagcaagttcaagagcaccatcgccgccctggaggccaagatcgcccagctggaggagcaggtggagcaggaggccagagagaagcaggccgccaccaagagcctgaagcagaaggacaagaagctgaaggagatcctgctgcaggtggaggacgagagaaagatggccgagcagtacaaggagcaggccgagaagggcaacgccagagtgaagcagctgaagagacagctggaggaggccgaggaggagagccagagaatcaacgccaacagaagaaagctgcagagagagctggacgaggccaccgagagcaacgaggccatgggcagagaggtgaacgccctgaagagcaagctgagaagaggcaacgagaccagcttcgtgcccagcagaagaagcggcggcagaagagtgatcgagaacgccgacggcagcgaggaggagaccgacaccagagacgccgacttcaacggcaccaaggccagcgagtag

SEQ ID NO: 90100 - DNA, 5838 bp, Artificial Sequence
  Description of Artificial Sequence: Synthetic coding sequence
atggcccagaagggccagctgagcgacgacgagaagttcctgttcgtggacaagaacttcatcaacagccccgtggcccaggccgactgggccgccaagagactggtgtgggtgcccagcgagaagcagggcttcgaggccgccagcatcaaggaggagaagggcgacgaggtggtggtggagctggtggagaacggcaagaaggtgaccgtgggcaaggacgacatccagaagatgaacccccccaagttcagcaaggtggaggacatggccgagctgacctgcctgaacgaggccagcgtgctgcacaacctgagagagagatacttcagcggcctgatctacacctacagcggcctgttctgcgtggtggtgaacccctacaagcacctgcccatctacagcgagaagatcgtggacatgtacaagggcaagaagagacacgagatgcccccccacatctacgccatcgccgacaccgcctacagaagcatgctgcaggacagagaggaccagagcatcctgtgcaccggcgagagcggcgccggcaagaccgagaacaccaagaaggtgatccagtacctggccgtggtggccagcagccacaagggcaagaaggacaccagcatcacccagggccccagcttcgcctacggcgagctggagaagcagctgctgcaggccaaccccatcctggaggccttcggcaacgccaagaccgtgaagaacgacaacagcagcagattcggcaagttcatcagaatcaacttcgacgtgaccggctacatcgtgggcgccaacatcgagacctacctgctggagaagagcagagccatcagacaggccagagacgagagaaccttccacatcttctactacatgatcgccggcgccaaggagaagatgagaagcgacctgctgctggagggcttcaacaactacaccttcctgagcaacggcttcgtgcccatccccgccgcccaggacgacgagatgttccaggagaccgtggaggccatggccatcatgggcttcagcgaggaggagcagctgagcatcctgaaggtggtgagcagcgtgctgcagctgggcaacatcgtgttcaagaaggagagaaacaccgaccaggccagcatgcccgacaacaccgccgcccagaaggtgtgccacctgatgggcatcaacgtgaccgacttcaccagaagcatcctgacccccagaatcaaggtgggcagagacgtggtgcagaaggcccagaccaaggagcaggccgacttcgccgtggaggccctggccaaggccacctacgagagactgttcagatggatcctgaccagagtgaacaaggccctggacaagacccacagacagggcgccagcttcctgggcatcctggacatcgccggcttcgagatcttcgaggtgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgagctgatcgagagacccaacaacccccccggcgtgctggccctgctggacgaggagtgctggttccccaaggccaccgacaagagcttcgtggagaagctgtgcaccgagcagggcagccaccccaagttccagaagcccaagcagctgaaggacaagaccgagttcagcatcatccactacgccggcaaggtggactacaacgccagcgcctggctgaccaagaacatggaccccctgaacgacaacgtgaccagcctgctgaacgccagcagcgacaagttcgtggccgacctgtggaaggacgtggacagaatcgtgggcctggaccagatggccaagatgaccgagagcagcctgcccagcgccagcaagaccaagaagggcatgttcagaaccgtgggccagctgtacaaggagcagctgggcaagctgatgaccaccctgagaaacaccacccccaacttcgtgagatgcatcatccccaaccacgagaagagaagcggcaagctggacgccttcctggtgctggagcagctgagatgcaacggcgtgctggagggcatcagaatctgcagacagggcttccccaacagaatcgtgttccaggagttcagacagagatacgagatcctggccgccaacgccatccccaagggcttcatggacggcaagcaggcctgcatcctgatgatcaaggccctggagctggaccccaacctgtacagaatcggccagagcaagatcttcttcagaaccggcgtgctggcccacctggaggaggagagagacctgaagatcaccgacgtgatcatggccttccaggccatgtgcagaggctacctggccagaaaggccttcgccaagagacagcagcagctgaccgccatgaaggtgatccagagaaactgcgccgcctacctgaagctgagaaactggcagtggtggagactgttcaccaaggtgaagcccctgctgcaggtgaccagacaggaggaggagatgcaggccaaggaggacgagctgcagaagaccaaggagagacagcagaaggccgagaacgagctgaaggagctggagcagaagcacagccagctgaccgaggagaagaacctgctgcaggagcagctgcaggccgagaccgagctgtacgccgaggccgaggagatgagagtgagactggccgccaagaagcaggagctggaggagatcctgcacgagatggaggccagactggaggaggaggaggacagaggccagcagctgcaggccgagagaaagaagatggcccagcagatgctggacctggaggagcagctggaggaggaggaggccgccagacagaagctgcagctggagaaggtgaccgccgaggccaagatcaagaagctggaggacgagatcctggtgatggacgaccagaacaacaagctgagcaaggagagaaagctgctggaggagagaatcagcgacctgaccaccaacctggccgaggaggaggagaaggccaagaacctgaccaagctgaagaacaagcacgagagcatgatcagcgagctggaggtgagactgaagaaggaggagaagagcagacaggagctggagaagctgaagagaaagctggagggcgacgccagcgacttccacgagcagatcgccgacctgcaggcccagatcgccgagctgaagatgcagctggccaagaaggaggaggagctgcaggccgccctggccagactggacgacgagatcgcccagaagaacaacgccctgaagaagatcagagagctggagggccacatcagcgacctgcaggaggacctggacagcgagagagccgccagaaacaaggccgagaagcagaagagagacctgggcgaggagctggaggccctgaagaccgagctggaggacaccctggacagcaccgccacccagcaggagctgagagccaagagagagcaggaggtgaccgtgctgaagaaggccctggacgaggagaccagaagccacgaggcccaggtgcaggagatgagacagaagcacgcccaggccgtggaggagctgaccgagcagctggagcagttcaagagagccaaggccaacctggacaagaacaagcagaccctggagaaggagaacgccgacctggccggcgagctgagagtgctgggccaggccaagcaggaggtggagcacaagaagaagaagctggaggcccaggtgcaggagctgcagagcaagtgcagcgacggcgagagagccagagccgagctgaacgacaaggtgcacaagctgcagaacgaggtggagagcgtgaccggcatgctgaacgaggccgagggcaaggccatcaagctggccaaggacgtggccagcctgagcagccagctgcaggacacccaggagctgctgcaggaggagaccagacagaagctgaacgtgagcaccaagctgagacagctggaggaggagagaaacagcctgcaggaccagctggacgaggagatggaggccaagcagaacctggagagacacatcagcaccctgaacatccagctgagcgacagcaagaagaagctgcaggacttcgccagcaccgtggaggccctggaggagggcaagaagagattccagaaggagatcgagaacctgacccagcagtacgaggagaaggccgccgcctacgacaagctggagaagaccaagaacagactgcagcaggagctggacgacctggtggtggacctggacaaccagagacagctggtgagcaacctggagaagaagcagagaaagttcgaccagctgctggccgaggagaagaacatcagcagcaagtacgccgacgagagagacagagccgaggccgaggccagagagaaggagaccaaggccctgagcctggccagagccctggaggaggccctggaggccaaggaggagctggagagaaccaacaagatgctgaaggccgagatggaggacctggtgagcagcaaggacgacgtgggcaagaacgtgcacgagctggagaagagcaagagagccctggagacccagatggaggagatgaagacccagctggaggagctggaggacgagctgcaggccaccgaggacgccaagctgagactggaggtgaacatgcaggccctgaagggccagttcgagagagacctgcaggccagagacgagcagaacgaggagaagagaagacagctgcagagacagctgcacgagtacgagaccgagctggaggacgagagaaagcagagagccctggccgccgccgccaagaagaagctggagggcgacctgaaggacctggagctgcaggccgacagcgccatcaagggcagagaggaggccatcaagcagctgagaaagctgcaggcccagatgaaggacttccagagagagctggaggacgccagagccagcagagacgagatcttcgccaccgccaaggagaacgagaagaaggccaagagcctggaggccgacctgatgcagctgcaggaggacctggccgccgccgagagagccagaaagcaggccgacctggagaaggaggagctggccgaggagctggccagcagcctgagcggcagaaacgccctgcaggacgagaagagaagactggaggccagaatcgcccagctggaggaggagctggaggaggagcagggcaacatggaggccatgagcgacagagtgagaaaggccacccagcaggccgagcagctgagcaacgagctggccaccgagagaagcaccgcccagaagaacgagagcgccagacagcagctggagagacagaacaaggagctgagaagcaagctgcacgagatggagggcgccgtgaagagcaagttcaagagcaccatcgccgccctggaggccaagatcgcccagctggaggagcaggtggagcaggaggccagagagaagcaggccgccaccaagagcctgaagcagaaggacaagaagctgaaggagatcctgctgcaggtggaggacgagagaaagatggccgagcagtacaaggagcaggccgagaagggcaacgccagagtgaagcagctgaagagacagctggaggaggccgaggaggagagccagagaatcaacgccaacagaagaaagctgcagagagagctggacgaggccaccgagagcaacgaggccatgggcagagaggtgaacgccctgaagagcaagctgagaggcccccccccccaggagaccagccagtag

SEQ ID NO: 90101 - DNA, 5817 bp, Artificial Sequence; identical to SEQ ID NO: 89972
  Description of Artificial Sequence: Synthetic coding sequence

SEQ ID NO: 90102 - DNA, 2001 bp, Artificial Sequence
  Description of Artificial Sequence: Synthetic coding sequence
atgctgagccacatgctgtacaagaaggagaacgccatcgacatcctgggcttcagcagcgaggagaaggtgggcatctacaagctgaccggcgccgtgatgcactacggcaacatgaagttcaagcagaagcagagagaggagcaggccgagcccgacggcaccgaggtggccgacaaggccggctacctgatgggcctgaacagcgccgagatgctgaagggcctgtgctgccccagagtgaaggtgggcaacgagtacgtgaccaagggccagaacgtgcagcaggtgaccaacagcgtgggcgccctggccaaggccgtgtacgagaagatgttcctgtggatggtgaccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtgggagttcatcgacttcggcatggacctggccgcctgcatcgagctgatcgagaagcccatgggcatcttcagcatcctggaggaggagtgcatgttccccaaggccaccgacaccagcttcaagaacaagctgtacgaccagcacctgggcaagagcaacaacttccagaagcccaagcccgccaagggcaaggccgaggcccacttcagcctggtgcactacgccggcaccgtggactacaacatcgccggctggctggacaagaacaaggaccccctgaacgagaccgtggtgggcctgtaccagaagagcagcctgaagctgctgagcttcctgttcagcaactacgccggcgccgagaccggcgacagcggcggcagcaagaagggcggcaagaagaagggcagcagcttccagaccgtgagcgccgtgttcagagagaacctgaacaagctgatgaccaacctgagaagcacccacccccacttcgtgagatgcctgatccccaacgagaccaagacccccggcgtgatggaccactacctggtgatgcaccagctgagatgcaacggcgtgctggagggcatcagaatctgcagaaagggcttccccagcagaatcctgtacgccgacttcaagcagagatacagaatcctgaacgccagcgccatccccgagggccagttcatcgacagcaagaacgccagcgagaagctgctgaacagcatcgacgtggacagagagcagttcagattcggcaacaccaaggtgttcttcaaggccggcctgctgggcctgctggaggagatgagagacgagaagctggtgaccctgatgaccagcacccaggccgtgtgcagaggctacctgatgagagtggagttcaagaagatgatggagagaagagacagcatcttctgcatccagtacaacatcagaagcttcatgaacgtgaagcactggccctggatgaacctgttcttcaagatcaagcccctgctgaagagcgccgaggccgagaaggagatggccaccatgaaggaggacttcgagagaaccaaggaggagctggccagaagcgaggccagaagaaaggagctgaccgagagactggaggaggaggaggagatgaacagcgagctggtggccaagaagagaaacctggaggacaagtgcagcagcctgaagagagacatcgacgacctggagctgaccctgaccaaggtggagaaggagaagcacgccaccgagaacaaggtgaagaacctgagcgaggagatgaccgccctggaggagaacatcagcaagctgaccaaggagaagaagagcctgcaggaggcccaccagcagaccctggacgacctgcaggtggaggaggacaaggtgaacggcctgatcaagatcaacgccaagctggagcagcagaccgacgacgagggcgtgtag

SEQ ID NO: 90103 - DNA, 6111 bp, Artificial Sequence; identical to SEQ ID NO: 89973
  Description of Artificial Sequence: Synthetic coding sequence

SEQ ID NO: 90104 - DNA, 4437 bp, Artificial Sequence
  Description of Artificial Sequence: Synthetic coding sequence
atggccgccgtgaccatgagcgtgcccggcagaaaggccccccccagacccggccccgtgcccgaggccgcccagcccttcctgttcacccccagaggccccagcgccggcggcggccccggcagcggcaccagcccccaggtggagtggaccgccagaagactggtgtgggtgcccagcgagctgcacggcttcgaggccgccgccctgagagacgagggcgaggaggaggccgaggtggagctggccgagagcggcagaagactgagactgcccagagaccagatccagagaatgaacccccccaagttcagcaaggccgaggacatggccgagctgacctgcctgaacgaggccagcgtgctgcacaacctgagagagagatactacagcggcctgatctacacctacagcggcctgttctgcgtggtgatcaacccctacaagcagctgcccatctacaccgaggccatcgtggagatgtacagaggcaagaagagacacgaggtgcccccccacgtgtacgccgtgaccgagggcgcctacagaagcatgctgcaggacagagaggaccagagcatcctgtgcaccggcgagagcggcgccggcaagaccgagaacaccaagaaggtgatccagtacctggcccacgtggccagcagccccaagggcagaaaggagcccggcgtgcccggcgagctggagagacagctgctgcaggccaaccccatcctggaggccttcggcaacgccaagaccgtgaagaacgacaacagcagcagattcggcaagttcatcagaatcaacttcgacgtggccggctacatcgtgggcgccaacatcgagacctacctgctggagaagagcagagccatcagacaggccaaggacgagtgcagcttccacatcttctaccagctgctgggcggcgccggcgagcagctgaaggccgacctgctgctggagccctgcagccactacagattcctgaccaacggccccagcagcagccccggccaggagagagagctgttccaggagaccctggagagcctgagagtgctgggcttcagccacgaggagatcatcagcatgctgagaatggtgagcgccgtgctgcagttcggcaacatcgccctgaagagagagagaaacaccgaccaggccaccatgcccgacaacaccgccgcccagaagctgtgcagactgctgggcctgggcgtgaccgacttcagcagagccctgctgacccccagaatcaaggtgggcagagactacgtgcagaaggcccagaccaaggagcaggccgacttcgccctggaggccctggccaaggccacctacgagagactgttcagatggctggtgctgagactgaacagagccctggacagaagccccagacagggcgccagcttcctgggcatcctggacatcgccggcttcgagatcttccagctgaacagcttcgagcagctgtgcatcaactacaccaacgagaagctgcagcagctgttcaaccacaccatgttcgtgctggagcaggaggagtaccagagagagggcatcccctggaccttcctggacttcggcctggacctgcagccctgcatcgacctgatcgagagacccgccaacccccccggcctgctggccctgctggacgaggagtgctggttccccaaggccaccgacaagagcttcgtggagaaggtggcccaggagcagggcggccaccccaagttccagagacccagacacctgagagaccaggccgacttcagcgtgctgcactacgccggcaaggtggactacaaggccaacgagtggctgatgaagaacatggaccccctgaacgacaacgtggccgccctgctgcaccagagcaccgacagactgaccgccgagatctggaaggacgtggagggcatcgtgggcctggagcaggtgagcagcctgggcgacggcccccccggcggcagacccagaagaggcatgttcagaaccgtgggccagctgtacaaggagagcctgagcagactgatggccaccctgagcaacaccaaccccagcttcgtgagatgcatcgtgcccaaccacgagaagagagccggcaagctggagcccagactggtgctggaccagctgagatgcaacggcgtgctggagggcatcagaatctgcagacagggcttccccaacagaatcctgttccaggagttcagacagagatacgagatcctgacccccaacgccatccccaagggcttcatggacggcaagcaggcctgcgagaagatgatccaggccctggagctggaccccaacctgtacagagtgggccagagcaagatcttcttcagagccggcgtgctggcccagctggaggaggagagagacctgaaggtgaccgacatcatcgtgagcttccaggccgccgccagaggctacctggccagaagagccttccagaagagacagcagcagcagagcgccctgagagtgatgcagagaaactgcgccgcctacctgaagctgagacactggcagtggtggagactgttcaccaaggtgaagcccctgctgcaggtgaccagacaggacgaggtgctgcaggccagagcccaggagctgcagaaggtgcaggagctgcagcagcagagcgccagagaggtgggcgagctgcagggcagagtggcccagctggaggaggagagagccagactggccgagcagctgagagccgaggccgagctgtgcgccgaggccgaggagaccagaggcagactggccgccagaaagcaggagctggagctggtggtgagcgagctggaggccagagtgggcgaggaggaggagtgcagcagacagatgcagaccgagaagaagagactgcagcagcacatccaggagctggaggcccacctggaggccgaggagggcgccagacagaagctgcagctggagaaggtgaccaccgaggccaagatgaagaagttcgaggaggacctgctgctgctggaggaccagaacagcaagctgagcaagagcggcagctgctggaagatcgtgtggcccagcagccaccccagacagctgagaagaagaagaagaagcagagccagcatcagctacggcagcaacatgagaccccagagccagacctggagagacagactgagaaaggaggagaagggcagacaggagctggagaagctgaagagaagactggacggcgagagcagcgagctgcaggagcagatggtggagcagcagcagagagccgaggagctgagagcccagctgggcagaaaggaggaggagctgcaggccgccctggccagagccgaggacgagggcggcgccagagcccagctgctgaagagcctgagagaggcccaggccgccctggccgaggcccaggaggacctggagagcgagagagtggccagaaccaaggccgagaagcagagaagagacctgggcgaggagctggaggccctgagaggcgagctggaggacaccctggacagcaccaacgcccagcaggagctgagaagcaagagagagcaggaggtgaccgagctgaagaagaccctggaggaggagaccagaatccacgaggccgccgtgcaggagctgagacagagacacggccaggccctgggcgagctggccgagcagctggagcaggccagaagaggcaagggcgcctgggagaagaccagactggccctggaggccgaggtgagcgagctgagagccgagctgagcagcctgcagaccgccagacaggagggcgagcagagaagaagaagactggagctgcagctgcaggaggtgcagggcagagccggcgacggcgagagagccagagccgaggccgccgagaagctgcagagagcccaggccgagctggagaacgtgagcggcgccctgaacgaggccgagagcaagaccatcagactgagcaaggagctgagcagcaccgaggcccagctgcacgacgcccaggagctgctgcaggaggagaccagagccaagctggccctgggcagcagagtgagagccatggaggccgaggccgccggcctgagagagcagctggaggaggaggccgccgccagagagagagccggcagagagctgcagaccgcccaggcccagctgagcgagtggagaagaagacaggaggaggaggccggcgccctggaggccggcgaggaggccagaagaagagccgccagagaggccgaggccctgacccagagactggccgagaagaccgagaccgtggacagactggagagaggcagaagaagactgcagcaggagctggacgacgccaccctgagccccgacgccctgaccgacggcgcccagccccccagcagcctggaccccaccggcccctgccccagaaaccccgccctgtag

SEQ ID NO: 90105 - DNA, 5340 bp, Artificial Sequence
  Description of Artificial Sequence: Synthetic coding sequence
atggccgccgtgaccatgagcgtgcccggcagaaaggccccccccagacccggccccgtgcccgaggccgcccagcccttcctgttcacccccagaggccccagcgccggcggcggccccggcagcggcaccagcccccaggtggagtggaccgccagaagactggtgtgggtgcccagcgagctgcacggcttcgaggccgccgccctgagagacgagggcgaggaggaggccgaggtggagctggccgagagcggcagaagactgagactgcccagagaccagatccagagaatgaacccccccaagttcagcaaggccgaggacatggccgagctgacctgcctgaacgaggccagcgtgctgcacaacctgagagagagatactacagcggcctgatctacacctacagcggcctgttctgcgtggtgatcaacccctacaagcagctgcccatctacaccgaggccatcgtggagatgtacagaggcaagaagagacacgaggtgcccccccacgtgtacgccgtgaccgagggcgcctacagaagcatgctgcaggacagagaggaccagagcatcctgtgcaccggcgagagcggcgccggcaagaccgagaacaccaagaaggtgatccagtacctggcccacgtggccagcagccccaagggcagaaaggagcccggcgtgcccggcgagctggagagacagctgctgcaggccaaccccatcctggaggccttcggcaacgccaagaccgtgaagaacgacaacagcagcagattcggcaagttcatcagaatcaacttcgacgtggccggctacatcgtgggcgccaacatcgagacctacctgctggagaagagcagagccatcagacaggccaaggacgagtgcagcttccacatcttctaccagctgctgggcggcgccggcgagcagctgaaggccgacctgctgctggagccctgcagccactacagattcctgaccaacggccccagcagcagccccggccaggagagagagctgttccaggagaccctggagagcctgagagtgctgggcttcagccacgaggagatcatcagcatgctgagaatggtgagcgccgtgctgcagttcggcaacatcgccctgaagagagagagaaacaccgaccaggccaccatgcccgacaacaccgccgcccagaagctgtgcagactgctgggcctgggcgtgaccgacttcagcagagccctgctgacccccagaatcaaggtgggcagagactacgtgcagaaggcccagaccaaggagcaggccgacttcgccctggaggccctggccaaggccacctacgagagactgttcagatggctggtgctgagactgaacagagccctggacagaagccccagacagggcgccagcttcctgggcatcctggacatcgccggcttcgagatcttccagctgaacagcttcgagcagctgtgcatcaactacaccaacgagaagctgcagcagctgttcaaccacaccatgttcgtgctggagcaggaggagtaccagagagagggcatcccctggaccttcctggacttcggcctggacctgcagccctgcatcgacctgatcgagagacccgccaacccccccggcctgctggccctgctggacgaggagtgctggttccccaaggccaccgacaagagcttcgtggagaaggtggcccaggagcagggcggccaccccaagttccagagacccagacacctgagagaccaggccgacttcagcgtgctgcactacgccggcaaggtggactacaaggccaacgagtggctgatgaagaacatggaccccctgaacgacaacgtggccgccctgctgcaccagagcaccgacagactgaccgccgagatctggaaggacgtggagggcatcgtgggcctggagcaggtgagcagcctgggcgacggcccccccggcggcagacccagaagaggcatgttcagaaccgtgggccagctgtacaaggagagcctgagcagactgatggccaccctgagcaacaccaaccccagcttcgtgagatgcatcgtgcccaaccacgagaagagagccggcaagctggagcccagactggtgctggaccagctgagatgcaacggcgtgctggagggcatcagaatctgcagacagggcttccccaacagaatcctgttccaggagttcagacagagatacgagatcctgacccccaacgccatccccaagggcttcatggacggcaagcaggcctgcgagaagatgatccaggccctggagctggaccccaacctgtacagagtgggccagagcaagatcttcttcagagccggcgtgctggcccagctggaggaggagagagacctgaaggtgaccgacatcatcgtgagcttccaggccgccgccagaggctacctggccagaagagccttccagaagagacagcagcagcagagcgccctgagagtgatgcagagaaactgcgccgcctacctgaagctgagacactggcagtggtggagactgttcaccaaggtgaagcccctgctgcaggtgaccagacaggacgaggtgctgcaggccagagcccaggagctgcagaaggtgcaggagctgcagcagcagagcgccagagaggtgggcgagctgcagggcagagtggcccagctggaggaggagagagccagactggccgagcagctgagagccgaggccgagctgtgcgccgaggccgaggagaccagaggcagactggccgccagaaagcaggagctggagctggtggtgagcgagctggaggccagagtgggcgaggaggaggagtgcagcagacagatgcagaccgagaagaagagactgcagcagcacatccaggagctggaggcccacctggaggccgaggagggcgccagacagaagctgcagctggagaaggtgaccaccgaggccaagatgaagaagttcgaggaggacctgctgctgctggaggaccagaacagcaagctgagcaagagcggcagctgctggaagatcgtgtggcccagcagccaccccagacagctgagaagaagaagaagaagcagagccagcatcagctacggcagcaacatgagaccccagagccagacctggagagacagactgagaaaggaggagaagggcagacaggagctggagaagctgaagagaagactggacggcgagagcagcgagctgcaggagcagatggtggagcagcagcagagagccgaggagctgagagcccagctgggcagaaaggaggaggagctgcaggccgccctggccagagccgaggacgagggcggcgccagagcccagctgctgaagagcctgagagaggcccaggccgccctggccgaggcccaggaggacctggagagcgagagagtggccagaaccaaggccgagaagcagagaagagacctgggcgaggagctggaggccctgagaggcgagctggaggacaccctggacagcaccaacgcccagcaggagctgagaagcaagagagagcaggaggtgaccgagctgaagaagaccctggaggaggagaccagaatccacgaggccgccgtgcaggagctgagacagagacacggccaggccctgggcgagctggccgagcagctggagcaggccagaagaggcaagggcgcctgggagaagaccagactggccctggaggccgaggtgagcgagctgagagccgagctgagcagcctgcagaccgccagacaggagggcgagcagagaagaagaagactggagctgcagctgcaggaggtgcagggcagagccggcgacggcgagagagccagagccgaggccgccgagaagctgcagagagcccaggccgagctggagaacgtgagcggcgccctgaacgaggccctgctgagcagcaaggacgacgtgggcaagagcgtgcacgagctggagagagcctgcagagtggccgagcaggccgccaacgacctgagagcccaggtgaccgagctggaggacgagctgaccgccgccgaggacgccaagctgagactggaggtgaccgtgcaggccctgaagacccagcacgagagagacctgcagggcagagacgaggccggcgaggagagaagaagacagctggccaagcagctgagagacgccgaggtggagagagacgaggagagaaagcagagaaccctggccgtggccgccagaaagaagctggagggcgagctggaggagctgaaggcccagatggccagcgccggccagggcaaggaggaggccgtgaagcagctgagaaagatgcaggcccagatgaaggagctgtggagagaggtggaggagaccagaaccagcagagaggagatcttcagccagaacagagagagcgagaagagactgaagggcctggaggccgaggtgctgagactgcaggaggagctggccgccagcgacagagccagaagacaggcccagcaggacagagacgagatggccgacgaggtggccaacggcaacctgagcaaggccgccatcctggaggagaagagacagctggagggcagactgggccagctggaggaggagctggaggaggagcagagcaacagcgagctgctgaacgacagatacagaaagctgctgctgcaggtggagagcctgaccaccgagctgagcgccgagagaagcttcagcgccaaggccgagagcggcagacagcagctggagagacagatccaggagctgagaggcagactgggcgaggaggacgccggcgccagagccagacacaagatgaccatcgccgccctggagagcaagctggcccaggccgaggagcagctggagcaggagaccagagagagaatcctgagcggcaagctggtgagaagagccgagaagagactgaaggaggtggtgctgcaggtggaggaggagagaagagtggccgaccagctgagagaccagctggagaagggcaacctgagagtgaagcagctgaagagacagctggaggaggccgaggaggaggccagcagagcccaggccggcagaagaagactgcagagagagctggaggacgtgaccgagagcgccgagagcatgaacagagaggtgaccaccctgagaaacagactgagaagaggccccctgaccttcaccaccagaaccgtgagacaggtgttcagactggaggagggcgtggccagcgacgaggaggccgaggaggcccagcccggcagcggccccagccccgagcccgagggcagcccccccgcccacccccagtag

SEQ ID NO: 90106 - DNA, 6087 bp, Artificial Sequence
  Description of Artificial Sequence: Synthetic coding sequence
atggccgccgtgaccatgagcgtgcccggcagaaaggccccccccagacccggccccgtgcccgaggccgcccagcccttcctgttcacccccagaggccccagcgccggcggcggccccggcagcggcaccagcccccaggtggagtggaccgccagaagactggtgtgggtgcccagcgagctgcacggcttcgaggccgccgccctgagagacgagggcgaggaggaggccgaggtggagctggccgagagcggcagaagactgagactgcccagagaccagatccagagaatgaacccccccaagttcagcaaggccgaggacatggccgagctgacctgcctgaacgaggccagcgtgctgcacaacctgagagagagatactacagcggcctgatctacacctacagcggcctgttctgcgtggtgatcaacccctacaagcagctgcccatctacaccgaggccatcgtggagatgtacagaggcaagaagagacacgaggtgcccccccacgtgtacgccgtgaccgagggcgcctacagaagcatgctgcaggacagagaggaccagagcatcctgtgcaccggcgagagcggcgccggcaagaccgagaacaccaagaaggtgatccagtacctggcccacgtggccagcagccccaagggcagaaaggagcccggcgtgcccggcgagctggagagacagctgctgcaggccaaccccatcctggaggccttcggcaacgccaagaccgtgaagaacgacaacagcagcagattcggcaagttcatcagaatcaacttcgacgtggccggctacatcgtgggcgccaacatcgagacctacctgctggagaagagcagagccatcagacaggccaaggacgagtgcagcttccacatcttctaccagctgctgggcggcgccggcgagcagctgaaggccgacctgctgctggagccctgcagccactacagattcctgaccaacggccccagcagcagccccggccaggagagagagctgttccaggagaccctggagagcctgagagtgctgggcttcagccacgaggagatcatcagcatgctgagaatggtgagcgccgtgctgcagttcggcaacatcgccctgaagagagagagaaacaccgaccaggccaccatgcccgacaacaccgccgcccagaagctgtgcagactgctgggcctgggcgtgaccgacttcagcagagccctgctgacccccagaatcaaggtgggcagagactacgtgcagaaggcccagaccaaggagcaggccgacttcgccctggaggccctggccaaggccacctacgagagactgttcagatggctggtgctgagactgaacagagccctggacagaagccccagacagggcgccagcttcctgggcatcctggacatcgccggcttcgagatcttccagctgaacagcttcgagcagctgtgcatcaactacaccaacgagaagctgcagcagctgttcaaccacaccatgttcgtgctggagcaggaggagtaccagagagagggcatcccctggaccttcctggacttcggcctggacctgcagccctgcatcgacctgatcgagagacccgccaacccccccggcctgctggccctgctggacgaggagtgctggttccccaaggccaccgacaagagcttcgtggagaaggtggcccaggagcagggcggccaccccaagttccagagacccagacacctgagagaccaggccgacttcagcgtgctgcactacgccggcaaggtggactacaaggccaacgagtggctgatgaagaacatggaccccctgaacgacaacgtggccgccctgctgcaccagagcaccgacagactgaccgccgagatctggaaggacgagcacggcggcttccagcagttcagcttcctgggcagcttcccccccagcccccccggcagcgccgagagatgcagcagcgccatcagcccccccggcgtggagggcatcgtgggcctggagcaggtgagcagcctgggcgacggcccccccggcggcagacccagaagaggcatgttcagaaccgtgggccagctgtacaaggagagcctgagcagactgatggccaccctgagcaacaccaaccccagcttcgtgagatgcatcgtgcccaaccacgagaagagagccggcaagctggagcccagactggtgctggaccagctgagatgcaacggcgtgctggagggcatcagaatctgcagacagggcttccccaacagaatcctgttccaggagttcagacagagatacgagatcctgacccccaacgccatccccaagggcttcatggacggcaagcaggcctgcgagaagatgatccaggccctggagctggaccccaacctgtacagagtgggccagagcaagatcttcttcagagccggcgtgctggcccagctggaggaggagagagacctgaaggtgaccgacatcatcgtgagcttccaggccgccgccagaggctacctggccagaagagccttccagaagagacagcagcagcagagcgccctgagagtgatgcagagaaactgcgccgcctacctgaagctgagacactggcagtggtggagactgttcaccaaggtgaagcccctgctgcaggtgaccagacaggacgaggtgctgcaggccagagcccaggagctgcagaaggtgcaggagctgcagcagcagagcgccagagaggtgggcgagctgcagggcagagtggcccagctggaggaggagagagccagactggccgagcagctgagagccgaggccgagctgtgcgccgaggccgaggagaccagaggcagactggccgccagaaagcaggagctggagctggtggtgagcgagctggaggccagagtgggcgaggaggaggagtgcagcagacagatgcagaccgagaagaagagactgcagcagcacatccaggagctggaggcccacctggaggccgaggagggcgccagacagaagctgcagctggagaaggtgaccaccgaggccaagatgaagaagttcgaggaggacctgctgctgctggaggaccagaacagcaagctgagcaaggagagaaagctgctggaggacagactggccgagttcagcagccaggccgccgaggaggaggagaaggtgaagagcctgaacaagctgagactgaagtacgaggccaccatcgccgacatggaggacagactgagaaaggaggagaagggcagacaggagctggagaagctgaagagaagactggacggcgagagcagcgagctgcaggagcagatggtggagcagcagcagagagccgaggagctgagagcccagctgggcagaaaggaggaggagctgcaggccgccctggccagagccgaggacgagggcggcgccagagcccagctgctgaagagcctgagagaggcccaggccgccctggccgaggcccaggaggacctggagagcgagagagtggccagaaccaaggccgagaagcagagaagagacctgggcgaggagctggaggccctgagaggcgagctggaggacaccctggacagcaccaacgcccagcaggagctgagaagcaagagagagcaggaggtgaccgagctgaagaagaccctggaggaggagaccagaatccacgaggccgccgtgcaggagctgagacagagacacggccaggccctgggcgagctggccgagcagctggagcaggccagaagaggcaagggcgcctgggagaagaccagactggccctggaggccgaggtgagcgagctgagagccgagctgagcagcctgcagaccgccagacaggagggcgagcagagaagaagaagactggagctgcagctgcaggaggtgcagggcagagccggcgacggcgagagagccagagccgaggccgccgagaagctgcagagagcccaggccgagctggagaacgtgagcggcgccctgaacgaggccgagagcaagaccatcagactgagcaaggagctgagcagcaccgaggcccagctgcacgacgcccaggagctgctgcaggaggagaccagagccaagctggccctgggcagcagagtgagagccatggaggccgaggccgccggcctgagagagcagctggaggaggaggccgccgccagagagagagccggcagagagctgcagaccgcccaggcccagctgagcgagtggagaagaagacaggaggaggaggccggcgccctggaggccggcgaggaggccagaagaagagccgccagagaggccgaggccctgacccagagactggccgagaagaccgagaccgtggacagactggagagaggcagaagaagactgcagcaggagctggacgacgccaccatggacctggagcagcagagacagctggtgagcaccctggagaagaagcagagaaagttcgaccagctgctggccgaggagaaggccgccgtgctgagagccgtggaggagagagagagagccgaggccgagggcagagagagagaggccagagccctgagcctgaccagagccctggaggaggagcaggaggccagagaggagctggagagacagaacagagccctgagagccgagctggaggccctgctgagcagcaaggacgacgtgggcaagagcgtgcacgagctggagagagcctgcagagtggccgagcaggccgccaacgacctgagagcccaggtgaccgagctggaggacgagctgaccgccgccgaggacgccaagctgagactggaggtgaccgtgcaggccctgaagacccagcacgagagagacctgcagggcagagacgaggccggcgaggagagaagaagacagctggccaagcagctgagagacgccgaggtggagagagacgaggagagaaagcagagaaccctggccgtggccgccagaaagaagctggagggcgagctggaggagctgaaggcccagatggccagcgccggccagggcaaggaggaggccgtgaagcagctgagaaagatgcaggcccagatgaaggagctgtggagagaggtggaggagaccagaaccagcagagaggagatcttcagccagaacagagagagcgagaagagactgaagggcctggaggccgaggtgctgagactgcaggaggagctggccgccagcgacagagccagaagacaggcccagcaggacagagacgagatggccgacgaggtggccaacggcaacctgagcaaggccgccatcctggaggagaagagacagctggagggcagactgggccagctggaggaggagctggaggaggagcagagcaacagcgagctgctgaacgacagatacagaaagctgctgctgcaggtggagagcctgaccaccgagctgagcgccgagagaagcttcagcgccaaggccgagagcggcagacagcagctggagagacagatccaggagctgagaggcagactgggcgaggaggacgccggcgccagagccagacacaagatgaccatcgccgccctggagagcaagctggcccaggccgaggagcagctggagcaggagaccagagagagaatcctgagcggcaagctggtgagaagagccgagaagagactgaaggaggtggtgctgcaggtggaggaggagagaagagtggccgaccagctgagagaccagctggagaagggcaacctgagagtgaagcagctgaagagacagctggaggaggccgaggaggaggccagcagagcccaggccggcagaagaagactgcagagagagctggaggacgtgaccgagagcgccgagagcatgaacagagaggtgaccaccctgagaaacagactgagaagaggccccctgaccttcaccaccagaaccgtgagacaggtgttcagactggaggagggcgtggccagcgacgaggaggccgaggaggcccagcccggcagcggccccagccccgagcccgagggcagcccccccgcccacccccagtag

SEQ ID NO: 90107 - DNA, 6012 bp, Artificial Sequence
  Description of Artificial Sequence: Synthetic coding sequence
atggccgccgtgaccatgagcgtgcccggcagaaaggccccccccagacccggccccgtgcccgaggccgcccagcccttcctgttcacccccagaggccccagcgccggcggcggccccggcagcggcaccagcccccaggtggagtggaccgccagaagactggtgtgggtgcccagcgagctgcacggcttcgaggccgccgccctgagagacgagggcgaggaggaggccgaggtggagctggccgagagcggcagaagactgagactgcccagagaccagatccagagaatgaacccccccaagttcagcaaggccgaggacatggccgagctgacctgcctgaacgaggccagcgtgctgcacaacctgagagagagatactacagcggcctgatctacacctacagcggcctgttctgcgtggtgatcaacccctacaagcagctgcccatctacaccgaggccatcgtggagatgtacagaggcaagaagagacacgaggtgcccccccacgtgtacgccgtgaccgagggcgcctacagaagcatgctgcaggacagagaggaccagagcatcctgtgcaccggcgagagcggcgccggcaagaccgagaacaccaagaaggtgatccagtacctggcccacgtggccagcagccccaagggcagaaaggagcccggcgtgcccgccagcgtgagcaccgtgagctacggcgagctggagagacagctgctgcaggccaaccccatcctggaggccttcggcaacgccaagaccgtgaagaacgacaacagcagcagattcggcaagttcatcagaatcaacttcgacgtggccggctacatcgtgggcgccaacatcgagacctacctgctggagaagagcagagccatcagacaggccaaggacgagtgcagcttccacatcttctaccagctgctgggcggcgccggcgagcagctgaaggccgacctgctgctggagccctgcagccactacagattcctgaccaacggccccagcagcagccccggccaggagagagagctgttccaggagaccctggagagcctgagagtgctgggcttcagccacgaggagatcatcagcatgctgagaatggtgagcgccgtgctgcagttcggcaacatcgccctgaagagagagagaaacaccgaccaggccaccatgcccgacaacaccgccgcccagaagctgtgcagactgctgggcctgggcgtgaccgacttcagcagagccctgctgacccccagaatcaaggtgggcagagactacgtgcagaaggcccagaccaaggagcaggccgacttcgccctggaggccctggccaaggccacctacgagagactgttcagatggctggtgctgagactgaacagagccctggacagaagccccagacagggcgccagcttcctgggcatcctggacatcgccggcttcgagatcttccagctgaacagcttcgagcagctgtgcatcaactacaccaacgagaagctgcagcagctgttcaaccacaccatgttcgtgctggagcaggaggagtaccagagagagggcatcccctggaccttcctggacttcggcctggacctgcagccctgcatcgacctgatcgagagacccgccaacccccccggcctgctggccctgctggacgaggagtgctggttccccaaggccaccgacaagagcttcgtggagaaggtggcccaggagcagggcggccaccccaagttccagagacccagacacctgagagaccaggccgacttcagcgtgctgcactacgccggcaaggtggactacaaggccaacgagtggctgatgaagaacatggaccccctgaacgacaacgtggccgccctgctgcaccagagcaccgacagactgaccgccgagatctggaaggacgtggagggcatcgtgggcctggagcaggtgagcagcctgggcgacggcccccccggcggcagacccagaagaggcatgttcagaaccgtgggccagctgtacaaggagagcctgagcagactgatggccaccctgagcaacaccaaccccagcttcgtgagatgcatcgtgcccaaccacgagaagagagccggcaagctggagcccagactggtgctggaccagctgagatgcaacggcgtgctggagggcatcagaatctgcagacagggcttccccaacagaatcctgttccaggagttcagacagagatacgagatcctgacccccaacgccatccccaagggcttcatggacggcaagcaggcctgcgagaagatgatccaggccctggagctggaccccaacctgtacagagtgggccagagcaagatcttcttcagagccggcgtgctggcccagctggaggaggagagagacctgaaggtgaccgacatcatcgtgagcttccaggccgccgccagaggctacctggccagaagagccttccagaagagacagcagcagcagagcgccctgagagtgatgcagagaaactgcgccgcctacctgaagctgagacactggcagtggtggagactgttcaccaaggtgaagcccctgctgcaggtgaccagacaggacgaggtgctgcaggccagagcccaggagctgcagaaggtgcaggagctgcagcagcagagcgccagagaggtgggcgagctgcagggcagagtggcccagctggaggaggagagagccagactggccgagcagctgagagccgaggccgagctgtgcgccgaggccgaggagaccagaggcagactggccgccagaaagcaggagctggagctggtggtgagcgagctggaggccagagtgggcgaggaggaggagtgcagcagacagatgcagaccgagaagaagagactgcagcagcacatccaggagctggaggcccacctggaggccgaggagggcgccagacagaagctgcagctggagaaggtgaccaccgaggccaagatgaagaagttcgaggaggacctgctgctgctggaggaccagaacagcaagctgagcaaggagagaaagctgctggaggacagactggccgagttcagcagccaggccgccgaggaggaggagaaggtgaagagcctgaacaagctgagactgaagtacgaggccaccatcgccgacatggaggacagactgagaaaggaggagaagggcagacaggagctggagaagctgaagagaagactggacggcgagagcagcgagctgcaggagcagatggtggagcagcagcagagagccgaggagctgagagcccagctgggcagaaaggaggaggagctgcaggccgccctggccagagccgaggacgagggcggcgccagagcccagctgctgaagagcctgagagaggcccaggccgccctggccgaggcccaggaggacctggagagcgagagagtggccagaaccaaggccgagaagcagagaagagacctgggcgaggagctggaggccctgagaggcgagctggaggacaccctggacagcaccaacgcccagcaggagctgagaagcaagagagagcaggaggtgaccgagctgaagaagaccctggaggaggagaccagaatccacgaggccgccgtgcaggagctgagacagagacacggccaggccctgggcgagctggccgagcagctggagcaggccagaagaggcaagggcgcctgggagaagaccagactggccctggaggccgaggtgagcgagctgagagccgagctgagcagcctgcagaccgccagacaggagggcgagcagagaagaagaagactggagctgcagctgcaggaggtgcagggcagagccggcgacggcgagagagccagagccgaggccgccgagaagctgcagagagcccaggccgagctggagaacgtgagcggcgccctgaacgaggccgagagcaagaccatcagactgagcaaggagctgagcagcaccgaggcccagctgcacgacgcccaggagctgctgcaggaggagaccagagccaagctggccctgggcagcagagtgagagccatggaggccgaggccgccggcctgagagagcagctggaggaggaggccgccgccagagagagagccggcagagagctgcagaccgcccaggcccagctgagcgagtggagaagaagacaggaggaggaggccggcgccctggaggccggcgaggaggccagaagaagagccgccagagaggccgaggccctgacccagagactggccgagaagaccgagaccgtggacagactggagagaggcagaagaagactgcagcaggagctggacgacgccaccatggacctggagcagcagagacagctggtgagcaccctggagaagaagcagagaaagttcgaccagctgctggccgaggagaaggccgccgtgctgagagccgtggaggagagagagagagccgaggccgagggcagagagagagaggccagagccctgagcctgaccagagccctggaggaggagcaggaggccagagaggagctggagagacagaacagagccctgagagccgagctggaggccctgctgagcagcaaggacgacgtgggcaagagcgtgcacgagctggagagagcctgcagagtggccgagcaggccgccaacgacctgagagcccaggtgaccgagctggaggacgagctgaccgccgccgaggacgccaagctgagactggaggtgaccgtgcaggccctgaagacccagcacgagagagacctgcagggcagagacgaggccggcgaggagagaagaagacagctggccaagcagctgagagacgccgaggtggagagagacgaggagagaaagcagagaaccctggccgtggccgccagaaagaagctggagggcgagctggaggagctgaaggcccagatggccagcgccggccagggcaaggaggaggccgtgaagcagctgagaaagatgcaggcccagatgaaggagctgtggagagaggtggaggagaccagaaccagcagagaggagatcttcagccagaacagagagagcgagaagagactgaagggcctggaggccgaggtgctgagactgcaggaggagctggccgccagcgacagagccagaagacaggcccagcaggacagagacgagatggccgacgaggtggccaacggcaacctgagcaaggccgccatcctggaggagaagagacagctggagggcagactgggccagctggaggaggagctggaggaggagcagagcaacagcgagctgctgaacgacagatacagaaagctgctgctgcaggtggagagcctgaccaccgagctgagcgccgagagaagcttcagcgccaaggccgagagcggcagacagcagctggagagacagatccaggagctgagaggcagactgggcgaggaggacgccggcgccagagccagacacaagatgaccatcgccgccctggagagcaagctggcccaggccgaggagcagctggagcaggagaccagagagagaatcctgagcggcaagctggtgagaagagccgagaagagactgaaggaggtggtgctgcaggtggaggaggagagaagagtggccgaccagctgagagaccagctggagaagggcaacctgagagtgaagcagctgaagagacagctggaggaggccgaggaggaggccagcagagcccaggccggcagaagaagactgcagagagagctggaggacgtgaccgagagcgccgagagcatgaacagagaggtgaccaccctgagaaacagactgagaagaggccccctgaccttcaccaccagaaccgtgagacaggtgttcagactggaggagggcgtggccagcgacgaggaggccgaggaggcccagcccggcagcggccccagccccgagcccgagggcagcccccccgcccacccccagtag

SEQ ID NO: 90108 - DNA, 6111 bp, Artificial Sequence
  Description of Artificial Sequence: Synthetic coding sequence
atggccgccgtgaccatgagcgtgcccggcagaaaggccccccccagacccggccccgtgcccgaggccgcccagcccttcctgttcacccccagaggccccagcgccggcggcggccccggcagcggcaccagcccccaggtggagtggaccgccagaagactggtgtgggtgcccagcgagctgcacggcttcgaggccgccgccctgagagacgagggcgaggaggaggccgaggtggagctggccgagagcggcagaagactgagactgcccagagaccagatccagagaatgaacccccccaagttcagcaaggccgaggacatggccgagctgacctgcctgaacgaggccagcgtgctgcacaacctgagagagagatactacagcggcctgatctacacctacagcggcctgttctgcgtggtgatcaacccctacaagcagctgcccatctacaccgaggccatcgtggagatgtacagaggcaagaagagacacgaggtgcccccccacgtgtacgccgtgaccgagggcgcctacagaagcatgctgcaggacagagaggaccagagcatcctgtgcaccggcgagagcggcgccggcaagaccgagaacaccaagaaggtgatccagtacctggcccacgtggccagcagccccaagggcagaaaggagcccggcgtgcccgtgagcaaccccgccctgggctggggcgagctggagagacagctgctgcaggccaaccccatcctggaggccttcggcaacgccaagaccgtgaagaacgacaacagcagcagattcggcaagttcatcagaatcaacttcgacgtggccggctacatcgtgggcgccaacatcgagacctacctgctggagaagagcagagccatcagacaggccaaggacgagtgcagcttccacatcttctaccagctgctgggcggcgccggcgagcagctgaaggccgacctgctgctggagccctgcagccactacagattcctgaccaacggccccagcagcagccccggccaggagagagagctgttccaggagaccctggagagcctgagagtgctgggcttcagccacgaggagatcatcagcatgctgagaatggtgagcgccgtgctgcagttcggcaacatcgccctgaagagagagagaaacaccgaccaggccaccatgcccgacaacaccgccgcccagaagctgtgcagactgctgggcctgggcgtgaccgacttcagcagagccctgctgacccccagaatcaaggtgggcagagactacgtgcagaaggcccagaccaaggagcaggccgacttcgccctggaggccctggccaaggccacctacgagagactgttcagatggctggtgctgagactgaacagagccctggacagaagccccagacagggcgccagcttcctgggcatcctggacatcgccggcttcgagatcttccagctgaacagcttcgagcagctgtgcatcaactacaccaacgagaagctgcagcagctgttcaaccacaccatgttcgtgctggagcaggaggagtaccagagagagggcatcccctggaccttcctggacttcggcctggacctgcagccctgcatcgacctgatcgagagacccgccaacccccccggcctgctggccctgctggacgaggagtgctggttccccaaggccaccgacaagagcttcgtggagaaggtggcccaggagcagggcggccaccccaagttccagagacccagacacctgagagaccaggccgacttcagcgtgctgcactacgccggcaaggtggactacaaggccaacgagtggctgatgaagaacatggaccccctgaacgacaacgtggccgccctgctgcaccagagcaccgacagactgaccgccgagatctggaaggacgagcacggcggcttccagcagttcagcttcctgggcagcttcccccccagcccccccggcagcgccgagagatgcagcagcgccatcagcccccccggcgtggagggcatcgtgggcctggagcaggtgagcagcctgggcgacggcccccccggcggcagacccagaagaggcatgttcagaaccgtgggccagctgtacaaggagagcctgagcagactgatggccaccctgagcaacaccaaccccagcttcgtgagatgcatcgtgcccaaccacgagaagagagccggcaagctggagcccagactggtgctggaccagctgagatgcaacggcgtgctggagggcatcagaatctgcagacagggcttccccaacagaatcctgttccaggagttcagacagagatacgagatcctgacccccaacgccatccccaagggcttcatggacggcaagcaggcctgcgagaagatgatccaggccctggagctggaccccaacctgtacagagtgggccagagcaagatcttcttcagagccggcgtgctggcccagctggaggaggagagagacctgaaggtgaccgacatcatcgtgagcttccaggccgccgccagaggctacctggccagaagagccttccagaagagacagcagcagcagagcgccctgagagtgatgcagagaaactgcgccgcctacctgaagctgagacactggcagtggtggagactgttcaccaaggtgaagcccctgctgcaggtgaccagacaggacgaggtgctgcaggccagagcccaggagctgcagaaggtgcaggagctgcagcagcagagcgccagagaggtgggcgagctgcagggcagagtggcccagctggaggaggagagagccagactggccgagcagctgagagccgaggccgagctgtgcgccgaggccgaggagaccagaggcagactggccgccagaaagcaggagctggagctggtggtgagcgagctggaggccagagtgggcgaggaggaggagtgcagcagacagatgcagaccgagaagaagagactgcagcagcacatccaggagctggaggcccacctggaggccgaggagggcgccagacagaagctgcagctggagaaggtgaccaccgaggccaagatgaagaagttcgaggaggacctgctgctgctggaggaccagaacagcaagctgagcaaggagagaaagctgctggaggacagactggccgagttcagcagccaggccgccgaggaggaggagaaggtgaagagcctgaacaagctgagactgaagtacgaggccaccatcgccgacatggaggacagactgagaaaggaggagaagggcagacaggagctggagaagctgaagagaagactggacggcgagagcagcgagctgcaggagcagatggtggagcagcagcagagagccgaggagctgagagcccagctgggcagaaaggaggaggagctgcaggccgccctggccagagccgaggacgagggcggcgccagagcccagctgctgaagagcctgagagaggcccaggccgccctggccgaggcccaggaggacctggagagcgagagagtggccagaaccaaggccgagaagcagagaagagacctgggcgaggagctggaggccctgagaggcgagctggaggacaccctggacagcaccaacgcccagcaggagctgagaagcaagagagagcaggaggtgaccgagctgaagaagaccctggaggaggagaccagaatccacgaggccgccgtgcaggagctgagacagagacacggccaggccctgggcgagctggccgagcagctggagcaggccagaagaggcaagggcgcctgggagaagaccagactggccctggaggccgaggtgagcgagctgagagccgagctgagcagcctgcagaccgccagacaggagggcgagcagagaagaagaagactggagctgcagctgcaggaggtgcagggcagagccggcgacggcgagagagccagagccgaggccgccgagaagctgcagagagcccaggccgagctggagaacgtgagcggcgccctgaacgaggccgagagcaagaccatcagactgagcaaggagctgagcagcaccgaggcccagctgcacgacgcccaggagctgctgcaggaggagaccagagccaagctggccctgggcagcagagtgagagccatggaggccgaggccgccggcctgagagagcagctggaggaggaggccgccgccagagagagagccggcagagagctgcagaccgcccaggcccagctgagcgagtggagaagaagacaggaggaggaggccggcgccctggaggccggcgaggaggccagaagaagagccgccagagaggccgaggccctgacccagagactggccgagaagaccgagaccgtggacagactggagagaggcagaagaagactgcagcaggagctggacgacgccaccatggacctggagcagcagagacagctggtgagcaccctggagaagaagcagagaaagttcgaccagctgctggccgaggagaaggccgccgtgctgagagccgtggaggagagagagagagccgaggccgagggcagagagagagaggccagagccctgagcctgaccagagccctggaggaggagcaggaggccagagaggagctggagagacagaacagagccctgagagccgagctggaggccctgctgagcagcaaggacgacgtgggcaagagcgtgcacgagctggagagagcctgcagagtggccgagcaggccgccaacgacctgagagcccaggtgaccgagctggaggacgagctgaccgccgccgaggacgccaagctgagactggaggtgaccgtgcaggccctgaagacccagcacgagagagacctgcagggcagagacgaggccggcgaggagagaagaagacagctggccaagcagctgagagacgccgaggtggagagagacgaggagagaaagcagagaaccctggccgtggccgccagaaagaagctggagggcgagctggaggagctgaaggcccagatggccagcgccggccagggcaaggaggaggccgtgaagcagctgagaaagatgcaggcccagatgaaggagctgtggagagaggtggaggagaccagaaccagcagagaggagatcttcagccagaacagagagagcgagaagagactgaagggcctggaggccgaggtgctgagactgcaggaggagctggccgccagcgacagagccagaagacaggcccagcaggacagagacgagatggccgacgaggtggccaacggcaacctgagcaaggccgccatcctggaggagaagagacagctggagggcagactgggccagctggaggaggagctggaggaggagcagagcaacagcgagctgctgaacgacagatacagaaagctgctgctgcaggtggagagcctgaccaccgagctgagcgccgagagaagcttcagcgccaaggccgagagcggcagacagcagctggagagacagatccaggagctgagaggcagactgggcgaggaggacgccggcgccagagccagacacaagatgaccatcgccgccctggagagcaagctggcccaggccgaggagcagctggagcaggagaccagagagagaatcctgagcggcaagctggtgagaagagccgagaagagactgaaggaggtggtgctgcaggtggaggaggagagaagagtggccgaccagctgagagaccagctggagaagggcaacctgagagtgaagcagctgaagagacagctggaggaggccgaggaggaggccagcagagcccaggccggcagaagaagactgcagagagagctggaggacgtgaccgagagcgccgagagcatgaacagagaggtgaccaccctgagaaacagactgagaagaggccccctgaccttcaccaccagaaccgtgagacaggtgttcagactggaggagggcgtggccagcgacgaggaggccgaggaggcccagcccggcagcggccccagccccgagcccgagggcagcccccccgcccacccccagtag

SEQ ID NO: 90109 - DNA, 5841 bp, Artificial Sequence
  Description of Artificial Sequence: Synthetic coding sequence
atggtggagagctgcctgctgaccttcagagccttcttctggtggatcgccctgatcaagatggacctgagcgacctgggcgaggccgccgccttcctgagaagaagcgaggccgagctgctgctgctgcaggccaccgccctggacggcaagaagaagtgctggatccccgacggcgagaacgcctacatcgaggccgaggtgaagggcagcgaggacgacggcaccgtgatcgtggagaccgccgacggcgagagcctgagcatcaaggaggacaagatccagcagatgaacccccccgagttcgagatgatcgaggacatggccatgctgacccacctgaacgaggccagcgtgctgcacaccctgaagagaagatacggccagtggatgatctacacctacagcggcctgttctgcgtgaccatcaacccctacaagtggctgcccgtgtaccagaaggaggtgatggccgcctacaagggcaagagaagaagcgaggcccccccccacatcttcgccgtggccaacaacgccttccaggacatgctgcacaacagagagaaccagagcatcctgttcaccggcgagagcggcgccggcaagaccgtgaacagcaagcacatcatccagtacttcgccaccatcgccgccatgatcgagagcagaaagaagcagggcgccctggaggaccagatcatgcaggccaacaccatcctggaggccttcggcaacgccaagaccctgagaaacgacaacagcagcagattcggcaagttcatcagaatgcacttcggcgccagaggcatgctgagcagcgtggacatcgacatctacctgctggagaagagcagagtgatcttccagcaggccggcgagagaaactaccacatcttctaccagatcctgagcggccagaaggagctgcacgacctgctgctggtgagcgccaaccccagcgacttccacttctgcagctgcggcgccgtgaccgtggagagcctggacgacgccgaggagctgctggccaccgagcaggccatggacatcctgggcttcctgcccgacgagaagtacggctgctacaagctgaccggcgccatcatgcacttcggcaacatgaagttcaagcagaagcccagagaggagcagctggaggccgacggcaccgagaacgccgacaaggccgccttcctgatgggcatcaacagcagcgagctggtgaagtgcctgatccaccccagaatcaaggtgggcaacgagtacgtgaccagaggccagaccatcgagcaggtgacctgcgccgtgggcgccctgagcaagagcatgtacgagagaatgttcaagtggctggtggccagaatcaacagagccctggacgccaagctgagcagacagttcttcatcggcatcctggacatcaccggcttcgagatcctggagtacaacagcctggagcagctgtgcatcaacttcaccaacgagaagctgcagcagttcttcaactggcacatgttcgtgctggagcaggaggagtacaagaaggagagcatcgagtgggtgagcatcggcttcggcctggacctgcaggcctgcatcgacctgatcgagaagcccatgggcatcctgagcatcctggaggaggagtgcatgttccccaaggccaccgacctgaccttcaagaccaagctgttcgacaaccacttcggcaagagcgtgcacctgcagaagcccaagcccgacaagaagaagttcgaggcccacttcgagctggtgcactacgccggcgtggtgccctacaacatcagcggctggctggagaagaacaaggacctgctgaacgagaccgtggtggccgtgttccagaagagcagcaacagactgctggccagcctgttcgagaactacatgagcaccgacagcgccatccccttcggcgagaagaagagaaagaagggcgccagcttccagaccgtggccagcctgcacaaggagaacctgaacaagctgatgaccaacctgaagagcaccgccccccacttcgtgagatgcatcaaccccaacgtgaacaagatccccggcatcctggacccctacctggtgctgcagcagctgagatgcaacggcgtgctggagggcaccagaatctgcagagagggcttccccaacagactgcagtacgccgacttcaagcagagatactgcatcctgaaccccagaaccttccccaagagcaagttcgtgagcagcagaaaggccgccgaggagctgctgggcagcctggagatcgaccacacccagtacagattcggcatcaccaaggtgttcttcaaggccggcttcctgggccagctggaggccatcagagacgagagactgagcaaggtgttcaccctgttccaggccagagcccagggcaagctgatgagaatcaagttccagaagatcctggaggagagagacgccctgatcctgatccagtggaacatcagagccttcatggccgtgaagaactggccctggatgagactgttcttcaagatcaagcccctggtgaagagcagcgaggtgggcgaggaggtggccggcctgaaggaggagtgcgcccagctgcagaaggccctggagaagagcgagttccagagagaggagctgaaggccaagcaggtgagcctgacccaggagaagaacgacctgatcctgcagctgcaggccgagcaggagaccctggccaacgtggaggagcagtgcgagtggctgatcaagagcaagatccagctggaggccagagtgaaggagctgagcgagagagtggaggaggaggaggagatcaacagcgagctgaccgccagaggcagaaagctggaggacgagtgcttcgagctgaagaaggagatcgacgacctggagaccatgctggtgaagagcgagaaggagaagagaaccaccgagcacaaggtgaagaacctgaccgaggaggtggagttcctgaacgaggacatcagcaagctgaacagagccgccaaggtggtgcaggaggcccaccagcagaccctggacgacctgcacatggaggaggagaagctgagcagcctgagcaaggccaacctgaagctggagcagcaggtggacgagctggagggcgccctggagcaggagagaaaggccagaatgaactgcgagagagagctgcacaagctggagggcaacctgaagctgaacagagagagcatggagaacctggagagcagccagagacacctggccgaggagctgagaaagaaggagctggagctgagccagatgaacagcaaggtggagaacgagaagggcctggtggcccagctgcagaagaccgtgaaggagctgcagacccagatcaaggacctgaaggagaagctggaggccgagagaaccaccagagccaagatggagagagagagagccgacctgacccaggacctggccgacctgaacgagagactggaggaggtgggcggcagcagcctggcccagctggagatcaccaagaagcaggagaccaagttccagaagctgcacagagacatggaggaggccaccctgcacttcgagaccaccagcgccagcctgaagaagagacacgccgacagcctggccgagctggagggccaggtggagaacctgcagcaggtgaagcagaagctggagaaggacaagagcgacctgcagctggaggtggacgacctgctgaccagagtggagcagatgaccagagccaaggccaacgccgagaagctgtgcaccctgtacgaggagagactgcacgaggccaccgccaagctggacaaggtgacccagctggccaacgacctggccgcccagaagaccaagctgtggagcgagagcggcgagttcctgagaagactggaggagaaggaggccctgatcaaccagctgagcagagagaagagcaacttcaccagacagatcgaggacctgagaggccagctggagaaggagaccaagagccagagcgccctggcccacgccctgcagaaggcccagagagactgcgacctgctgagagagcagtacgaggaggagcaggaggtgaaggccgagctgcacagaaccctgagcaaggtgaacgccgagatggtgcagtggagaatgaagtacgagaacaacgtgatccagagaaccgaggacctggaggacgccaagaaggagctggccatcagactgcaggaggccgccgaggccatgggcgtggccaacgccagaaacgccagcctggagagagccagacaccagctgcagctggagctgggcgacgccctgagcgacctgggcaaggtgagaagcgccgccgccagactggaccagaagcagctgcagagcggcaaggccctggccgactggaagcagaagcacgaggagagccaggccctgctggacgccagccagaaggaggtgcaggccctgagcaccgagctgctgaagctgaagaacacctacgaggagagcatcgtgggccaggagaccctgagaagagagaacaagaacctgcaggaggagatcagcaacctgaccaaccaggtgagagagggcaccaagaacctgaccgagatggagaaggtgaagaagctgatcgaggaggagaagaccgaggtgcaggtgaccctggaggagaccgagggcgccctggagagaaacgagagcaagatcctgcacttccagctggagctgctggaggccaaggccgagctggagagaaagctgagcgagaaggacgaggagatcgagaacttcagaagaaagcagcagtgcaccatcgacagcctgcagagcagcctggacagcgaggccaagagcagaatcgaggtgaccagactgaagaagaagatggaggaggacctgaacgagatggagctgcagctgagctgcgccaacagacaggtgagcgaggccaccaagagcctgggccagctgcagatccagatcaaggacctgcagatgcagctggacgacagcacccagctgaacagcgacctgaaggagcaggtggccgtggccgagagaagaaacagcctgctgcagagcgagctggaggacctgagaagcctgcaggagcagaccgagagaggcagaagactgagcgaggaggagctgctggaggccaccgagagaatcaacctgttctacacccagaacaccagcctgctgagccagaagaagaagctggaggccgacgtggccagaatgcagaaggaggccgaggaggtggtgcaggagtgccagaacgccgaggagaaggccaagaaggccgccatcgaggccgccaacctgagcgaggagctgaagaagaagcaggacaccatcgcccacctggagagaaccagagagaacatggagcagaccatcaccgacctgcagaagagactggccgaggccgagcagatggccctgatgggcagcagaaagcagatccagaagctggagagcagagtgagagagctggagggcgagctggagggcgagatcagaagaagcgccgaggcccagagaggcgccagaagactggagagatgcatcaaggagctgacctaccaggccgaggaggacaagaagaacctgagcagaatgcagacccagatggacaagctgcagctgaaggtgcagaactacaagcagcaggtggaggtggccgagacccaggccaaccagtacctgagcaagtacaagaagcagcagcacgagctgaacgaggtgaaggagagagccgaggtggccgagagccaggtgaacaagctgaagatcaaggccagagagttcggcaagaaggtgcaggaggagtag

SEQ ID NO: 90110 - DNA, 5826 bp, Artificial Sequence
  Description of Artificial Sequence: Synthetic coding sequence
atgagcagcgacagcgagctggccgtgttcggcgaggccgcccccttcctgagaaagagcgagagagagagaatcgaggcccagaacagacccttcgacgccaagaccagcgtgttcgtggccgagcccaaggagagcttcgtgaagggcaccatccagagcagagagggcggcaaggtgaccgtgaagaccgagggcggcgccaccctgaccgtgaaggacgaccaggtgttccccatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaagcccgaggtggtgaccgcctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgtgaccggcgagaagaagaaggaggagatcaccagcggcaagatccagggcaccctggaggaccagatcatcagcgccaaccccctgctggaggccttcggcaacgccaagaccgtgagaaacgacaacagcagcagattcggcaagttcatcagaatccacttcggcaccaccggcaagctggccagcgccgacatcgagacctacctgctggagaagagcagagtggtgttccagctgaaggccgagagaagctaccacatcttctaccagatcaccagcaacaagaagcccgagctgatcgagatgctgctgatcaccaccaacccctacgactaccccttcgtgagccagggcgagatcagcgtggccagcatcgacgaccaggaggagctgatggccaccgacagcgccatcgacatcctgggcttcaccaacgaggagaaggtgagcatctacaagctgaccggcgccgtgatgcactacggcaacctgaagttcaagcagaagcagagagaggagcaggccgagcccgacggcaccgaggtggccgacaaggccgcctacctgcagagcctgaacagcgccgacctgctgaaggccctgtgctaccccagagtgaaggtgggcaacgagtacgtgaccaagggccagaccgtggagcaggtgagcaacgccgtgggcgccctggccaaggccgtgtacgagaagatgttcctgtggatggtggccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtggaccttcatcgacttcggcatggacctggccgcctgcatcgagctgatcgagaagcccatgggcatcttcagcatcctggaggaggagtgcatgttccccaaggccaccgacaccagcttcaagaacaagctgtacgaccagcacctgggcaagagcgccaacttccagaagcccaaggtggtgaagggcaaggccgaggcccacttcgccctgatccactacgccggcgtggtggactacaacatcaccggctggctggagaagaacaaggaccccctgaacgagaccgtggtgggcctgtaccagaagagcgccatgaagaccctggcccagctgttcagcggcgcccagaccgccgagggcgagggcgccggcggcggcgccaagaagggcggcaagaagaagggcagcagcttccagaccgtgagcgccctgttcagagagaacctgaacaagctgatgaccaacctgagaagcacccacccccacttcgtgagatgcatcatccccaacgagaccaagacccccggcgccatggagcacgagctggtgctgcaccagctgagatgcaacggcgtgctggagggcatcagaatctgcagaaagggcttccccagcagaatcctgtacgccgacttcaagcagagatacaaggtgctgaacgccagcgccatccccgagggccagttcatcgacagcaagaaggccagcgagaagctgctggccagcatcgacatcgaccacacccagtacaagttcggccacaccaaggtgttcttcaaggccggcctgctgggcctgctggaggagatgagagacgacaagctggcccagctgatcaccagaacccaggccagatgcagaggcttcctggccagagtggagtaccagagaatggtggagagaagagaggccatcttctgcatccagtacaacatcagaagcttcatgaacgtgaagcactggccctggatgaagctgttcttcaagatcaagcccctgctgaagagcgccgagaccgagaaggagatggccaccatgaaggaggagttccagaagatcaaggacgagctggccaagagcgaggccaagagaaaggagctggaggagaagatggtgaccctgctgaaggagaagaacgacctgcagctgcaggtgcaggccgaggccgagggcctggccgacgccgaggagagatgcgaccagctgatcaagaccaagatccagctggaggccaagatcaaggaggtgaccgagagagccgaggacgaggaggagatcaacgccgagctgaccgccaagaagagaaagctggaggacgagtgcagcgagctgaagaaggacatcgacgacctggagctgaccctggccaaggtggagaaggagaagcacgccaccgagaacaaggtgaagaacctgaccgaggagatggccggcctggacgagaccatcgccaagctgaccaaggagaagaaggccctgcaggaggcccaccagcagaccctggacgacctgcaggccgaggaggacaaggtgaacaccctgaccaaggccaagatcaagctggagcagcaggtggacgacctggagggcagcctggagcaggagaagaagctgagaatggacctggagagagccaagagaaagctggagggcgacctgaagctggcccaggagagcatcatggacatcgagaacgagaagcagcagctggacgagaagctgaagaagaaggagttcgagatcagcaacctgcagagcaagatcgaggacgagcaggccctgggcatccagctgcagaagaagatcaaggagctgcaggccagaatcgaggagctggaggaggagatcgaggccgagagagccagcagagccaaggccgagaagcagagaagcgacctgagcagagagctggaggagatcagcgagagactggaggaggccggcggcgccaccagcgcccagatcgagatgaacaagaagagagaggccgagttccagaagatgagaagagacctggaggaggccaccctgcagcacgaggccaccgccgccaccctgagaaagaagcacgccgacagcgtggccgagctgggcgagcagatcgacaacctgcagagagtgaagcagaagctggagaaggagaagagcgagatgaagatggagatcgacgacctggccagcaacgtggagaccgtgagcaaggccaagggcaacctggagaagatgtgcagaaccctggaggaccagctgagcgagctgaagagcaaggaggaggagcagcagagactgatcaacgacctgaccgcccagagaggcagactgcagaccgagagcggcgagttcagcagacagctggacgagaaggaggccctggtgagccagctgagcagaggcaagcaggccttcacccagcagatcgaggagctgaagagacagctggaggaggagatcaaggccaagaacgccctggcccacgccctgcagagcagcagacacgactgcgacctgctgagagagcagtacgaggaggagcaggagagcaaggccgagctgcagagagccctgagcaaggccaacaccgaggtggcccagtggagaaccaagtacgagaccgacgccatccagagaaccgaggagctggaggaggccaagaagaagctggcccagagactgcaggccgccgaggagcacgtggaggccgtgaacgccaagtgcgccagcctggagaagaccaagcagagactgcagaacgaggtggaggacctgatgctggacgtggagagaaccaacgccgcctgcgccgccctggacaagaagcagagaaacttcgacaagatcctggccgagtggaagcagaagtgcgaggagacccacgccgagctggaggccagccagaaggaggccagaagcctgggcaccgagctgttcaagatcaagaacgcctacgaggagagcctggaccagctggagaccctgaagagagagaacaagaacctgcagcaggagatcagcgacctgaccgagcagatcgccgagggcggcaagagaatccacgagctggagaagatcaagaagcaggtggagcaggagaagtgcgagctgcaggccgccctggaggaggccgaggccagcctggagcacgaggagggcaagatcctgagaatccagctggagctgaaccaggtgaagagcgaggtggacagaaagatcgccgagaaggacgaggagatcgaccagctgaagagaaaccacatcagaatcgtggagagcatgcagagcaccctggacgccgagatcagaagcagaaacgacgccatcagactgaagaagaagatggagggcgacctgaacgagatggagatccagctgaaccacgccaacagaatggccgccgaggccctgagaaactacagaaacacccagggcatcctgaaggacacccagatccacctggacgacgccctgagaagccaggaggacctgaaggagcagctggccatggtggagagaagagccaacctgctgcaggccgagatcgaggagctgagagccaccctggagcagaccgagagaagcagaaagatcgccgagcaggagctgctggacgccagcgagagagtgcagctgctgcacacccagaacaccagcctgatcaacaccaagaagaagctggagaccgacatcagccagatgcagggcgagatggaggacatcctgcaggaggccagaaacgccgaggagaaggccaagaaggccatcaccgacgccgccatgatggccgaggagctgaagaaggagcaggacaccagcgcccacctggagagaatgaagaagaacatggagcagaccgtgaaggacctgcagctgagactggacgaggccgagcagctggccctgaagggcggcaagaagcagatccagaagctggaggccagagtgagagagctggagggcgaggtggagagcgagcagaagagaaacgccgaggccgtgaagggcctgagaaagcacgagagaagagtgaaggagctgacctaccagaccgaggaggacagaaagaacatcctgagactgcaggacctggtggacaagctgcaggccaaggtgaagagctacaagagacaggccgaggaggccgaggagcagagcaacaccaacctggccaagttcagaaagctgcagcacgagctggaggaggccgaggagagagccgacatcgccgagagccaggtgaacaagctgagagtgaagagcagagaggtgcacaccaaggtgatcagcgaggagtag

SEQ ID NO: 90111 - DNA, 5826 bp, Artificial Sequence; identical to SEQ ID NO: 90110
  Description of Artificial Sequence: Synthetic coding sequence

SEQ ID NO: 90112 - DNA, 549 bp, Artificial Sequence
  Description of Artificial Sequence: Synthetic coding sequence
atgagcagcgacagcgagctggccgtgttcggcgaggccgcccccttcctgagaaagagcgagagagagagaatcgaggcccagaacagacccttcgacgccaagaccagcgtgttcgtggccgagcccaaggagagcttcgtgaagggcaccatccagagcagagagggcggcaaggtgaccgtgaagaccgagggcggcgccaccctgaccgtgaaggacgaccaggtgttccccatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaagcccgaggtggtgaccgcctacagaggcaagaagagacaggaggcccccccccacatcttcagcatcagcgacaacgcctaccagttcatgctgaccgacagagagaaccagagcatcctgatcaccggcgagagcggctag

SEQ ID NO: 90113 - DNA, 405 bp, Artificial Sequence
  Description of Artificial Sequence: Synthetic coding sequence
atgagcagcgacagcgagctggccgtgttcggcgaggccgcccccttcctgagaaagagcgagagagagagaatcgaggcccagaacagacccttcgacgccaagaccagcgtgttcgtggccgagcccaaggagagcttcgtgaagggcaccatccagagcagagagggcggcaaggtgaccgtgaagaccgagggcggcgccaccctgaccgtgaaggacgaccaggtgttccccatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtag

SEQ ID NO: 90114 - DNA, 2127 bp, Artificial Sequence
  Description of Artificial Sequence: Synthetic coding sequence
atgagcagcgacagcgagctggccgtgttcggcgaggccgcccccttcctgagaaagagcgagagagagagaatcgaggcccagaacagacccttcgacgccaagaccagcgtgttcgtggccgagcccaaggagagcttcgtgaagggcaccatccagagcagagagggcggcaaggtgaccgtgaagaccgagggcggcgccaccctgaccgtgaaggacgaccaggtgttccccatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaagcccgaggtggtgaccgcctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgtgaccggcgagaagaagaaggaggagatcaccagcggcaagatccagggcaccctggaggaccagatcatcagcgccaaccccctgctggaggccttcggcaacgccaagaccgtgagaaacgacaacagcagcagattcggcaagttcatcagaatccacttcggcaccaccggcaagctggccagcgccgacatcgagacctacctgctggagaagagcagagtggtgttccagctgaaggccgagagaagctaccacatcttctaccagatcaccagcaacaagaagcccgagctgatcgagatgctgctgatcaccaccaacccctacgactaccccttcgtgagccagggcgagatcagcgtggccagcatcgacgaccaggaggagctgatggccaccgacagcgccatcgacatcctgggcttcaccaacgaggagaaggtgagcatctacaagctgaccggcgccgtgatgcactacggcaacctgaagttcaagcagaagcagagagaggagcaggccgagcccgacggcaccgaggtggccgacaaggccgcctacctgcagagcctgaacagcgccgacctgctgaaggccctgtgctaccccagagtgaaggtgggcaacgagtacgtgaccaagggccagaccgtggagcaggtgagcaacgccgtgggcgccctggccaaggccgtgtacgagaagatgttcctgtggatggtggccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtggaccttcatcgacttcggcatggacctggccgcctgcatcgagctgatcgagaagcccatgggcatcttcagcatcctggaggaggagtgcatgttccccaaggccaccgacaccagcttcaagaacaagctgtacgaccagcacctgggcaagagcgccaacttccagaagcccaaggtggtgaagggcaaggccgaggcccacttcgccctgatccactacgccggcgtggtggactacaacatcaccggctggctggagaagaacaaggaccccctgaacgagaccgtggtgggcctgtaccagaagagcgccatgaagaccctggcccagctgttcagcggcgcccagaccgccgagggcgagggcgccggcggcggcgccaagaagggcggcaagaagaagggcagcagcttccagaccgtgagcgccctgttcagagaggagcagagcaacaccaacctggccaagttcagaaagctgcagcacgagctggaggaggccgaggagagagccgacatcgccgagagccaggtgaacaagctgagagtgaagagcagagaggtgcacaccaaggtgatcagcgaggagtag

SEQ ID NO: 90115 - DNA, 5820 bp, Artificial Sequence
  Description of Artificial Sequence: Synthetic coding sequence
atgagcagcgacagcgagatggccatcttcggcgaggccgcccccttcctgagaaagagcgagagagagagaatcgaggcccagaacaagcccttcgacgccaagaccagcgtgttcgtggtggaccccaaggagagcttcgtgaaggccaccgtgcagagcagagagggcggcaaggtgaccgccaagaccgaggccggcgccaccgtgaccgtgaaggacgaccaggtgttccccatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaacgccgaggtggtgaccgcctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgtgaccggcgagaagaagaaggaggaggtgaccagcggcaagatgcagggcaccctggaggaccagatcatcagcgccaaccccctgctggaggccttcggcaacgccaagaccgtgagaaacgacaacagcagcagattcggcaagttcatcagaatccacttcggcaccaccggcaagctggccagcgccgacatcgagacctacctgctggagaagagcagagtgaccttccagctgaaggccgagagaagctaccacatcttctaccagatcatgagcaacaagaagcccgacctgatcgagatgctgctgatcaccaccaacccctacgactacgccttcgtgagccagggcgagatcaccgtgcccagcatcgacgaccaggaggagctgatggccaccgacagcgccatcgagatcctgggcttcaccagcgacgagagagtgagcatctacaagctgaccggcgccgtgatgcactacggcaacatgaagttcaagcagaagcagagagaggagcaggccgagcccgacggcaccgaggtggccgacaaggccgcctacctgcagaacctgaacagcgccgacctgctgaaggccctgtgctaccccagagtgaaggtgggcaacgagtacgtgaccaagggccagaccgtgcagcaggtgtacaacgccgtgggcgccctggccaaggccgtgtacgacaagatgttcctgtggatggtgaccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtggaccttcatcgacttcggcatggacctggccgcctgcatcgagctgatcgagaagcccatgggcatcttcagcatcctggaggaggagtgcatgttccccaaggccaccgacaccagcttcaagaacaagctgtacgagcagcacctgggcaagagcaacaacttccagaagcccaagcccgccaagggcaagcccgaggcccacttcagcctgatccactacgccggcaccgtggactacaacatcgccggctggctggacaagaacaaggaccccctgaacgagaccgtggtgggcctgtaccagaagagcgccatgaagaccctggccctgctgttcgtgggcgccaccggcgccgaggccgaggccggcggcggcaagaagggcggcaagaagaagggcagcagcttccagaccgtgagcgccctgttcagagagaacctgaacaagctgatgaccaacctgagaagcacccacccccacttcgtgagatgcatcatccccaacgagaccaagacccccggcgccatggagcacgagctggtgctgcaccagctgagatgcaacggcgtgctggagggcatcagaatctgcagaaagggcttccccagcagaatcctgtacgccgacttcaagcagagatacaaggtgctgaacgccagcgccatccccgagggccagttcatcgacagcaagaaggccagcgagaagctgctgggcagcatcgacatcgaccacacccagtacaagttcggccacaccaaggtgttcttcaaggccggcctgctgggcctgctggaggagatgagagacgagaagctggcccagctgatcaccagaacccaggccatgtgcagaggcttcctggccagagtggagtaccagaagatggtggagagaagagagagcatcttctgcatccagtacaacgtgagagccttcatgaacgtgaagcactggccctggatgaagctgtacttcaagatcaagcccctgctgaagagcgccgagaccgagaaggagatggccaacatgaaggaggagttcgagaagaccaaggaggagctggccaagaccgaggccaagagaaaggagctggaggagaagatggtgaccctgatgcaggagaagaacgacctgcagctgcaggtgcaggccgaggccgacagcctggccgacgccgaggagagatgcgaccagctgatcaagaccaagatccagctggaggccaagatcaaggaggtgaccgagagagccgaggacgaggaggagatcaacgccgagctgaccgccaagaagagaaagctggaggacgagtgcagcgagctgaagaaggacatcgacgacctggagctgaccctggccaaggtggagaaggagaagcacgccaccgagaacaaggtgaagaacctgaccgaggagatggccggcctggacgagaccatcgccaagctgaccaaggagaagaaggccctgcaggaggcccaccagcagaccctggacgacctgcaggccgaggaggacaaggtgaacaccctgaccaaggccaagatcaagctggagcagcaggtggacgacctggagggcagcctggagcaggagaagaagatcagaatggacctggagagagccaagagaaagctggagggcgacctgaagctggcccaggagagcaccatggacatcgagaacgacaagcagcagctggacgagaagctgaagaagaaggagttcgagatgagcggcctgcagagcaagatcgaggacgagcaggccctgggcatgcagctgcagaagaagatcaaggagctgcaggccagaatcgaggagctggaggaggagatcgaggccgagagagccagcagagccaaggccgagaagcagagaagcgacctgagcagagagctggaggagatcagcgagagactggaggaggccggcggcgccaccagcgcccagatcgagatgaacaagaagagagaggccgagttccagaagatgagaagagacctggaggaggccaccctgcagcacgaggccaccgccgccaccctgagaaagaagcacgccgacagcgtggccgagctgggcgagcagatcgacaacctgcagagagtgaagcagaagctggagaaggagaagagcgagatgaagatggagatcgacgacctggccagcaacatggagaccgtgagcaaggccaagggcaacctggagaagatgtgcagagccctggaggaccagctgagcgagatcaagaccaaggaggaggagcagcagagactgatcaacgacctgaccgcccagagagccagactgcagaccgagagcggcgagtacagcagacagctggacgagaaggacaccctggtgagccagctgagcagaggcaagcaggccttcacccagcagatcgaggagctgaagagacagctggaggaggagatcaaggccaagagcgccctggcccacgccctgcagagcagcagacacgactgcgacctgctgagagagcagtacgaggaggagcaggaggccaaggccgagctgcagagagccatgagcaaggccaacagcgaggtggcccagtggagaaccaagtacgagaccgacgccatccagagaaccgaggagctggaggaggccaagaagaagctggcccagagactgcaggacgccgaggagcacgtggaggccgtgaacgccaagtgcgccagcctggagaagaccaagcagagactgcagaacgaggtggaggacctgatgatcgacgtggagagaaccaacgccgcctgcgccgccctggacaagaagcagagaaacttcgacaagatcctggccgagtggaagcagaagtgcgaggagacccacgccgagctggaggccagccagaaggagagcagaagcctgagcaccgagctgttcaagatcaagaacgcctacgaggagagcctggaccagctggagaccctgaagagagagaacaagaacctgcagcaggagatcagcgacctgaccgagcagatcgccgagggcggcaagagaatccacgagctggagaagatcaagaagcaggtggagcaggagaagagcgagctgcaggccgccctggaggaggccgaggccagcctggagcacgaggagggcaagatcctgagaatccagctggagctgaaccaggtgaagagcgaggtggacagaaagatcgccgagaaggacgaggagatcgaccagatgaagagaaaccacatcagaatcgtggagagcatgcagagcaccctggacgccgagatcagaagcagaaacgacgccatcagactgaagaagaagatggagggcgacctgaacgagatggagatccagctgaaccacgccaacagaatggccgccgaggccctgagaaactacagaaacacccaggccatcctgaaggacacccagctgcacctggacgacgccctgagaagccaggaggacctgaaggagcagctggccatggtggagagaagagccaacctgctgcaggccgagatcgaggagctgagagccaccctggagcagaccgagagaagcagaaagatcgccgagcaggagctgctggacgccagcgagagagtgcagctgctgcacacccagaacaccagcctgatcaacaccaagaagaagctggagaccgacatcagccagatccagggcgagatggaggacatcatccaggaggccagaaacgccgaggagaaggccaagaaggccatcaccgacgccgccatgatggccgaggagctgaagaaggagcaggacaccagcgcccacctggagagaatgaagaagaacctggagcagaccgtgaaggacctgcagcacagactggacgaggccgagcagctggccctgaagggcggcaagaagcagatccagaagctggaggccagagtgagagagctggagggcgaggtggagagcgagcagaagagaaacgtggaggccgtgaagggcctgagaaagcacgagagaaaggtgaaggagctgacctaccagaccgaggaggacagaaagaacatcctgagactgcaggacctggtggacaagctgcaggccaaggtgaagagctacaagagacaggccgaggaggccgaggagcagagcaacgtgaacctgagcaagttcagaagaatccagcacgagctggaggaggccgaggagagagccgacatcgccgagagccaggtgaacaagctgagagtgaagagcagagaggtgcacaccaagatcatcagcgaggagtag

SEQ ID NO: 90116 - DNA, 5820 bp, Artificial Sequence
  Description of Artificial Sequence: Synthetic coding sequence
atgagcagcgacagcgagatggccatcttcggcgaggccgcccccttcctgagaaagagcgagaaggagagaatcgaggcccagaacaagcccttcgacgccaagaccagcgtgttcgtggtggaccccaaggagagctacgtgaaggccatcgtgcagagcagagagggcggcaaggtgaccgccaagaccgaggccggcgccaccgtgaccgtgaaggaggaccaggtgttcagcatgaacccccccaagtacgacaagatcgaggacatggccatgatgacccacctgcacgagcccgccgtgctgtacaacctgaaggagagatacgccgcctggatgatctacacctacagcggcctgttctgcgtgaccgtgaacccctacaagtggctgcccgtgtacaaccccgaggtggtgaccgcctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgtgaccggcgagaagaagaaggaggagcccgccagcggcaagatgcagggcaccctggaggaccagatcatcagcgccaaccccctgctggaggccttcggcaacgccaagaccgtgagaaacgacaacagcagcagattcggcaagttcatcagaatccacttcggcgccaccggcaagctggccagcgccgacatcgagacctacctgctggagaagagcagagtgaccttccagctgaaggccgagagaagctaccacatcttctaccagatcctgagcaacaagaagcccgagctgatcgagatgctgctgatcaccaccaacccctacgacttcgccttcgtgagccagggcgagatcaccgtgcccagcatcgacgaccaggaggagctgatggccaccgacagcgccgtggacatcctgggcttcaccgccgacgagaaggtggccatctacaagctgaccggcgccgtgatgcactacggcaacatgaagttcaagcagaagcagagagaggagcaggccgagcccgacggcaccgaggtggccgacaaggccgcctacctgaccagcctgaacagcgccgacctgctgaagagcctgtgctaccccagagtgaaggtgggcaacgagttcgtgaccaagggccagaccgtgcagcaggtgtacaacgccgtgggcgccctggccaaggccatctacgagaagatgttcctgtggatggtgaccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtgggagttcatcgacttcggcatggacctggccgcctgcatcgagctgatcgagaagcccatgggcatcttcagcatcctggaggaggagtgcatgttccccaaggccaccgacaccagcttcaagaacaagctgtacgagcagcacctgggcaagagcaacaacttccagaagcccaagcccgccaagggcaagcccgaggcccacttcagcctggtgcactacgccggcaccgtggactacaacatcgccggctggctggacaagaacaaggaccccctgaacgagaccgtggtgggcctgtaccagaagagcgccatgaagaccctggccttcctgttcagcggcgcccagaccgccgaggccgagggcggcggcggcaagaagggcggcaagaagaagggcagcagcttccagaccgtgagcgccctgttcagagagaacctgaacaagctgatgaccaacctgagaagcacccacccccacttcgtgagatgcatcatccccaacgagaccaagacccccggcgccatggagcacgagctggtgctgcaccagctgagatgcaacggcgtgctggagggcatcagaatctgcagaaagggcttccccagcagaatcctgtacgccgacttcaagcagagatacaaggtgctgaacgccagcgccatccccgagggccagttcatcgacagcaagaaggccagcgagaagctgctgggcagcatcgagatcgaccacacccagtacaagttcggccacaccaaggtgttcttcaaggccggcctgctgggcaccctggaggagatgagagacgagaagctggcccagctgatcaccagaacccaggccatctgcagaggcttcctgatgagagtggagttcagaaagatgatggagagaagagagagcatcttctgcatccagtacaacatcagagccttcatgaacgtgaagcactggccctggatgaagctgtacttcaagatcaagcccctgctgaagagcgccgagaccgagaaggagatggccaacatgaaggaggagttcgagaagaccaaggaggagctggccaagaccgaggccaagagaaaggagctggaggagaagatggtgaccctgatgcaggagaagaacgacctgcagctgcaggtgcaggccgaggccgacgccctggccgacgccgaggagagatgcgaccagctgatcaagaccaagatccagctggaggccaagatcaaggaggtgaccgagagagccgaggacgaggaggagatcaacgccgagctgaccgccaagaagagaaagctggaggacgagtgcagcgagctgaagaaggacatcgacgacctggagctgaccctggccaaggtggagaaggagaagcacgccaccgagaacaaggtgaagaacctgaccgaggagatggccggcctggacgagaccatcgccaagctgaccaaggagaagaaggccctgcaggaggcccaccagcagaccctggacgacctgcagatggaggaggacaaggtgaacaccctgaccaaggccaagaccaagctggagcagcaggtggacgacctggagggcagcctggagcaggagaagaagctgtgcatggacctggagagagccaagagaaagctggagggcgacctgaagctggcccaggagagcaccatggacaccgagaacgacaagcagcagctgaacgagaagctgaagaagaaggagttcgagatgagcaacctgcagggcaagatcgaggacgagcaggccctggccatccagctgcagaagaagatcaaggagctgcaggccagaatcgaggagctggaggaggagatcgaggccgagagagccagcagagccaaggccgagaagcagagaagcgacctgagcagagagctggaggagatcagcgagagactggaggaggccggcggcgccaccagcgcccagatcgagatgaacaagaagagagaggccgagttccagaagatgagaagagacctggaggagagcaccctgcagcacgaggccaccgccgccgccctgagaaagaagcacgccgacagcgtggccgagctgggcgagcagatcgacagcctgcagagagtgaagcagaagctggagaaggagaagagcgagctgaagatggagatcaacgacctggccagcaacatggagaccgtgagcaaggccaaggccaacttcgagaagatgtgcagaaccctggaggaccagctgagcgagatcaagaccaaggaggaggagcagcagagactgatcaacgagctgagcgcccagaaggccagactgcacaccgagagcggcgagttcagcagacagctggacgagaaggacgccatggtgagccagctgagcagaggcaagcaggccttcacccagcagatcgaggagctgaagagacagctggaggaggagaccaaggccaagagcaccctggcccacgccctgcagagcgccagacacgactgcgacctgctgagagagcagtacgaggaggagcaggaggccaaggccgagctgcagagaggcatgagcaaggccaacagcgaggtggcccagtggagaaccaagtacgagaccgacgccatccagagaaccgaggagctggaggaggccaagaagaagctggcccagagactgcaggacgccgaggagcacgtggaggccgtgaacagcaagtgcgccagcctggagaagaccaagcagagactgcagaacgaggtggaggacctgatgatcgacgtggagagaagcaacgccgcctgcatcgccctggacaagaagcagagaaacttcgacaaggtgctggccgagtggaagcagaagtacgaggagacccaggccgagctggaggccagccagaaggagagcagaagcctgagcaccgagctgttcaaggtgaagaacgcctacgaggagagcctggaccacctggagaccctgaagagagagaacaagaacctgcagcaggagatcagcgacctgaccgagcagatcgccgagggcggcaagcacatccacgagctggagaaggtgaagaagcagctggaccacgagaagagcgagctgcagaccagcctggaggaggccgaggccagcctggagcacgaggagggcaagatcctgagaatccagctggagctgaaccaggtgaagagcgagatcgacagaaagatcgccgagaaggacgaggagctggaccagctgaagagaaaccacctgagagtggtggagagcatgcagagcaccctggacgccgagatcagaagcagaaacgacgccctgagaatcaagaagaagatggagggcgacctgaacgagatggagatccagctgaaccacgccaacagacaggccgccgaggccctgagaaacctgagaaacacccagggcatcctgaaggacacccagctgcacctggacgacgccatcagaggccaggacgacctgaaggagcagctggccatggtggagagaagagccaacctgatgcaggccgaggtggaggagctgagagccagcctggagagaaccgagagaggcagaaagatggccgagcaggagctgctggacgccagcgagagagtgcagctgctgcacacccagaacaccagcctgatcaacaccaagaagaagctggagaccgacatcagccagatccagggcgagatggaggacatcgtgcaggaggccagaaacgccgaggagaaggccaagaaggccatcaccgacgccgccatgatggccgaggagctgaagaaggagcaggacaccagcgcccacctggagagaatgaagaagaacatggagcagaccgtgaaggacctgcagctgagactggacgaggccgagcagctggccctgaagggcggcaagaagcagatccagaagctggaggccagagtgagagagctggagagcgaggtggagagcgagcagaagcacaacgtggaggccgtgaagggcctgagaaagcacgagagaagagtgaaggagctgacctaccagaccgaggaggacagaaagaacatcctgagactgcaggacctggtggacaagctgcagaccaaggtgaaggcctacaagagacaggccgaggaggccgaggagcagagcaacgtgaacctggccaagttcagaaagctgcagcacgagctggaggaggccaaggagagagccgacatcgccgagagccaggtgaacaagctgagagtgaagagcagagaggtgcacaccaaggtgatcagcgaggagtag

SEQ ID NO: 90117 - DNA, 5820 bp, Artificial Sequence
  Description of Artificial Sequence: Synthetic coding sequence
atgaccgacgcccagatggccgacttcggcgccgccgcccagtacctgagaaagagcgagaaggagagactggaggcccagaccagacccttcgacatcagaaccgagtgcttcgtgcccgacgacaaggaggagttcgtgaaggccaagatcctgagcagagagggcggcaaggtgatcgccgagaccgagaacggcaagaccgtgaccgtgaaggaggaccaggtgctgcagcagaacccccccaagttcgacaagatcgaggacatggccatgctgaccttcctgcacgagcccgccgtgctgttcaacctgaaggagagatacgccgcctggatgatctacacctacagcggcctgttctgcgtgaccgtgaacccctacaagtggctgcccgtgtacaacgccgaggtggtggccgcctacagaggcaagaagagaagcgaggcccccccccacatcttcagcatcagcgacaacgcctaccagtacatgctgaccgacagagagaaccagagcatcctgatcaccggcgagagcggcgccggcaagaccgtgaacaccaagagagtgatccagtacttcgccagcatcgccgccatcggcgacagaggcaagaaggacaacgccaacgccaacaagggcaccctggaggaccagatcatccaggccaaccccgccctggaggccttcggcaacgccaagaccgtgagaaacgacaacagcagcagattcggcaagttcatcagaatccacttcggcgccaccggcaagctggccagcgccgacatcgagacctacctgctggagaagagcagagtgatcttccagctgaaggccgagagaaactaccacatcttctaccagatcctgagcaacaagaagcccgagctgctggacatgctgctggtgaccaacaacccctacgactacgccttcgtgagccagggcgaggtgagcgtggccagcatcgacgacagcgaggagctgatggccaccgacagcgccttcgacgtgctgggcttcaccagcgaggagaaggccggcgtgtacaagctgaccggcgccatcatgcactacggcaacatgaagttcaagcagaagcagagagaggagcaggccgagcccgacggcaccgaggacgccgacaagagcgcctacctgatgggcctgaacagcgccgacctgctgaagggcctgtgccaccccagagtgaaggtgggcaacgagtacgtgaccaagggccagagcgtgcagcaggtgtactacagcatcggcgccctggccaaggccgtgtacgagaagatgttcaactggatggtgaccagaatcaacgccaccctggagaccaagcagcccagacagtacttcatcggcgtgctggacatcgccggcttcgagatcttcgacttcaacagcttcgagcagctgtgcatcaacttcaccaacgagaagctgcagcagttcttcaaccaccacatgttcgtgctggagcaggaggagtacaagaaggagggcatcgagtggaccttcatcgacttcggcatggacctgcaggcctgcatcgacctgatcgagaagcccatgggcatcatgagcatcctggaggaggagtgcatgttccccaaggccaccgacatgaccttcaaggccaagctgtacgacaaccacctgggcaagagcaacaacttccagaagcccagaaacatcaagggcaagcaggaggcccacttcagcctgatccactacgccggcaccgtggactacaacatcctgggctggctggagaagaacaaggaccccctgaacgagaccgtggtggccctgtaccagaagagcagcctgaagctgatggccaccctgttcagcagctacgccaccgccgacaccggcgacagcggcaagagcaagggcggcaagaagaagggcagcagcttccagaccgtgagcgccctgcacagagagaacctgaacaagctgatgaccaacctgagaaccacccacccccacttcgtgagatgcatcatccccaacgagagaaaggcccccggcgtgatggacaaccccctggtgatgcaccagctgagatgcaacggcgtgctggagggcatcagaatctgcagaaagggcttccccaacagaatcctgtacggcgacttcagacagagatacagaatcctgaaccccgtggccatccccgagggccagttcatcgacagcagaaagggcaccgagaagctgctgagcagcctggacatcgaccacaaccagtacaagttcggccacaccaaggtgttcttcaaggccggcctgctgggcctgctggaggagatgagagacgagagactgagcagaatcatcaccagaatgcaggcccaggccagaggccagctgatgagaatcgagttcaagaagatcgtggagagaagagacgccctgctggtgatccagtggaacatcagagccttcatgggcgtgaagaactggccctggatgaagctgtacttcaagatcaagcccctgctgaagagcgccgagaccgagaaggagatggccaccatgaaggaggagttcggcagaatcaaggagaccctggagaagagcgaggccagaagaaaggagctggaggagaagatggtgagcctgctgcaggagaagaacgacctgcagctgcaggtgcaggccgagcaggacaacctgaacgacgccgaggagagatgcgaccagctgatcaagaacaagatccagctggaggccaaggtgaaggagatgaacgagagactggaggacgaggaggagatgaacgccgagctgaccgccaagaagagaaagctggaggacgagtgcagcgagctgaagaaggacatcgacgacctggagctgaccctggccaaggtggagaaggagaagcacgccaccgagaacaaggtgaagaacctgaccgaggagatggccggcctggacgagatcatcgccaagctgaccaaggagaagaaggccctgcaggaggcccaccagcaggccctggacgacctgcaggtggaggaggacaaggtgaacagcctgagcaagagcaaggtgaagctggagcagcaggtggacgacctggagggcagcctggagcaggagaagaaggtgagaatggacctggagagagccaagagaaagctggagggcgacctgaagctgacccaggagagcatcatggacctggagaacgacaagctgcagctggaggagaagctgaagaagaaggagttcgacatcaaccagcagaacagcaagatcgaggacgagcaggtgctggccctgcagctgcagaagaagctgaaggagaaccaggccagaatcgaggagctggaggaggagctggaggccgagagaaccgccagagccaaggtggagaagctgagaagcgacctgagcagagagctggaggagatcagcgagagactggaggaggccggcggcgccaccagcgtgcagatcgagatgaacaagaagagagaggccgagttccagaagatgagaagagacctggaggaggccaccctgcagcacgaggccaccgccgccgccctgagaaagaagcacgccgacagcgtggccgagctgggcgagcagatcgacaacctgcagagagtgaagcagaagctggagaaggagaagagcgagttcaagctggagctggacgacgtgaccagcaacatggagcagatcatcaaggccaaggccaacctggagaaggtgagcagaaccctggaggaccaggccaacgagtacagagtgaagctggaggaggcccagagaagcctgaacgacttcaccacccagagagccaagctgcagaccgagaacggcgagctggccagacagctggaggagaaggaggccctgatcagccagctgaccagaggcaagctgagctacacccagcagatggaggacctgaagagacagctggaggaggagggcaaggccaagaacgccctggcccacgccctgcagagcgccagacacgactgcgacctgctgagagagcagtacgaggaggagaccgaggccaaggccgagctgcagagagtgctgagcaaggccaacagcgaggtggcccagtggagaaccaagtacgagaccgacgccatccagagaaccgaggagctggaggaggccaagaagaagctggcccagagactgcaggacgccgaggaggccgtggaggccgtgaacgccaagtgcagcagcctggagaagaccaagcacagactgcagaacgagatcgaggacctgatggtggacgtggagagaagcaacgccgccgccgccgccctggacaagaagcagagaaacttcgacaagatcctggccgagtggaagcagaagtacgaggagagccagagcgagctggagagcagccagaaggaggccagaagcctgagcaccgagctgttcaagctgaagaacgcctacgaggagagcctggagcacctggagaccttcaagagagagaacaagaacctgcaggaggagatcagcgacctgaccgagcagctgggcgagggcggcaagaacgtgcacgagctggagaaggtgagaaagcagctggaggtggagaagctggagctgcagagcgccctggaggaggccgaggccagcctggagcacgaggagggcaagatcctgagagcccagctggagttcaaccagatcaaggccgagatcgagagaaagctggccgagaaggacgaggagatggagcaggccaagagaaaccaccagagagtggtggacagcctgcagaccagcctggacgccgagaccagaagcagaaacgaggtgctgagagtgaagaagaagatggagggcgacctgaacgagatggagatccagctgagccacgccaacagaatggccgccgaggcccagaagcaggtgaagagcctgcagagcctgctgaaggacacccagatccagctggacgacgccgtgagagccaacgacgacctgaaggagaacatcgccatcgtggagagaagaaacaacctgctgcaggccgagctggaggagctgagagccgtggtggagcagaccgagagaagcagaaagctggccgagcaggagctgatcgagaccagcgagagagtgcagctgctgcacagccagaacaccagcctgatcaaccagaagaagaagatggagagcgacctgacccagctgcagagcgaggtggaggaggccgtgcaggagtgcagaaacgccgaggagaaggccaagaaggccatcaccgacgccgccatgatggccgaggagctgaagaaggagcaggacaccagcgcccacctggagagaatgaagaagaacatggagcagaccatcaaggacctgcagcacagactggacgaggccgagcagatcgccctgaagggcggcaagaagcagctgcagaagctggaggccagagtgagagagctggagggcgagctggaggccgagcagaagagaaacgccgagagcgtgaagggcatgagaaagagcgagagaagaatcaaggagctgacctaccagaccgaggaggacaagaagaacctgctgagactgcaggacctggtggacaagctgcagctgaaggtgaaggcctacaagagacaggccgaggaggccgaggagcaggccaacaccaacctgagcaagttcagaaaggtgcagcacgagctggacgaggccgaggagagagccgacatcgccgagagccaggtgaacaagctgagagccaagagcagagacatcggcgccaagcagaagatgcacgacgaggagtag

SEQ ID NO: 90118 - DNA, 5820 bp, Artificial Sequence; identical to SEQ ID NO: 90117
  Description of Artificial Sequence: Synthetic coding sequence

SEQ ID NO: 90119 - DNA, 5808 bp, Artificial Sequence
  Description of Artificial Sequence: Synthetic coding sequence
atgggcgacagcgagatggccgtgttcggcgccgccgccccctacctgagaaagagcgagaaggagagactggaggcccagaccagacccttcgacctgaagaaggacgtgttcgtgcccgacgacaagcaggagttcgtgaaggccaagatcgtgagcagagagggcggcaaggtgaccgccgagaccgagtacggcaagaccgtgaccgtgaaggaggaccaggtgatgcagcagaacccccccaagttcgacaagatcgaggacatggccatgctgaccttcctgcacgagcccgccgtgctgtacaacctgaaggacagatacggcagctggatgatctacacctacagcggcctgttctgcgtgaccgtgaacccctacaagtggctgcccgtgtacacccccgaggtggtggccgcctacagaggcaagaagagaagcgaggcccccccccacatcttcagcatcagcgacaacgcctaccagtacatgctgaccgacagagagaaccagagcatcctgatcaccggcgagagcggcgccggcaagaccgtgaacaccaagagagtgatccagtacttcgccgtgatcgccgccatcggcgacagaagcaagaaggaccagagccccggcaagggcaccctggaggaccagatcatccaggccaaccccgccctggaggccttcggcaacgccaagaccgtgagaaacgacaacagcagcagattcggcaagttcatcagaatccacttcggcgccaccggcaagctggccagcgccgacatcgagacctacctgctggagaagagcagagtgatcttccagctgaaggccgagagagactaccacatcttctaccagatcctgagcaacaagaagcccgagctgctggacatgctgctgatcaccaacaacccctacgactacgccttcatcagccagggcgagaccaccgtggccagcatcgacgacgccgaggagctgatggccaccgacaacgccttcgacgtgctgggcttcaccagcgaggagaagaacagcatgtacaagctgaccggcgccatcatgcacttcggcaacatgaagttcaagctgaagcagagagaggagcaggccgagcccgacggcaccgaggaggccgacaagagcgcctacctgatgggcctgaacagcgccgacctgctgaagggcctgtgccaccccagagtgaaggtgggcaacgagtacgtgaccaagggccagaacgtgcagcaggtgatctacgccaccggcgccctggccaaggccgtgtacgagagaatgttcaactggatggtgaccagaatcaacgccaccctggagaccaagcagcccagacagtacttcatcggcgtgctggacatcgccggcttcgagatcttcgacttcaacagcttcgagcagctgtgcatcaacttcaccaacgagaagctgcagcagttcttcaaccaccacatgttcgtgctggagcaggaggagtacaagaaggagggcatcgagtggaccttcatcgacttcggcatggacctgcaggcctgcatcgacctgatcgagaagcccatgggcatcatgagcatcctggaggaggagtgcatgttccccaaggccaccgacatgaccttcaaggccaagctgttcgacaaccacctgggcaagagcgccaacttccagaagcccagaaacatcaagggcaagcccgaggcccacttcagcctgatccactacgccggcatcgtggactacaacatcatcggctggctgcagaagaacaaggaccccctgaacgagaccgtggtgggcctgtaccagaagagcagcctgaagctgctgagcaccctgttcgccaactacgccggcgccgacgcccccatcgagaagggcaagggcaaggccaagaagggcagcagcttccagaccgtgagcgccctgcacagagagaacctgaacaagctgatgaccaacctgagaagcacccacccccacttcgtgagatgcatcatccccaacgagaccaagagccccggcgtgatggacaaccccctggtgatgcaccagctgagatgcaacggcgtgctggagggcatcagaatctgcagaaagggcttccccaacagaatcctgtacggcgacttcagacagagatacagaatcctgaaccccgccgccatccccgagggccagttcatcgacagcagaaagggcgccgagaagctgctgagcagcctggacatcgaccacaaccagtacaagttcggccacaccaaggtgttcttcaaggccggcctgctgggcctgctggaggagatgagagacgagagactgagcagaatcatcaccagaatccaggcccagagcagaggcgtgctggccagaatggagtacaagaagctgctggagagaagagacagcctgctggtgatccagtggaacatcagagccttcatgggcgtgaagaactggccctggatgaagctgtacttcaagatcaagcccctgctgaagagcgccgagagagagaaggagatggccagcatgaaggaggagttcaccagactgaaggaggccctggagaagagcgaggccagaagaaaggagctggaggagaagatggtgagcctgctgcaggagaagaacgacctgcagctgcaggtgcaggccgagcaggacaacctggccgacgccgaggagagatgcgaccagctgatcaagaacaagatccagctggaggccaaggtgaaggagatgaacgagagactggaggacgaggaggagatgaacgccgagctgaccgccaagaagagaaagctggaggacgagtgcagcgagctgaagagagacatcgacgacctggagctgaccctggccaaggtggagaaggagaagcacgccaccgagaacaaggtgaagaacctgaccgaggagatggccggcctggacgagatcatcgccaagctgaccaaggagaagaaggccctgcaggaggcccaccagcaggccctggacgacctgcaggccgaggaggacaaggtgaacaccctgaccaaggccaaggtgaagctggagcagcaggtggacgacctggagggcagcctggagcaggagaagaaggtgagaatggacctggagagagccaagagaaagctggagggcgacctgaagctgacccaggagagcatcatggacctggagaacgacaagcagcagctggacgagagactgaagaagaaggacttcgagctgaacgccctgaacgccagaatcgaggacgagcaggccctgggcagccagctgcagaagaagctgaaggagctgcaggccagaatcgaggagctggaggaggagctggaggccgagagaaccgccagagccaaggtggagaagctgagaagcgacctgagcagagagctggaggagatcagcgagagactggaggaggccggcggcgccaccagcgtgcagatcgagatgaacaagaagagagaggccgagttccagaagatgagaagagacctggaggaggccaccctgcagcacgaggccaccgccgccgccctgagaaagaagcacgccgacagcgtggccgagctgggcgagcagatcgacaacctgcagagagtgaagcagaagctggagaaggagaagagcgagttcaagctggagctggacgacgtgaccagcaacatggagcagatcatcaaggccaaggccaacctggagaagatgtgcagaaccctggaggaccagatgaacgagcacagaagcaaggccgaggagacccagagaagcgtgaacgacctgaccagccagagagccaagctgcagaccgagaacggcgagctgagcagacagctggacgagaaggaggccctgatcagccagctgaccagaggcaagctgacctacacccagcagctggaggacctgaagagacagctggaggaggaggtgaaggccaagaacgccctggcccacgccctgcagagcgccagacacgactgcgacctgctgagagagcagtacgaggaggagaccgaggccaaggccgagctgcagagagtgctgagcaaggccaacagcgaggtggcccagtggagaaccaagtacgagaccgacgccatccagagaaccgaggagctggaggaggccaagaagaagctggcccagagactgcaggaggccgaggaggccgtggaggccgtgaacgccaagtgcagcagcctggagaagaccaagcacagactgcagaacgagatcgaggacctgatggtggacgtggagagaagcaacgccgccgccgccgccctggacaagaagcagagaaacttcgacaagatcctggccgagtggaagcagaagtacgaggagagccagagcgagctggagagcagccagaaggaggccagaagcctgagcaccgagctgttcaagctgaagaacgcctacgaggagagcctggagcacctggagaccttcaagagagagaacaagaacctgcaggaggagatcagcgacctgaccgagcagctgggcagcagcggcaagaccatccacgagctggagaaggtgagaaagcagctggaggccgagaagatggagctgcagagcgccctggaggaggccgaggccagcctggagcacgaggagggcaagatcctgagagcccagctggagttcaaccagatcaaggccgagatcgagagaaagctggccgagaaggacgaggagatggagcaggccaagagaaaccacctgagagtggtggacagcctgcagaccagcctggacgccgagaccagaagcagaaacgaggccctgagagtgaagaagaagatggagggcgacctgaacgagatggagatccagctgagccacgccaacagaatggccgccgaggcccagaagcaggtgaagagcctgcagagcctgctgaaggacacccagatccagctggacgacgccgtgagagccaacgacgacctgaaggagaacatcgccatcgtggagagaagaaacaacctgctgcaggccgagctggaggagctgagagccgtggtggagcagaccgagagaagcagaaagctggccgagcaggagctgatcgagaccagcgagagagtgcagctgctgcacagccagaacaccagcctgatcaaccagaagaagaagatggacgccgacctgagccagctgcagaccgaggtggaggaggccgtgcaggagtgcagaaacgccgaggagaaggccaagaaggccatcaccgacgccgccatgatggccgaggagctgaagaaggagcaggacaccagcgcccacctggagagaatgaagaagaacatggagcagaccatcaaggacctgcagcacagactggacgaggccgagcagatcgccctgaagggcggcaagaagcagctgcagaagctggaggccagagtgagagagctggagaacgagctggaggccgagcagaagagaaacgccgagagcgtgaagggcatgagaaagagcgagagaagaatcaaggagctgacctaccagaccgaggaggacagaaagaacctgctgagactgcaggacctggtggacaagctgcagctgaaggtgaaggcctacaagagacaggccgaggaggccgaggagcaggccaacaccaacctgagcaagttcagaaaggtgcagcacgagctggacgaggccgaggagagagccgacatcgccgagagccaggtgaacaagctgagagccaagagcagagacatcggcaccaagggcctgaacgaggagtag

SEQ ID NO: 90120 - DNA, 5823 bp, Artificial Sequence
  Description of Artificial Sequence: Synthetic coding sequence
atgggcgacagcgagatggccgtgttcggcgccgccgccccctacctgagaaagagcgagaaggagagactggaggcccagaccagacccttcgacctgaagaaggacgtgttcgtgcccgacgacaagcaggagttcgtgaaggccaagatcgtgagcagagagggcggcaaggtgaccgccgagaccgagtacggcaagaccgtgaccgtgaaggaggaccaggtgatgcagcagaacccccccaagttcgacaagatcgaggacatggccatgctgaccttcctgcacgagcccgccgtgctgtacaacctgaaggacagatacggcagctggatgatctacacctacagcggcctgttctgcgtgaccgtgaacccctacaagtggctgcccgtgtacacccccgaggtggtggccgcctacagaggcaagaagagaagcgaggcccccccccacatcttcagcatcagcgacaacgcctaccagtacatgctgaccgacagagagaaccagagcatcctgatcaccggcgagagcggcgccggcaagaccgtgaacaccaagagagtgatccagtacttcgccgtgatcgccgccatcggcgacagaagcaagaaggaccagagccccggcaagggcaccctggaggaccagatcatccaggccaaccccgccctggaggccttcggcaacgccaagaccgtgagaaacgacaacagcagcagattcggcaagttcatcagaatccacttcggcgccaccggcaagctggccagcgccgacatcgagacctacctgctggagaagagcagagtgatcttccagctgaaggccgagagagactaccacatcttctaccagatcctgagcaacaagaagcccgagctgctggacatgctgctgatcaccaacaacccctacgactacgccttcatcagccagggcgagaccaccgtggccagcatcgacgacgccgaggagctgatggccaccgacaacgccttcgacgtgctgggcttcaccagcgaggagaagaacagcatgtacaagctgaccggcgccatcatgcacttcggcaacatgaagttcaagctgaagcagagagaggagcaggccgagcccgacggcaccgaggaggccgacaagagcgcctacctgatgggcctgaacagcgccgacctgctgaagggcctgtgccaccccagagtgaaggtgggcaacgagtacgtgaccaagggccagaacgtgcagcaggtgatctacgccaccggcgccctggccaaggccgtgtacgagagaatgttcaactggatggtgaccagaatcaacgccaccctggagaccaagcagcccagacagtacttcatcggcgtgctggacatcgccggcttcgagatcttcgacttcaacagcttcgagcagctgtgcatcaacttcaccaacgagaagctgcagcagttcttcaaccaccacatgttcgtgctggagcaggaggagtacaagaaggagggcatcgagtggaccttcatcgacttcggcatggacctgcaggcctgcatcgacctgatcgagaagcccatgggcatcatgagcatcctggaggaggagtgcatgttccccaaggccaccgacatgaccttcaaggccaagctgttcgacaaccacctgggcaagagcgccaacttccagaagcccagaaacatcaagggcaagcccgaggcccacttcagcctgatccactacgccggcatcgtggactacaacatcatcggctggctgcagaagaacaaggaccccctgaacgagaccgtggtgggcctgtaccagaagagcagcctgaagctgctgagcaccctgttcgccaactacgccggcgccgacgcccccatcgagaagggcaagggcaaggccaagaagggcagcagcttccagaccgtgagcgccctgcacagagagaacctgaacaagctgatgaccaacctgagaagcacccacccccacttcgtgagatgcatcatccccaacgagaccaagagccccggcgtgatggacaaccccctggtgatgcaccagctgagatgcaacggcgtgctggagggcatcagaatctgcagaaagggcttccccaacagaatcctgtacggcgacttcagacagagatacagaatcctgaaccccgccgccatccccgagggccagttcatcgacagcagaaagggcgccgagaagctgctgagcagcctggacatcgaccacaaccagtacaagttcggccacaccaaggtgttcttcaaggccggcctgctgggcctgctggaggagatgagagacgagagactgagcagaatcatcaccagaatccaggcccagagcagaggcgtgctggccagaatggagtacaagaagctgctggagagaagagacagcctgctggtgatccagtggaacatcagagccttcatgggcgtgaagaactggccctggatgaagctgtacttcaagatcaagcccctgctgaagagcgccgagagagagaaggagatggccagcatgaaggaggagttcaccagactgaaggaggccctggagaagagcgaggccagaagaaaggagctggaggagaagatggtgagcctgctgcaggagaagaacgacctgcagctgcaggtgcaggccgagcaggacaacctggccgacgccgaggagagatgcgaccagctgatcaagaacaagatccagctggaggccaaggtgaaggagatgaacgagagactggaggacgaggaggagatgaacgccgagctgaccgccaagaagagaaagctggaggacgagtgcagcgagctgaagagagacatcgacgacctggagctgaccctggccaaggtggagaaggagaagcacgccaccgagaacaaggtgaagaacctgaccgaggagatggccggcctggacgagatcatcgccaagctgaccaaggagaagaaggccctgcaggaggcccaccagcaggccctggacgacctgcaggccgaggaggacaaggtgaacaccctgaccaaggccaaggtgaagctggagcagcaggtggacgacctggagggcagcctggagcaggagaagaaggtgagaatggacctggagagagccaagagaaagctggagggcgacctgaagctgacccaggagagcatcatggacctggagaacgacaagcagcagctggacgagagactgaagaagaaggacttcgagctgaacgccctgaacgccagaatcgaggacgagcaggccctgggcagccagctgcagaagaagctgaaggagctgcaggccagaatcgaggagctggaggaggagctggaggccgagagaaccgccagagccaaggtggagaagctgagaagcgacctgagcagagagctggaggagatcagcgagagactggaggaggccggcggcgccaccagcgtgcagatcgagatgaacaagaagagagaggccgagttccagaagatgagaagagacctggaggaggccaccctgcagcacgaggccaccgccgccgccctgagaaagaagcacgccgacagcgtggccgagctgggcgagcagatcgacaacctgcagagagtgaagcagaagctggagaaggagaagagcgagttcaagctggagctggacgacgccctgctgggcctgcccagcagcaacttcctgctgcccccccccctgagcgccaacctggagaagatgtgcagaaccctggaggaccagatgaacgagcacagaagcaaggccgaggagacccagagaagcgtgaacgacctgaccagccagagagccaagctgcagaccgagaacggcgagctgagcagacagctggacgagaaggaggccctgatcagccagctgaccagaggcaagctgacctacacccagcagctggaggacctgaagagacagctggaggaggaggtgaaggccaagaacgccctggcccacgccctgcagagcgccagacacgactgcgacctgctgagagagcagtacgaggaggagaccgaggccaaggccgagctgcagagagtgctgagcaaggccaacagcgaggtggcccagtggagaaccaagtacgagaccgacgccatccagagaaccgaggagctggaggaggccaagaagaagctggcccagagactgcaggaggccgaggaggccgtggaggccgtgaacgccaagtgcagcagcctggagaagaccaagcacagactgcagaacgagatcgaggacctgatggtggacgtggagagaagcaacgccgccgccgccgccctggacaagaagcagagaaacttcgacaagatcctggccgagtggaagcagaagtacgaggagagccagagcgagctggagagcagccagaaggaggccagaagcctgagcaccgagctgttcaagctgaagaacgcctacgaggagagcctggagcacctggagaccttcaagagagagaacaagaacctgcaggaggagatcagcgacctgaccgagcagctgggcagcagcggcaagaccatccacgagctggagaaggtgagaaagcagctggaggccgagaagatggagctgcagagcgccctggaggaggccgaggccagcctggagcacgaggagggcaagatcctgagagcccagctggagttcaaccagatcaaggccgagatcgagagaaagctggccgagaaggacgaggagatggagcaggccaagagaaaccacctgagagtggtggacagcctgcagaccagcctggacgccgagaccagaagcagaaacgaggccctgagagtgaagaagaagatggagggcgacctgaacgagatggagatccagctgagccacgccaacagaatggccgccgaggcccagaagcaggtgaagagcctgcagagcctgctgaaggacacccagatccagctggacgacgccgtgagagccaacgacgacctgaaggagaacatcgccatcgtggagagaagaaacaacctgctgcaggccgagctggaggagctgagagccgtggtggagcagaccgagagaagcagaaagctggccgagcaggagctgatcgagaccagcgagagagtgcagctgctgcacagccagaacaccagcctgatcaaccagaagaagaagatggacgccgacctgagccagctgcagaccgaggtggaggaggccgtgcaggagtgcagaaacgccgaggagaaggccaagaaggccatcaccgacgccgccatgatggccgaggagctgaagaaggagcaggacaccagcgcccacctggagagaatgaagaagaacatggagcagaccatcaaggacctgcagcacagactggacgaggccgagcagatcgccctgaagggcggcaagaagcagctgcagaagctggaggccagagtgagagagctggagaacgagctggaggccgagcagaagagaaacgccgagagcgtgaagggcatgagaaagagcgagagaagaatcaaggagctgacctaccagaccgaggaggacagaaagaacctgctgagactgcaggacctggtggacaagctgcagctgaaggtgaaggcctacaagagacaggccgaggaggccgaggagcaggccaacaccaacctgagcaagttcagaaaggtgcagcacgagctggacgaggccgaggagagagccgacatcgccgagagccaggtgaacaagctgagagccaagagcagagacatcggcaccaagggcctgaacgaggagtag

SEQ ID NO: 90121 - DNA, 5814 bp, Artificial Sequence
  Description of Artificial Sequence: Synthetic coding sequence
atgagcgccagcagcgacgccgagatggccgtgttcggcgaggccgccccctacctgagaaagagcgagaaggagagaatcgaggcccagaacaagcccttcgacgccaagaccagcgtgttcgtggccgagcccaaggagagctacgtgaagagcaccatccagagcaaggagggcggcaaggtgaccgtgaagaccgagggcggcgccaccctgaccgtgagagaggaccaggtgttccccatgaacccccccaagtacgacaagatcgaggacatggccatgatgacccacctgcacgagcccggcgtgctgtacaacctgaaggagagatacgccgcctggatgatctacacctacagcggcctgttctgcgtgaccgtgaacccctacaagtggctgcccgtgtacaagcccgaggtggtggccgcctacagaggcaagaagagacaggaggcccccccccacatcttcagcatcagcgacaacgcctaccagttcatgctgaccgacagagagaaccagagcatcctgatcaccggcgagagcggcgccggcaagaccgtgaacaccaagagagtgatccagtacttcgccaccatcgccgtgaccggcgagaagaagaaggacgagagcggcaagatgcagggcaccctggaggaccagatcatcagcgccaaccccctgctggaggccttcggcaacgccaagaccgtgagaaacgacaacagcagcagattcggcaagttcatcagaatccacttcggcaccaccggcaagctggccagcgccgacatcgagacctacctgctggagaagagcagagtgaccttccagctgaaggccgagagaagctaccacatcttctaccagatcaccagcaacaagaagcccgacctgatcgagatgctgctgatcaccaccaacccctacgactacgccttcgtgagccagggcgagatcaccgtgcccagcatcgacgaccaggaggagctgatggccaccgacagcgccatcgacatcctgggcttcacccccgaggagaaggtgagcatctacaagctgaccggcgccgtgatgcactacggcaacatgaagttcaagcagaagcagagagaggagcaggccgagcccgacggcaccgaggtggccgacaaggccgcctacctgcagagcctgaacagcgccgacctgctgaaggccctgtgctaccccagagtgaaggtgggcaacgagtacgtgaccaagggccagaccgtgcagcaggtgtacaacgccgtgggcgccctggccaaggccgtgtacgagaagatgttcctgtggatggtgaccagaatcaaccagcagctggacaccaagcagcccagacagtacttcatcggcgtgctggacatcgccggcttcgagatcttcgacttcaacagcctggagcagctgtgcatcaacttcaccaacgagaagctgcagcagttcttcaaccaccacatgttcgtgctggagcaggaggagtacaagaaggagggcatcgagtggaccttcatcgacttcggcatggacctggccgcctgcatcgagctgatcgagaagcccctgggcatcttcagcatcctggaggaggagtgcatgttccccaaggccaccgacaccagcttcaagaacaagctgtacgaccagcacctgggcaagagcgccaacttccagaagcccaaggtggtgaagggcaaggccgaggcccacttcagcctgatccactacgccggcaccgtggactacaacatcaccggctggctggacaagaacaaggaccccctgaacgacaccgtggtgggcctgtaccagaagagcgccatgaagaccctggccagcctgttcagcacctacgccagcgccgaggccgacagcagcgccaagaagggcgccaagaagaagggcagcagcttccagaccgtgagcgccctgttcagagagaacctgaacaagctgatgaccaacctgagaagcacccacccccacttcgtgagatgcatcatccccaacgagaccaagacccccggcgccatggagcacgagctggtgctgcaccagctgagatgcaacggcgtgctggagggcatcagaatctgcagaaagggcttccccagcagaatcctgtacggcgacttcaagcagagatacaaggtgctgaacgccagcgccatccccgagggccagttcatcgacagcaagaaggccagcgagaagctgctggccagcatcgacatcgaccacacccagtacaagttcggccacaccaaggtgttcttcaaggccggcctgctgggcctgctggaggagatgagagacgagaagctggcccagatcatcaccagaacccaggccgtgtgcagaggcttcctgatgagagtggagtaccagaagatgctgcagagaagagaggccctgttctgcatccagtacaacgtgagagccttcatgaacgtgaagcactggccctggatgaagctgttcttcaagatcaagcccctgctgaagagcgccgagaccgagaaggagatggccaccatgaaggaggagttccagaagaccaaggacgagctggccaagagcgaggccaagagaaaggagctggaggagaagatggtgaccctgctgaaggagaagaacgacctgcagctgcaggtgcagagcgaggccgacagcctggccgacgccgaggagagatgcgagcagctgatcaagaacaagatccagctggaggccaagatcaaggaggtgaccgagagagccgaggaggaggaggagatcaacgccgagctgaccgccaagaagagaaagctggaggacgagtgcagcgagctgaagaaggacatcgacgacctggagctgaccctggccaaggtggagaaggagaagcacgccaccgagaacaaggtgaagaacctgaccgaggagatggccggcctggacgagaccatcgccaagctgagcaaggagaagaaggccctgcaggagacccaccagcagaccctggacgacctgcaggccgaggaggacaaggtgaacatcctgaccaaggccaagaccaagctggagcagcaggtggacgacctggagggcagcctggagcaggagaagaagctgagaatggacctggagagagccaagagaaagctggagggcgacctgaagctggcccaggagagcaccatggacatggagaacgacaagcagcagctggacgagaagctggagaagaaggagttcgagatcagcaacctgatcagcaagatcgaggacgagcaggccgtggagatccagctgcagaagaagatcaaggagctgcaggccagaatcgaggagctgggcgaggagatcgaggccgagagagccagcagagccaaggccgagaagcagagaagcgacctgagcagagagctggaggagatcagcgagagactggaggaggccggcggcgccaccagcgcccaggtggagctgaacaagaagagagaggccgagttccagaagctgagaagagacctggaggaggccaccctgcagcacgaggccatggtggccgccctgagaaagaagcacgccgacagcatggccgagctgggcgagcagatcgacaacctgcagagagtgaagcagaagctggagaaggagaagagcgagctgaagatggagaccgacgacctgagcagcaacgccgaggccatcagcaaggccaagggcaacctggagaagatgtgcagaagcctggaggaccaggtgagcgagctgaagaccaaggaggaggagcagcagagactgatcaacgacctgaccgcccagagagccagactgcagaccgaggccggcgagtacagcagacagctggacgagaaggacgccctggtgagccagctgagcagaagcaagcaggccagcacccagcagatcgaggagctgaagcaccagctggaggaggagaccaaggccaagaacgccctggcccacgccctgcagagcagcagacacgactgcgacctgctgagagagcagtacgaggaggagcaggagggcaaggccgagctgcagagagccctgagcaaggccaacagcgaggtggcccagtggagaaccaagtacgagaccgacgccatccagagaaccgaggagctggaggaggccaagaagaagctggcccagagactgcaggaggccgaggagcacgtggaggccgtgaacgccaagtgcgccagcctggagaagaccaagcagagactgcagaacgaggtggaggacctgatgctggacgtggagagaagcaacgccgcctgcgccgccctggacaagaagcagagaaacttcgacaaggtgctgagcgagtggaagcagaagtacgaggagacccaggccgagctggaggccagccagaaggagagcagaagcctgagcaccgagctgttcaaggtgaagaacgtgtacgaggagagcctggaccagctggagaccctgagaagagagaacaagaacctgcagcaggagatcagcgacctgaccgagcagatcgccgagggcggcaagcagatccacgagctggagaagatcaagaagcaggtggagcaggagaagtgcgagatccaggccgccctggaggaggccgaggccagcctggagcacgaggagggcaagatcctgagaatccagctggagctgaaccaggtgaagagcgaggtggacagaaagatcgccgagaaggacgaggagatcgaccagctgaagagaaaccacaccagagtggtggagaccatgcagagcaccctggacgccgagatcagaagcagaaacgacgccctgagagtgaagaagaagatggagggcgacctgaacgagatggagatccagctgaaccacgccaacagactggccgccgagagcctgagaaactacagaaacacccagggcatcctgaaggagacccagctgcacctggacgacgccctgagaggccaggaggacctgaaggagcagctggccatcgtggagagaagagccaacctgctgcaggccgagatcgaggagctgtgggccaccctggagcagaccgagagaagcagaaagatcgccgagcaggagctgctggacgccagcgagagagtgcagctgctgcacacccagaacaccagcctgatcaacaccaagaagaagctggagaacgacgtgagccagctgcagagcgaggtggaggaggtgatccaggagagcagaaacgccgaggagaaggccaagaaggccatcaccgacgccgccatgatggccgaggagctgaagaaggagcaggacaccagcgcccacctggagagaatgaagaagaacctggagcagaccgtgaaggacctgcagcacagactggacgaggccgagcagctggccctgaagggcggcaagaagcagatccagaagctggaggccagagtgagagagctggagggcgaggtggagaacgagcagaagagaaacgccgaggccgtgaagggcctgagaaagcacgagagaagagtgaaggagctgacctaccagaccgaggaggacagaaagaacgtgctgagactgcaggacctggtggacaagctgcaggccaaggtgaagagctacaagagacaggccgaggaggccgaggagcagagcaacgccaacctgagcaagttcagaaagctgcagcacgagctggaggaggccgaggagagagccgacatcgccgagagccaggtgaacaagctgagagtgaagagcagagaggtgcacaccaagatcagcgccgagtag

SEQ ID NO: 90122 - DNA, 5814 bp, Artificial Sequence; identical to SEQ ID NO: 90121
  Description of Artificial Sequence: Synthetic coding sequence

SEQ ID NO: 90123 - DNA, 453 bp, Artificial Sequence
  Description of Artificial Sequence: Synthetic coding sequence
atgagcttcagcgccgaccagatcgccgagttcaaggaggccttcctgctgttcgacagaaccggcgacagcaagatcaccctgagccaggtgggcgacgtgctgagagccctgggcaccaaccccaccaacgccgaggtgagaaaggtgctgggcaaccccagcaacgaggagctgaacgccaagaagatcgagttcgagcagttcctgcccatgatgcaggccatcagcaacaacaaggaccaggccacctacgaggacttcgtggagggcctgagagtgttcgacaaggagggcaacggcaccgtgatgggcgccgagctgagacacgtgctggccaccctgggcgagaagatgaaggaggaggaggtggaggccctgatggccggccaggaggacagcaacggctgcatcaactacgaggccttcgtgaagcacatcatgagcatctag

SEQ ID NO: 90124 - DNA, 585 bp, Artificial Sequence
  Description of Artificial Sequence: Synthetic coding sequence
atggcccccaagaaggacgtgaagaagcccgtggccgccgccgccgccgcccccgcccccgcccccgcccccgcccccgcccccgcccccgccaagcccaaggaggagaagatcgacctgagcgccatcaagatcgagttcagcaaggagcagcaggacgagttcaaggaggccttcctgctgttcgacagaaccggcgacagcaagatcaccctgagccaggtgggcgacgtgctgagagccctgggcaccaaccccaccaacgccgaggtgagaaaggtgctgggcaaccccagcaacgaggagctgaacgccaagaagatcgagttcgagcagttcctgcccatgatgcaggccatcagcaacaacaaggaccaggccacctacgaggacttcgtggagggcctgagagtgttcgacaaggagggcaacggcaccgtgatgggcgccgagctgagacacgtgctggccaccctgggcgagaagatgaaggaggaggaggtggaggccctgatggccggccaggaggacagcaacggctgcatcaactacgaggccttcgtgaagcacatcatgagcatctag

SEQ ID NO: 90125 - DNA, 519 bp, Artificial Sequence; identical to SEQ ID NO: 90017
  Description of Artificial Sequence: Synthetic coding sequence

SEQ ID NO: 90126 - DNA, 519 bp, Artificial Sequence; identical to SEQ ID NO: 90017
  Description of Artificial Sequence: Synthetic coding sequence

SEQ ID NO: 90127 - DNA, 519 bp, Artificial Sequence; identical to SEQ ID NO: 90017
  Description of Artificial Sequence: Synthetic coding sequence

SEQ ID NO: 90128 - DNA, 519 bp, Artificial Sequence; identical to SEQ ID NO: 90017
  Description of Artificial Sequence: Synthetic coding sequence

SEQ ID NO: 90129 - DNA, 627 bp, Artificial Sequence
  Description of Artificial Sequence: Synthetic coding sequence
atggccctgggccagaagctgttcatcaccatgagcagaggcgccggcagactgcagggcaccctgtgggccctggtgttcctgggcatcctggtgggcatggtggtgcccagccccgccggcaccagagccaacaacaccctgctggacagcagaggctggggcaccctgctgagcagaagcagagccggcctggccggcgagatcgccggcgtgaactgggagagcggctacctggtgggcatcaagagacagagaagactgtactgcaacgtgggcatcggcttccacctgcaggtgctgcccgacggcagaatcagcggcacccacgaggagaacccctacagcctgctggagatcagcaccgtggagagaggcgtggtgagcctgttcggcgtgagaagcgccctgttcgtggccatgaacagcaagggcagactgtacgccacccccagcttccaggaggagtgcaagttcagagagaccctgctgcccaacaactacaacgcctacgagagcgacctgtaccagggcacctacatcgccctgagcaagtacggcagagtgaagagaggcagcaaggtgagccccatcatgaccgtgacccacttcctgcccagaatctag

SEQ ID NO: 90130 - DNA, 588 bp, Artificial Sequence
  Description of Artificial Sequence: Synthetic coding sequence
atggcccccaagaagcccgagcccaagaaggacgacgccaaggccgcccccaaggccgcccccgcccccgcccccccccccgagcccgagagacccaaggaggtggagttcgacgccagcaagatcaagatcgagttcacccccgagcagatcgaggagttcaaggaggccttcatgctgttcgacagaacccccaagtgcgagatgaagatcacctacggccagtgcggcgacgtgctgagagccctgggccagaaccccacccaggccgaggtgctgagagtgctgggcaagcccagacaggaggagctgaacaccaagatgatggacttcgagaccttcctgcccatgctgcagcacatcagcaagaacaaggacaccggcacctacgaggacttcgtggagggcctgagagtgttcgacaaggagggcaacggcaccgtgatgggcgccgagctgagacacgtgctggccaccctgggcgagagactgaccgaggacgaggtggagaagctgatggccggccaggaggacagcaacggctgcatcaactacgaggccttcgtgaagcacatcatgagcagctag

SEQ ID NO: 90131 - DNA, 588 bp, Artificial Sequence; identical to SEQ ID NO: 90130
  Description of Artificial Sequence: Synthetic coding sequence

SEQ ID NO: 90132 - DNA, 141 bp, Artificial Sequence
  Description of Artificial Sequence: Synthetic coding sequence
atggcccccaagaagcccgagcccaagaaggacgacgccaaggccgcccccaaggccgcccccgcccccgcccccccccccgagcccgagagacccaaggaggtggagttcgacgccagcaagatcaagatcgagttctag

SEQ ID NO: 90133 - DNA, 594 bp, Artificial Sequence
  Description of Artificial Sequence: Synthetic coding sequence
atggcccccaagaagcccgagcccaagaaggaggccgccaagcccgcccccgcccccgcccccgcccccgcccccgcccccgcccccgcccccgaggcccccaaggagcccgccttcgaccccaagagcgtgaagatcgacttcaccgccgaccagatcgaggagttcaaggaggccttcagcctgttcgacagaacccccaccggcgagatgaagatcacctacggccagtgcggcgacgtgctgagagccctgggccagaaccccaccaacgccgaggtgctgagagtgctgggcaagcccaagcccgaggagatgaacgtgaagatgctggacttcgagaccttcctgcccatcctgcagcacatcagcagaaacaaggagcagggcacctacgaggacttcgtggagggcctgagagtgttcgacaaggagagcaacggcaccgtgatgggcgccgagctgagacacgtgctggccaccctgggcgagaagatgaccgaggccgaggtggagcagctgctggccggccaggaggacgccaacggctgcatcaactacgaggccttcgtgaagcacatcatgagcggctag

SEQ ID NO: 90134 - DNA, 594 bp, Artificial Sequence; identical to SEQ ID NO: 90133
  Description of Artificial Sequence: Synthetic coding sequence

SEQ ID NO: 90135 - DNA, 264 bp, Artificial Sequence
  Description of Artificial Sequence: Synthetic coding sequence
cccgaggcccccaaggagcccgccttcgaccccaagagcgtgaaggtgatcggctgcccctgccccagaagccagagccacggcgccgtgatcgacttcaccgccgaccagatcgaggagttcaaggaggccttcatgggcgccgagctgagacacgtgctggccaccctggtgatcaagagcgcccccccccccaagcccaccgccggcgagaagatgaccgaggccgaggtggagcagctgctggccggccaggaggactag

SEQ ID NO: 90136 - DNA, 522 bp, Artificial Sequence
  Description of Artificial Sequence: Synthetic coding sequence
atggccagcagaaagaccaagaagaaggagggcggcgccctgagagcccagagagccagcagcaacgtgttcagcaacttcgagcagacccagatccaggagttcaaggaggccttcaccctgatggaccagaacagagacggcttcatcgacaaggaggacctgaaggacacctacgccagcctgggcaagaccaacgtgaaggacgacgagctggacgccatgctgaaggaggccagcggccccatcaacttcaccatgttcctgaacctgttcggcgagaagctgagcggcaccgacgccgaggagaccatcctgaacgccttcaagatgctggaccccgacggcaagggcaagatcaacaaggagtacatcaagagactgctgatgagccaggccgacaagatgaccgccgaggaggtggaccagatgttccagttcgccagcatcgacgtggccggcaacctggactacaaggccctgagctacgtgatcacccacggcgaggagaaggaggagtag

SEQ ID NO: 90137 - DNA, 399 bp, Artificial Sequence
  Description of Artificial Sequence: Synthetic coding sequence
atggaccagaacagagacggcttcatcgacaaggaggacctgaaggacacctacgccagcctgggcaagaccaacgtgaaggacgacgagctggacgccatgctgaaggaggccagcggccccatcaacttcaccatgttcctgaacctgttcggcgagaagctgagcggcaccgacgccgaggagaccatcctgaacgccttcaagatgctggaccccgacggcaagggcaagatcaacaaggagtacatcaagagactgctgatgagccaggccgacaagatgaccgccgaggaggtggaccagatgttccagttcgccagcatcgacgtggccggcaacctggactacaaggccctgagctacgtgatcacccacggcgaggagaaggaggagtag

SEQ ID NO: 90138 - DNA, 399 bp, Artificial Sequence; identical to SEQ ID NO: 90137
  Description of Artificial Sequence: Synthetic coding sequence

SEQ ID NO: 90139 - DNA, 399 bp, Artificial Sequence; identical to SEQ ID NO: 90137
  Description of Artificial Sequence: Synthetic coding sequence

SEQ ID NO: 90140 - DNA, 456 bp, Artificial Sequence
  Description of Artificial Sequence: Synthetic coding sequence
atgtgcgacttcaccgaggaccagaccgccgagttcaaggaggccttccagctgttcgacagaaccggcgacggcaagatcctgtacagccagtgcggcgacgtgatgagagccctgggccagaaccccaccaacgccgaggtgctgaaggtgctgggcaaccccaagagcgacgagatgaacgtgaaggtgctggacttcgagcacttcctgcccatgctgcagaccgtggccaagaacaaggaccagggcacctacgaggactacgtggagggcctgagagtgttcgacaaggagggcaacggcaccgtgatgggcgccgagatcagacacgtgctggtgaccctgggcgagaagatgaccgaggaggaggtggagatgctggtggccggccacgaggacagcaacggctgcatcaactacgaggagctggtgagaatggtgctgaacggctag

SEQ ID NO: 90141 - DNA, 456 bp, Artificial Sequence
  Description of Artificial Sequence: Synthetic coding sequence
atgtgcgacttcaccgaggaccagaccgccgagttcaaggaggccttccagctgttcgacagaaccggcgacggcaagatcctgtacagccagtgcggcgacgtgatgagagccctgggccagaaccccaccaacgccgaggtgctgaaggtgctgggcaaccccaagagcgacgagatgaacgtgaaggtgctggacttcgagcacttcctgcccatgctgcagaccgtggccaagaacaaggaccagggcacctacgaggactacgtggagggcctgagagtgttcgacaaggagggcaacggcaccgtgatgggcgccgagatcagacacgtgctggtgaccctgggcgagaagatgaccgaggaggaggtggagatgctggtggccggccacgaggacagcaacggctgcatcaactacgaggccttcgtgagacacatcctgagcggctag

SEQ ID NO: 90142 - DNA, 456 bp, Artificial Sequence; identical to SEQ ID NO: 90141
  Description of Artificial Sequence: Synthetic coding sequence

SEQ ID NO: 90143 - DNA, 1491 bp, Artificial Sequence
  Description of Artificial Sequence: Synthetic coding sequence
atgagcagcatggaggagatccaggtggagctgcagtgcgccgacctgtggaagagattccacgacatcggcaccgagatgatcatcaccaaggccggcagaagaatgttccccgccatgagagtgaagatcaccggcctggacccccaccagcagtactacatcgccatggacatcgtgcccgtggacaacaagagatacagatacgtgtaccacagcagcaagtggatggtggccggcaacgccgacagccccgtgccccccagagtgtacatccaccccgacagcctggccagcggcgacacctggatgagacaggtggtgagcttcgacaagctgaagctgaccaacaacgagctggacgaccagggccacatcatcctgcacagcatgcacaagtaccagcccagagtgcacgtgatcagaaaggacttcagcagcgacctgagccccaccaagcccgtgcccgtgggcgacggcgtgaagaccttcaacttccccgagaccgtgttcaccaccgtgaccgcctaccagaaccagcagatcaccagactgaagatcgacagaaaccccttcgccaagggcttcagagacagcggcagaaacagaaccggcctggaggccatcatggagacctacgccttctggagaccccccgtgagaaccctgaccttcgaggacttcaccaccatgcagaagcagcagggcggcagcaccggcaccagccccaccaccagcagcaccggcacccccagccccagcgccagcagccacctgctgagccccagctgcagcccccccaccttccacctggcccccaacaccttcaacgtgggctgcagagagagccagctgtgcaacctgaacctgagcgactaccccccctgcgccagaagcaacatggccgccctgcagagctaccccggcctgagcgacagcggctacaacagactgcagagcggcaccaccagcgccacccagcccagcgagaccttcatgccccagagaacccccagcctgatcagcggcatccccaccccccccagcctgcccggcaacagcaagatggaggcctacggcggccagctgggcagcttccccaccagccagttccagtacgtgatgcaggccggcaacgccgccagcagcagcagcagcccccacatgttcggcggcagccacatgcagcagagcagctacaacgccttcagcctgcacaacccctacaacctgtacggctacaacttccccaccagccccagactggccgccagccccgagaagctgagcgccagccagagcaccctgctgtgcagcagccccagcaacggcgccttcggcgagagacagtacctgcccagcggcatggagcacagcatgcacatgatcagccccagccccaacaaccagcaggccaccaacacctgcgacggcagacagtacggcgccgtgcccggcagcagcagccagatgagcgtgcacatggtgtag

SEQ ID NO: 90144 - DNA, 627 bp, Artificial Sequence
  Description of Artificial Sequence: Synthetic coding sequence
atgccccccaagaaggacgtgcccgtgaagaagcccgccggccccagcatcagcaagcccgccgccaagcccgccgccgccggcgccccccccgccaagaccaaggccgagcccgccgtgccccaggccccccagaagacccaggagccccccgtggacctgagcaaggtggtgatcgagttcaacaaggaccagctggaggagttcaaggaggccttcgagctgttcgacagagtgggcgacggcaagatcctgtacagccagtgcggcgacgtgatgagagccctgggccagaaccccaccaacgccgaggtgctgaaggtgctgggcaaccccaagagcgacgagctgaagagcagaagagtggacttcgagaccttcctgcccatgctgcaggccgtggccaagaacagaggccagggcacctacgaggactacctggagggcttcagagtgttcgacaaggagggcaacggcaaggtgatgggcgccgagctgagacacgtgctgaccaccctgggcgagaagatgaccgaggaggaggtggagaccgtgctggccggccacgaggacagcaacggctgcatcaactacgaggccttcctgaagcacatcctgagcgtgtag

SEQ ID NO: 90145 - DNA, 90 bp, Artificial Sequence
  Description of Artificial Sequence: Synthetic coding sequence
atgccccccaagaaggacgtgcccgtgaagaagcccgccggccccagcatcagcaagcccgccgccaagcccgccgccgccggcgcctag

SEQ ID NO: 90146 - DNA, 627 bp, Artificial Sequence; identical to SEQ ID NO: 90144
  Description of Artificial Sequence: Synthetic coding sequence

SEQ ID NO: 90147 - DNA, 3477 bp, Artificial Sequence
  Description of Artificial Sequence: Synthetic coding sequence
atggccgccgtgagaggcgcccccctgctgagctgcctgctggccctgctggccctgtgccccggcggcagaccccagaccgtgctgaccgacgacgagatcgaggagttcctggagggcttcctgagcgagctggagcccgagcccagagaggacgacgtggaggccccccccccccccgagcccacccccagagtgagaaaggcccaggccggcggcaagcccggcaagagacccggcaccgccgccgaggtgccccccgagaagaccaaggacaagggcaagaagggcaagaaggacaagggccccaaggtgcccaaggagagcctggagggcagccccagaccccccaagaagggcaaggagaagccccccaaggccaccaagaagcccaaggagaagccccccaaggccaccaagaagcccaaggagaagccccccaaggccaccaagaagcccaaggagaagccccccaaggccaccaagaagccccccagcggcaagagaccccccatcctggcccccagcgagaccctggagtggcccctgccccccccccccagccccggccccgaggagctgccccaggagggcggcgcccccctgagcaacaactggcagaaccccggcgaggagacccacgtggaggccagagagcaccagcccgagcccgaggaggagaccgagcagcccaccctggactacaacgaccagatcgagagagaggactacgaggacttcgagtacatcagaagacagaagcagcccagacccccccccagcagaagaagaagacccgagagagtgtggcccgagccccccgaggagaaggcccccgcccccgcccccgaggagagaatcgagccccccgtgaagcccctgctgccccccctgccccccgactacggcgacggctacgtgatccccaactacgacgacatggactactacttcggccccccccccccccagaagcccgacgccgagagacagaccgacgaggagaaggaggagctgaagaagcccaagaaggaggacagcagccccaaggaggagaccgacaagtgggccgtggagaagggcaaggaccacaaggagcccagaaagggcgaggagctggaggaggagtggacccccaccgagaaggtgaagtgcccccccatcggcatggagagccacagaatcgaggacaaccagatcagagccagcagcatgctgagacacggcctgggcgcccagagaggcagactgaacatgcagaccggcgccaccgaggacgactactacgacggcgcctggtgcgccgaggacgacgccagaacccagtggatcgaggtggacaccagaagaaccaccagattcaccggcgtgatcacccagggcagagacagcagcatccacgacgacttcgtgaccaccttcttcgtgggcttcagcaacgacagccagacctgggtgatgtacaccaacggctacgaggagatgaccttccacggcaacgtggacaaggacacccccgtgctgagcgagctgcccgagcccgtggtggccagattcatcagaatctaccccctgacctggaacggcagcctgtgcatgagactggaggtgctgggctgcagcgtggcccccgtgtacagctactacgcccagaacgaggtggtggccaccgacgacctggacttcagacaccacagctacaaggacatgagacagctgatgaaggtggtgaacgaggagtgccccaccatcaccagaacctacagcctgggcaagagcagcagaggcctgaagatctacgccatggagatcagcgacaaccccggcgagcacgagctgggcgagcccgagttcagatacaccgccggcatccacggcaacgaggtgctgggcagagagctgctgctgctgctgatgcagtacctgtgcagagagtacagagacggcaaccccagagtgagaagcctggtgcaggacaccagaatccacctggtgcccagcctgaaccccgacggctacgaggtggccgcccagatgggcagcgagttcggcaactgggccctgggcctgtggaccgaggagggcttcgacatcttcgaggacttccccgacctgaacagcgtgctgtggggcgccgaggagagaaagtgggtgccctacagagtgcccaacaacaacctgcccatccccgagagatacctgagccccgacgccaccgtgagcaccgaggtgagagccatcatcgcctggatggagaagaaccccttcgtgctgggcgccaacctgaacggcggcgagagactggtgagctacccctacgacatggccagaacccccacccaggagcagctgctggccgccgccatggccgccgccagaggcgaggacgaggacgaggtgagcgaggcccaggagacccccgaccacgccatcttcagatggctggccatcagcttcgccagcgcccacctgaccctgaccgagccctacagaggcggctgccaggcccaggactacaccggcggcatgggcatcgtgaacggcgccaagtggaaccccagaaccggcaccatcaacgacttcagctacctgcacaccaactgcctggagctgagcttctacctgggctgcgacaagttcccccacgagagcgagctgcccagagagtgggagaacaacaaggaggccctgctgaccttcatggagcaggtgcacagaggcatcaagggcgtggtgaccgacgagcagggcatccccatcgccaacgccaccatcagcgtgagcggcatcaaccacggcgtgaagaccgccagcggcggcgactactggagaatcctgaaccccggcgagtacagagtgaccgcccacgccgagggctacacccccagcgccaagacctgcaacgtggactacgacatcggcgccacccagtgcaacttcatcctggccagaagcaactggaagagaatcagagagatcatggccatgaacggcaacagacccatcccccacatcgaccccagcagacccatgaccccccagcagagaagactgcagcagagaagactgcagcacagactgagactgagagcccagatgagactgagaagactgaacgccaccaccaccctgggcccccacaccgtgccccccaccctgccccccgcccccgccaccaccctgagcaccaccatcgagccctggggcctgatcccccccaccaccgccggctgggaggagagcgagaccgagacctacaccgaggtggtgaccgagttcggcaccgaggtggagcccgagttcggcaccaaggtggagcccgagttcgagacccagctggagcccgagttcgagacccagctggagcccgagttcgaggaggaggaggaggaggagaaggaggaggagatcgccaccggccaggccttccccttcaccaccgtggagacctacaccgtgaacttcggcgacttctag

SEQ ID NO: 90148 - DNA, 447 bp, Artificial Sequence
  Description of Artificial Sequence: Synthetic coding sequence
atgttcgagcaggcccagatccaggagttcaaggaggccttcagctgcatcgaccagaacagagacggcatcatctgcaaggccgacctgagagagacctacagccagctgggcaaggtgagcgtgcccgaggaggagctggacgccatgctgcaggagggcaagggccccatcaacttcaccgtgttcctgaccctgttcggcgagaagctgaacggcaccgaccccgaggaggccatcctgagcgccttcagaatgttcgaccccagcggcaagggcgtggtgaacaaggacgagttcaagcagctgctgctgacccaggccgacaagttcagccccgccgaggtggagcagatgttcgccctgacccccatggacctggccggcaacatcgactacaagagcctgtgctacatcatcacccacggcgacgagaaggaggagtag

SEQ ID NO: 90149 - DNA, 1128 bp, Artificial Sequence
  Description of Artificial Sequence: Synthetic coding sequence
atgcagaagctgcagctgtgcgtgtacatctacctgttcatgctgatcgtggccggccccgtggacctgaacgagaacagcgagcagaaggagaacgtggagaaggagggcctgtgcaacgcctgcacctggagacagaacaccaagagcagcagaatcgaggccatcaagatccagatcctgagcaagctgagactggagaccgcccccaacatcagcaaggacgtgatcagacagctgctgcccaaggccccccccctgagagagctgatcgaccagtacgacgtgcagagagacgacagcagcgacggcagcctggaggacgacgactaccacgccaccaccgagaccatcatcaccatgcccaccgagagcgacttcctgatgcaggtggacggcaagcccaagtgctgcttcttcaagttcagcagcaagatccagtacaacaaggtggtgaaggcccagctgtggatctacctgagacccgtggagacccccaccaccgtgttcgtgcagatcctgagactgatcaagcccatgaaggacggcaccagatacaccggcatcagaagcctgaagctggacatgaaccccggcaccggcatctggcagagcatcgacgtgaagaccgtgctgcagaactggctgaagcagcccgagagcaacctgggcatcgagatcaaggccctggacgagaacggccacgacctggccgtgaccttccccggccccggcgaggacggcctgaaccccttcctggaggtgaaggtgaccgacacccccaagagaagcagaagagacttcggcctggactgcgacgagcacagcaccgagagcagatgctgcagataccccctgaccgtggacttcgaggccttcggctgggactggatcatcgcccccaagagatacaaggccaactactgcagcggcgagtgcgagttcgtgttcctgcagaagtacccccacacccacctggtgcaccaggccaaccccagaggcagcgccggcccctgctgcacccccaccaagatgagccccatcaacatgctgtacttcaacggcaaggagcagatcatctacggcaagatccccgccatggtggtggacagatgcggctgcagctag

SEQ ID NO: 90150 - DNA, 1497 bp, Artificial Sequence
  Description of Artificial Sequence: Synthetic coding sequence
atgttcaactacgagagacccaagcacttcatccagagccagaacccctgcggcagcagactgcagccccccggccccgagaccagcagcttcagcagccagaccaagcagagcagcatcatcatccagcccagacagtgcaccgagcagagattcagcgccagcagcaccctgagcagccacatcaccatgagcagcagcgccttccccgccagccccaagcagcacgccggcagcaaccccggccagagagtgaccaccacctacaaccagagccccgccagcttcctgagcagcatcctgcccagccagcccgactacaacagcagcaagatccccagcgccatggacagcaactaccagcagagcagcgccggccagcccatcaacgccaagcccagccagaccgccaacgccaagcccatccccagaacccccgaccacgagatccagggcagcaaggaggccctgatccaggacctggagagaaagctgaagtgcaaggacaccctgctgcacaacggcaaccagagactgacctacgaggagaagatggccagaagactgctgggcccccagaacgccgccgccgtgttccaggcccaggacgacagcggcgcccaggacagccagcagcacaacagcgagcacgccagactgcaggtgcccaccagccaggtgagaagcagaagcaccagcagaggcgacgtgaacgaccaggacgccatccaggagaagttctacccccccagattcatccaggtgcccgagaacatgagcatcgacgagggcagattctgcagaatggacttcaaggtgagcggcctgcccgcccccgacgtgagctggtacctgaacggcagaaccgtgcagagcgacgacctgcacaagatgatcgtgagcgagaagggcctgcacagcctgatcttcgaggtggtgagagccagcgacgccggcgcctacgcctgcgtggccaagaacagagccggcgaggccaccttcaccgtgcagctggacgtgctggccaaggagcacaagagagcccccatgttcatctacaagccccagagcaagaaggtgctggagggcgacagcgtgaagctggagtgccagatcagcgccatccccccccccaagctgttctggaagagaaacaacgagatggtgcagttcaacaccgacagaatcagcctgtaccaggacaacaccggcagagtgaccctgctgatcaaggacgtgaacaagaaggacgccggctggtacaccgtgagcgccgtgaacgaggccggcgtgaccacctgcaacaccagactggacgtgaccgccagacccaaccagaccctgcccgcccccaagcagctgagagtgagacccaccttcagcaagtacctggccctgaacggcaagggcctgaacgtgaagcaggccttcaaccccgagggcgagttccagagactggccgcccagagcggcctgtacgagagcgaggagctgtag

SEQ ID NO: 90151 - DNA, 945 bp, Artificial Sequence
  Description of Artificial Sequence: Synthetic coding sequence
atggccagaagactgctgggcccccagaacgccgccgccgtgttccaggcccaggacgacagcggcgcccaggacagccagcagcacaacagcgagcacgccagactgcaggtgcccaccagccaggtgagaagcagaagcaccagcagaggcgacgtgaacgaccaggacgccatccaggagaagttctacccccccagattcatccaggtgcccgagaacatgagcatcgacgagggcagattctgcagaatggacttcaaggtgagcggcctgcccgcccccgacgtgagctggtacctgaacggcagaaccgtgcagagcgacgacctgcacaagatgatcgtgagcgagaagggcctgcacagcctgatcttcgaggtggtgagagccagcgacgccggcgcctacgcctgcgtggccaagaacagagccggcgaggccaccttcaccgtgcagctggacgtgctggccaaggagcacaagagagcccccatgttcatctacaagccccagagcaagaaggtgctggagggcgacagcgtgaagctggagtgccagatcagcgccatccccccccccaagctgttctggaagagaaacaacgagatggtgcagttcaacaccgacagaatcagcctgtaccaggacaacaccggcagagtgaccctgctgatcaaggacgtgaacaagaaggacgccggctggtacaccgtgagcgccgtgaacgaggccggcgtgaccacctgcaacaccagactggacgtgaccgccagacccaaccagaccctgcccgcccccaagcagctgagagtgagacccaccttcagcaagtacctggccctgaacggcaagggcctgaacgtgaagcaggccttcaaccccgagggcgagttccagagactggccgcccagagcggcctgtacgagagcgaggagctgtag

SEQ ID NO: 90152 - DNA, 357 bp, Artificial Sequence
  Description of Artificial Sequence: Synthetic coding sequence
atgtgcgacaaggagttcatgtgggccctgaagaacggcgacctggacgaggtgaaggactacgtggccaagggcgaggacgtgaacagaaccctggagggcggcagaaagcccctgcactacgccgccgactgcggccagctggagatcctggagttcctgctgctgaagggcgccgacatcaacgcccccgacaagcaccacatcacccccctgctgagcgccgtgtacgagggccacgtgagctgcgtgaagctgctgctgagcaagggcgccgacaagaccgtgaagggccccgacggcctgaccgccttcgaggccaccgacaaccaggccatcaaggccctgctgcagtag

SEQ ID NO: 90153 - DNA, 1812 bp, Artificial Sequence
  Description of Artificial Sequence: Synthetic coding sequence
atggccagcgccagcaccagcaagtacaacagccacagcctggagaacgagagcatcaagagaaccagcagagacggcgtgaacagagacctgaccgaggccgtgcccagactgcccggcgagaccctgatcaccgacaaggaggtgatctacatctgccccttcaacggccccatcaagggcagagtgtacatcaccaactacagactgtacctgagaagcctggagaccgacagcagcctgatcctggacgtgcccctgggcgtgatcagcagaatcgagaagatgggcggcgccaccagcagaggcgagaacagctacggcctggacatcacctgcaaggacatgagaaacctgagattcgccctgaagcaggagggccacagcagaagagacatgttcgagatcctgaccagatacgccttccccctggcccacagcctgcccctgttcgccttcctgaacgaggagaagttcaacgtggacggctggaccgtgtacaaccccgtggaggagtacagaagacagggcctgcccaaccaccactggagaatcaccttcatcaacaagtgctacgagctgtgcgacacctaccccgccctgctggtggtgccctacagagccagcgacgacgacctgagaagagtggccaccttcagaagcagaaacagaatccccgtgctgagctggatccaccccgagaacaagaccgtgatcgtgagatgcagccagcccctggtgggcatgagcggcaagagaaacaaggacgacgagaagtacctggacgtgatcagagagaccaacaagcagatcagcaagctgaccatctacgacgccagacccagcgtgaacgccgtggccaacaaggccaccggcggcggctacgagagcgacgacgcctaccacaacgccgagctgttcttcctggacatccacaacatccacgtgatgagagagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggacagaaccgcccagctgaccagcctggccatgctgatgctggacagcttctacagaagcatcgagggcttcgagatcctggtgcagaaggagtggatcagcttcggccacaagttcgccagcagaatcggccacggcgacaagaaccacaccgacgccgacagaagccccatcttcctgcagttcatcgactgcgtgtggcagatgagcaagcagttccccaccgccttcgagttcaacgagcagttcctgatcatcatcctggaccacctgtacagctgcagattcggcaccttcctgttcaactgcgagagcgccagagagagacagaaggtgaccgagagaaccgtgagcctgtggagcctgatcaacagcaacaaggagaagttcaagaaccccttctacaccaaggagatcaacagagtgctgtaccccgtggccagcatgagacacctggagctgtgggtgaactactacatcagatggaaccccagaatcaagcagcagcagcccaaccccgtggagcagagatacatggagctgctggccctgagagacgagtacatcaagagactggaggagctgcagctggccaacagcgccaagctgagcgacccccccaccagccccagcagccccagccagatgatgccccacgtgcagacccacttctag

SEQ ID NO: 90154 - DNA, 1701 bp, Artificial Sequence
  Description of Artificial Sequence: Synthetic coding sequence
atggccagcgccagcaccagcaagtacaacagccacagcctggagaacgagagcatcaagagaaccagcagagacggcgtgaacagagacctgaccgaggccgtgcccagactgcccggcgagaccctgatcaccgacaaggaggtgatctacatctgccccttcaacggccccatcaagggcagagtgtacatcaccaactacagactgtacctgagaagcctggagaccgacatgagaaacctgagattcgccctgaagcaggagggccacagcagaagagacatgttcgagatcctgaccagatacgccttccccctggcccacagcctgcccctgttcgccttcctgaacgaggagaagttcaacgtggacggctggaccgtgtacaaccccgtggaggagtacagaagacagggcctgcccaaccaccactggagaatcaccttcatcaacaagtgctacgagctgtgcgacacctaccccgccctgctggtggtgccctacagagccagcgacgacgacctgagaagagtggccaccttcagaagcagaaacagaatccccgtgctgagctggatccaccccgagaacaagaccgtgatcgtgagatgcagccagcccctggtgggcatgagcggcaagagaaacaaggacgacgagaagtacctggacgtgatcagagagaccaacaagcagatcagcaagctgaccatctacgacgccagacccagcgtgaacgccgtggccaacaaggccaccggcggcggctacgagagcgacgacgcctaccacaacgccgagctgttcttcctggacatccacaacatccacgtgatgagagagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggacagaaccgcccagctgaccagcctggccatgctgatgctggacagcttctacagaagcatcgagggcttcgagatcctggtgcagaaggagtggatcagcttcggccacaagttcgccagcagaatcggccacggcgacaagaaccacaccgacgccgacagaagccccatcttcctgcagttcatcgactgcgtgtggcagatgagcaagcagttccccaccgccttcgagttcaacgagcagttcctgatcatcatcctggaccacctgtacagctgcagattcggcaccttcctgttcaactgcgagagcgccagagagagacagaaggtgaccgagagaaccgtgagcctgtggagcctgatcaacagcaacaaggagaagttcaagaaccccttctacaccaaggagatcaacagagtgctgtaccccgtggccagcatgagacacctggagctgtgggtgaactactacatcagatggaaccccagaatcaagcagcagcagcccaaccccgtggagcagagatacatggagctgctggccctgagagacgagtacatcaagagactggaggagctgcagctggccaacagcgccaagctgagcgacccccccaccagccccagcagccccagccagatgatgccccacgtgcagacccacttctag

SEQ ID NO: 90155 - DNA, 1251 bp, Artificial Sequence
  Description of Artificial Sequence: Synthetic coding sequence
atgggcggcgccaccagcagaggcgagaacagctacggcctggacatcacctgcaaggacatgagaaacctgagattcgccctgaagcaggagggccacagcagaagagacatgttcgagatcctgaccagatacgccttccccctggcccacagcctgcccctgttcgccttcctgaacgaggagaagttcaacgtggacggctggaccgtgtacaaccccgtggaggagtacagaagacagggcctgcccaaccaccactggagaatcaccttcatcaacaagtgctacgagctgtgcgacacctaccccgccctgctggtggtgccctacagagccagcgacgacgacctgagaagagtggccaccttcagaagcagaaacagaatccccgtgctgagctggatccaccccgagaacaagaccgtgatcgtgagatgcagccagcccctggtgggcatgagcggcaagagaaacaaggacgacgagaagtacctggacgtgatcagagagaccaacaagcagatcagcaagctgaccatctacgacgccagacccagcgtgaacgccgtggccaacaaggccaccggcggcggctacgagagcgacgacgcctaccacaacgccgagctgttcttcctggacatccacaacatccacgtgatgagagagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggacagaaccgcccagctgaccagcctggccatgctgatgctggacagcttctacagaagcatcgagggcttcgagatcctggtgcagaaggagtggatcagcttcggccacaagttcgccagcagaatcggccacggcgacaagaaccacaccgacgccgacagaagccccatcttcctgcagttcatcgactgcgtgtggcagatgagcaagcagttccccaccgccttcgagttcaacgagcagttcctgatcatcatcctggaccacctgtacagctgcagattcggcaccttcctgttcaactgcgagagcgccagagagagacaggccctgcacttcctgagcctgagcctgtgcagaagactgcagaagggcctgttcctgtacggccactag

SEQ ID NO: 90156 - DNA, 1467 bp, Artificial Sequence
  Description of Artificial Sequence: Synthetic coding sequence
atgagaaacctgagattcgccctgaagcaggagggccacagcagaagagacatgttcgagatcctgaccagatacgccttccccctggcccacagcctgcccctgttcgccttcctgaacgaggagaagttcaacgtggacggctggaccgtgtacaaccccgtggaggagtacagaagacagggcctgcccaaccaccactggagaatcaccttcatcaacaagtgctacgagctgtgcgacacctaccccgccctgctggtggtgccctacagagccagcgacgacgacctgagaagagtggccaccttcagaagcagaaacagaatccccgtgctgagctggatccaccccgagaacaagaccgtgatcgtgagatgcagccagcccctggtgggcatgagcggcaagagaaacaaggacgacgagaagtacctggacgtgatcagagagaccaacaagcagatcagcaagctgaccatctacgacgccagacccagcgtgaacgccgtggccaacaaggccaccggcggcggctacgagagcgacgacgcctaccacaacgccgagctgttcttcctggacatccacaacatccacgtgatgagagagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggacagaaccgcccagctgaccagcctggccatgctgatgctggacagcttctacagaagcatcgagggcttcgagatcctggtgcagaaggagtggatcagcttcggccacaagttcgccagcagaatcggccacggcgacaagaaccacaccgacgccgacagaagccccatcttcctgcagttcatcgactgcgtgtggcagatgagcaagcagttccccaccgccttcgagttcaacgagcagttcctgatcatcatcctggaccacctgtacagctgcagattcggcaccttcctgttcaactgcgagagcgccagagagagacagaaggtgaccgagagaaccgtgagcctgtggagcctgatcaacagcaacaaggagaagttcaagaaccccttctacaccaaggagatcaacagagtgctgtaccccgtggccagcatgagacacctggagctgtgggtgaactactacatcagatggaaccccagaatcaagcagcagcagcccaaccccgtggagcagagatacatggagctgctggccctgagagacgagtacatcaagagactggaggagctgcagctggccaacagcgccaagctgagcgacccccccaccagccccagcagccccagccagatgatgccccacgtgcagacccacttctag

SEQ ID NO: 90157 - DNA, 1998 bp, Artificial Sequence
  Description of Artificial Sequence: Synthetic coding sequence
atggacagacccgccgccgccgccgccgccggctgcgagggcggcggcggccccaaccccggccccgccggcggcagaagaccccccagagccgccggcggcgccaccgccggcagcagacagcccagcgtggagaccctggacagccccaccggcagccacgtggagtggtgcaagcagctgatcgccgccaccatcagcagccagatcagcggcagcgtgaccagcgagaacgtgagcagagactacaaggccctgagagacggcaacaagctggcccagatggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagaccaagggcggcggctacgagagcgagagcgcctaccccaacgccgagctggtgttcctggagatccacaacatccacgtgatgagagagagcctgagaaagctgaaggagatcgtgtaccccagcatcgacgaggccagatggctgagcaacgtggacggcacccactggctggagtacatcagaatgctgctggccggcgccgtgagaatcgccgacaagatcgagagcggcaagaccagcgtggtggtgcactgcagcgacggctgggacagaaccgcccagctgaccagcctggccatgctgatgctggacagctactacagaaccatcaagggcttcgagaccctggtggagaaggagtggatcagcttcggccacagattcgccctgagagtgggccacggcaacgacaaccacgccgacgccgacagaagccccatcttcctgcagttcgtggactgcgtgtggcagatgaccagacagttccccagcgccttcgagttcaacgagctgttcctgatcaccatcctggaccacctgtacagctgcctgttcggcaccttcctgtgcaactgcgagcagcagagattcaaggaggacgtgtacaccaagaccatcagcctgtggagctacatcaacagccagctggacgagttcagcaaccccttcttcgtgaactacgagaaccacgtgctgtaccccgtggccagcctgagccacctggagctgtgggtgaactactacgtgagatggaaccccagaatgagaccccagatgcccatccaccagaacctgaaggagctgctggccgtgagagccgagctgcagaagagagtggagggcctgcagagagaggtggccaccagagccgtgagcagcagcagcgagagaggcagcagccccagccacagcgccaccagcgtgcacaccagcgtgtag

SEQ ID NO: 90158 - DNA, 264 bp, Artificial Sequence
  Description of Artificial Sequence: Synthetic coding sequence
atggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaactag

SEQ ID NO: 90159 - DNA, 264 bp, Artificial Sequence; identical to SEQ ID NO: 90158
  Description of Artificial Sequence: Synthetic coding sequence

SEQ ID NO: 90160 - DNA, 273 bp, Artificial Sequence
  Description of Artificial Sequence: Synthetic coding sequence
atggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactgtag

SEQ ID NO: 90161 - DNA, 2022 bp, Artificial Sequence
  Description of Artificial Sequence: Synthetic coding sequence
atggacagacccgccgccgccgccgccgccggctgcgagggcggcggcggccccaaccccggccccgccggcggcagaagaccccccagagccgccggcggcgccaccgccggcagcagacagcccagcgtggagaccctggacagccccaccggcagccacgtggagtggtgcaagcagctgatcgccgccaccatcagcagccagatcagcggcagcgtgaccagcgagaacgtgagcagagactacaaggtgttcagaagacccgacctgagagccctgagagacggcaacaagctggcccagatggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagaccaagggcggcggctacgagagcgagagcgcctaccccaacgccgagctggtgttcctggagatccacaacatccacgtgatgagagagagcctgagaaagctgaaggagatcgtgtaccccagcatcgacgaggccagatggctgagcaacgtggacggcacccactggctggagtacatcagaatgctgctggccggcgccgtgagaatcgccgacaagatcgagagcggcaagaccagcgtggtggtgcactgcagcgacggctgggacagaaccgcccagctgaccagcctggccatgctgatgctggacagctactacagaaccatcaagggcttcgagaccctggtggagaaggagtggatcagcttcggccacagattcgccctgagagtgggccacggcaacgacaaccacgccgacgccgacagaagccccatcttcctgcagttcgtggactgcgtgtggcagatgaccagacagttccccagcgccttcgagttcaacgagctgttcctgatcaccatcctggaccacctgtacagctgcctgttcggcaccttcctgtgcaactgcgagcagcagagattcaaggaggacgtgtacaccaagaccatcagcctgtggagctacatcaacagccagctggacgagttcagcaaccccttcttcgtgaactacgagaaccacgtgctgtaccccgtggccagcctgagccacctggagctgtgggtgaactactacgtgagatggaaccccagaatgagaccccagatgcccatccaccagaacctgaaggagctgctggccgtgagagccgagctgcagaagagagtggagggcctgcagagagaggtggccaccagagccgtgagcagcagcagcgagagaggcagcagccccagccacagcgccaccagcgtgcacaccagcgtgtag

SEQ ID NO: 90162 - DNA, 1707 bp, Artificial Sequence
  Description of Artificial Sequence: Synthetic coding sequence
atggacagacccgccgccgccgccgccgccggctgcgagggcggcggcggccccaaccccggccccgccggcggcagaagaccccccagagccgccggcggcgccaccgccggcagcagacagcccagcgtggagaccctggacagccccaccggcagccacgtggagtggtgcaagcagctgatcgccgccaccatcagcagccagatcagcggcagcgtgaccagcgagaacgtgagcagagactacaaggccctgagagacggcaacaagctggcccagatggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagaccaagggcggcggctacgagagcgagagcgcctaccccaacgccgagctggtgttcctggagatccacaacatccacgtgatgagagagagcctgagaaagctgaaggagatcgtgtaccccagcatcgacgaggccagatggctgagcaacgtggacggcacccactggctggagtacatcagaatgctgctggccggcgccgtgagaatcgccgacaagatcgagagcggcaagaccagcgtggtggtgcactgcagcgacggctgggacagaaccgcccagctgaccagcctggccatgctgatgctggacagctactacagaaccatcaagggcttcgagaccctggtggagaaggagtggatcagcttcggccacagattcgccctgagagtgggccacggcaacgacaaccacgccgacgccgacagaagccccatcttcctgcagttcgtggactgcgtgtggcagatgaccagacagttccccagcgccttcgagttcaacgagctgttcctgatcaccatcctggaccacctgtacagctgcctgttcggcaccttcctgtgcaactgcgagcagcagagattcaaggaggcctggggcgccggcacccagagagccagaggcagcctgagaagcagatag

SEQ ID NO: 90163 - DNA, 444 bp, Artificial Sequence
  Description of Artificial Sequence: Synthetic coding sequence
atggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgtag

SEQ ID NO: 90164 - DNA, 1182 bp, Artificial Sequence
  Description of Artificial Sequence: Synthetic coding sequence
atgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagatgctgctggccggcgccgtgagaatcgccgacaagatcgagagcggcaagaccagcgtggtggtgcactgcagcgacggctgggacagaaccgcccagctgaccagcctggccatgctgatgctggacagctactacagaaccatcaagggcttcgagaccctggtggagaaggagtggatcagcttcggccacagattcgccctgagagtgggccacggcaacgacaaccacgccgacgccgacagaagccccatcttcctgcagttcgtggactgcgtgtggcagatgaccagacagttccccagcgccttcgagttcaacgagctgttcctgatcaccatcctggaccacctgtacagctgcctgttcggcaccttcctgtgcaactgcgagcagcagagattcaaggaggcctggggcgccggcacccagagagccagaggcagcctgagaagcagatag

SEQ ID NO: 90165 - DNA, 1716 bp, Artificial Sequence
  Description of Artificial Sequence: Synthetic coding sequence
atggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagaccaagggcggcggctacgagagcgagagcgcctaccccaacgccgagctggtgttcctggagatccacaacatccacgtgatgagagagagcctgagaaagctgaaggagatcgtgtaccccagcatcgacgaggccagatggctgagcaacgtggacggcacccactggctggagtacatcagaatgctgctggccggcgccgtgagaatcgccgacaagatcgagagcggcaagaccagcgtggtggtgcactgcagcgacggctgggacagaaccgcccagctgaccagcctggccatgctgatgctggacagctactacagaaccatcaagggcttcgagaccctggtggagaaggagtggatcagcttcggccacagattcgccctgagagtgggccacggcaacgacaaccacgccgacgccgacagaagccccatcttcctgcagttcgtggactgcgtgtggcagatgaccagacagttccccagcgccttcgagttcaacgagctgttcctgatcaccatcctggaccacctgtacagctgcctgttcggcaccttcctgtgcaactgcgagcagcagagattcaaggaggacgtgtacaccaagaccatcagcctgtggagctacatcaacagccagctggacgagttcagcaaccccttcttcgtgaactacgagaaccacgtgctgtaccccgtggccagcctgagccacctggagctgtgggtgaactactacgtgagatggaaccccagaatgagaccccagatgcccatccaccagaacctgaaggagctgctggccgtgagagccgagctgcagaagagagtggagggcctgcagagagaggtggccaccagagccgtgagcagcagcagcgagagaggcagcagccccagccacagcgccaccagcgtgcacaccagcgtgtag

SEQ ID NO: 90166 - DNA, 1092 bp, Artificial Sequence
  Description of Artificial Sequence: Synthetic coding sequence
atggacagacccgccgccgccgccgccgccggctgcgagggcggcggcggccccaaccccggccccgccggcggcagaagaccccccagagccgccggcggcgccaccgccggcagcagacagcccagcgtggagaccctggacagccccaccggcagccacgtggagtggtgcaagcagctgatcgccgccaccatcagcagccagatcagcggcagcgtgaccagcgagaacgtgagcagagactacaaggccctgagagacggcaacaagctggcccagatggaggaggcccccctgttccccggcgagagcatcaaggccatcgtgaaggacgtgatgtacatctgccccttcatgggcgccgtgagcggcaccctgaccgtgaccgacttcaagctgtacttcaagaacgtggagagagacccccacttcatcctggacgtgcccctgggcgtgatcagcagagtggagaagatcggcgcccagagccacggcgacaacagctgcggcatcgagatcgtgtgcaaggacatgagaaacctgagactggcctacaagcaggaggagcagagcaagctgggcatcttcgagaacctgaacaagcacgccttccccctgagcaacggccaggccctgttcgccttcagctacaaggagaagttccccatcaacggctggaaggtgtacgaccccgtgagcgagtacaagagacagggcctgcccaacgagagctggaagatcagcaagatcaacagcaactacgagttctgcgacacctaccccgccatcatcgtggtgcccaccagcgtgaaggacgacgacctgagcaaggtggccgccttcagagccaagggcagagtgcccgtgctgagctggatccaccccgagagccaggccaccatcaccagatgcagccagcccctggtgggccccaacgacaagagatgcaaggaggacgagaagtacctgcagaccatcatggacgccaacgcccagagccacaagctgatcatcttcgacgccagacagaacagcgtggccgacaccaacaagctgtggtaccaggacaccgccagcctgatggagtag

SEQ ID NO: 90167 - DNA, 1998 bp, Artificial Sequence; identical to SEQ ID NO: 90157
  Description of Artificial Sequence: Synthetic coding sequence

SEQ ID NO: 90168 - DNA, 1914 bp, Artificial Sequence
  Description of Artificial Sequence: Synthetic coding sequence
atgctgggcaagggcgtggtgggcggcggcggcggcaccaaggcccccaagcccagcttcgtgagctacgtgagacccgaggagatccacaccaacgagaaggaggtgaccgagaaggaggtgaccctgcacctgctgcccggcgagcagctgctgtgcgaggccagcaccgtgctgaagtacgtgcaggaggacagctgccagcacggcgtgtacggcagactggtgtgcaccgacttcaagatcgccttcctgggcgacgacgagagcgccctggacaacgacgagacccagttcaagaacaaggtgatcggcgagaacgacatcaccctgcactgcgtggaccagatctacggcgtgttcgacgagaagaagaagaccctgttcggccagctgaagaagtaccccgagaagctgatcatccactgcaaggacctgagagtgttccagttctgcctgagatacaccaaggaggaggaggtgaagagaatcgtgagcggcatcatccaccacacccaggcccccaagctgctgaagagactgttcctgttcagctacgccaccgccgcccagaacaacaccgtgaccgaccccaagaaccacaccgtgatgttcgacaccctgaaggactggtgctgggagctggagagaaccaagggcaacatgaagtacaaggccgtgagcgtgaacgagggctacaaggtgtgcgagagactgcccgcctacttcgtggtgcccacccccctgcccgaggagaacgtgcagagattccagggccacggcatccccatctggtgctggagctgccacaacggcagcgccctgctgaagatgagcgccctgcccaaggagcaggacgacggcatcctgcagatccagaagagcttcctggacggcatctacaagaccatccacagacccccctacgagatcgtgaagaccgaggacctgagcagcaacttcctgagcctgcaggagatccagaccgcctacagcaagttcaagcagctgttcctgatcgacaacagcaccgagttctgggacaccgacatcaagtggttcagcctgctggagagcagcagctggctggacatcatcagaagatgcctgaagaaggccatcgagatcaccgagtgcatggaggcccagaacatgaacgtgctgctgctggaggagaacgccagcgacctgtgctgcctgatcagcagcctggtgcagctgatgatggacccccactgcagaaccagaatcggcttccagagcctgatccagaaggagtgggtgatgggcggccactgcttcctggacagatgcaaccacctgagacagaacgacaaggaggagcaccagagacagctgagcctgcccctgacccagagcaagagcagccccaagagaggcttcttcagagaggagaccgaccacctgatcaagaacctgctgggcaagagaatcagcaagctgatcaacagcagcgacgagctgcaggacaacttcagagagttctacgacagctggcacagcaagagcaccgactaccacggcctgctgctgccccacatcgagggccccgagatcaaggtgtgggcccagagatacctgagatggatccccgaggcccagatcctgggcggcggccaggtggccaccctgagcaagctgctggagatgatggaggaggtgcagagcctgcaggagaagatcgacgagagacaccacagccagcaggccccccaggccgaggccccctgcctgctgagaaacagcgccagactgagcagcctgttccccttcgccctgctgcagagacacagcagcaagcccgtgctgcccaccagcggctggaaggccctgggcgacgaggacgacctggccaagagagaggacgagttcgtggacctgggcgacgtgtag

SEQ ID NO: 90169 - DNA, 2082 bp, Artificial Sequence
  Description of Artificial Sequence: Synthetic coding sequence
atgctgggcaagggcgtggtgggcggcggcggcggcaccaaggcccccaagcccagcttcgtgagctacgtgagacccgaggagatccacaccaacgagaaggaggtgaccgagaaggaggtgaccctgcacctgctgcccggcgagcagctgctgtgcgaggccagcaccgtgctgaagtacgtgcaggaggacagctgccagcacggcgtgtacggcagactggtgtgcaccgacttcaagatcgccttcctgggcgacgacgagagcgccctggacaacgacgagacccagttcaagaacaaggtgatcggcgagaacgacatcaccctgcactgcgtggaccagatctacggcgtgttcgacgagaagaagaagaccctgttcggccagctgaagaagtaccccgagaagctgatcatccactgcaaggacctgagagtgttccagttctgcctgagatacaccaaggaggaggaggtgaagagaatcgtgagcggcatcatccaccacacccaggcccccaagctgctgaagagactgttcctgttcagctacgccaccgccgcccagaacaacaccgtgaccgaccccaagaaccacaccgtgatgttcgacaccctgaaggactggtgctgggagctggagagaaccaagggcaacatgaagtacaaggccgtgagcgtgaacgagggctacaaggtgtgcgagagactgcccgcctacttcgtggtgcccacccccctgcccgaggagaacgtgcagagattccagggccacggcatccccatctggtgctggagctgccacaacggcagcgccctgctgaagatgagcgccctgcccaaggagcaggacgacggcatcctgcagatccagaagagcttcctggacggcatctacaagaccatccacagacccccctacgagatcgtgaagaccgaggacctgagcagcaacttcctgagcctgcaggagatccagaccgcctacagcaagttcaagcagctgttcctgatcgacaacagcaccgagttctgggacaccgacatcaagtggttcagcctgctggagagcagcagctggctggacatcatcagaagatgcctgaagaaggccatcgagatcaccgagtgcatggaggcccagaacatgaacgtgctgctgctggaggagaacgccagcgacctgtgctgcctgatcagcagcctggtgcagctgatgatggacccccactgcagaaccagaatcggcttccagagcctgatccagaaggagtgggtgatgggcggccactgcttcctggacagatgcaaccacctgagacagaacgacaaggaggaggtgcccgtgttcctgctgttcctggactgcgtgtggcagctggtgcaccagcacccccccgccttcgagttcaccgagacctacctgaccgtgctgagcgacagcctgtacatccccatcttcagcaccttcttcttcaacagcccccaccagaaggacaccaacatgcaccagagacagctgagcctgcccctgacccagagcaagagcagccccaagagaggcttcttcagagaggagaccgaccacctgatcaagaacctgctgggcaagagaatcagcaagctgatcaacagcagcgacgagctgcaggacaacttcagagagttctacgacagctggcacagcaagagcaccgactaccacggcctgctgctgccccacatcgagggccccgagatcaaggtgtgggcccagagatacctgagatggatccccgaggcccagatcctgggcggcggccaggtggccaccctgagcaagctgctggagatgatggaggaggtgcagagcctgcaggagaagatcgacgagagacaccacagccagcaggccccccaggccgaggccccctgcctgctgagaaacagcgccagactgagcagcctgttccccttcgccctgctgcagagacacagcagcaagcccgtgctgcccaccagcggctggaaggccctgggcgacgaggacgacctggccaagagagaggacgagttcgtggacctgggcgacgtgtag

SEQ ID NO: 90170 - DNA, 2244 bp, Artificial Sequence
  Description of Artificial Sequence: Synthetic coding sequence
atgctgggcaagggcgtggtgggcggcggcggcggcaccaaggcccccaagcccagcttcgtgagctacgtgagacccgaggagatccacaccaacgagaaggaggtgaccgagaaggaggtgaccctgcacctgctgcccggcgagcagctgctgtgcgaggccagcaccgtgctgaagtacgtgcaggaggacagctgccagcacggcgtgtacggcagactggtgtgcaccgacttcaagatcgccttcctgggcgacgacgagagcgccctggacaacgacgagacccagttcaagaacaaggtgatcggcgagaacgacatcaccctgcactgcgtggaccagatctacggcgtgttcgacgagaagaagaagaccctgttcggccagctgaagaagtaccccgagaagctgatcatccactgcaaggacctgagagtgttccagttctgcctgagatacaccaaggaggaggaggtgaagagaatcgtgagcggcatcatccaccacacccaggcccccaagctgctgaagagactgttcctgttcagctacgccaccgccgcccagaacaacaccgtgaccgaccccaagaaccacaccgtgatgttcgacaccctgaaggactggtgctgggagctggagagaaccaagggcaacatgaagtacaaggccgtgagcgtgaacgagggctacaaggtgtgcgagagactgcccgcctacttcgtggtgcccacccccctgcccgaggagaacgtgcagagattccagggccacggcatccccatctggtgctggagctgccacaacggcagcgccctgctgaagatgagcgccctgcccaaggagcaggacgacggcatcctgcagatccagaagagcttcctggacggcatctacaagaccatccacagacccccctacgagatcgtgaagaccgaggacctgagcagcaacttcctgagcctgcaggagatccagaccgcctacagcaagttcaagcagctgttcctgatcgacaacagcaccgagttctgggacaccgacatcaagtggttcagcctgctggagagcagcagctggctggacatcatcagaagatgcctgaagaaggccatcgagatcaccgagtgcatggaggcccagaacatgaacgtgctgctgctggaggagaacgccagcgacctgtgctgcctgatcagcagcctggtgcagctgatgatggacccccactgcagaaccagaatcggcttccagagcctgatccagaaggagtgggtgatgggcggccactgcttcctggacagatgcaaccacctgagacagaacgacaaggaggaggtgcccgtgttcctgctgttcctggactgcgtgtggcagctggtgcaccagcacccccccgccttcgagttcaccgagacctacctgaccgtgctgagcgacagcctgtacatccccatcttcagcaccttcttcttcaacagcccccaccagaaggacaccaacatgggcagagagggccaggacacccagagcaagcccctgaacctgctgaccgtgtgggactggagcgtgcagttcgagcccaaggcccagaccctgctgaagaaccccctgtacgtggagaagcccaagctggacaagggccagagaaagggcatgagattcaagcaccagagacagctgagcctgcccctgacccagagcaagagcagccccaagagaggcttcttcagagaggagaccgaccacctgatcaagaacctgctgggcaagagaatcagcaagctgatcaacagcagcgacgagctgcaggacaacttcagagagttctacgacagctggcacagcaagagcaccgactaccacggcctgctgctgccccacatcgagggccccgagatcaaggtgtgggcccagagatacctgagatggatccccgaggcccagatcctgggcggcggccaggtggccaccctgagcaagctgctggagatgatggaggaggtgcagagcctgcaggagaagatcgacgagagacaccacagccagcaggccccccaggccgaggccccctgcctgctgagaaacagcgccagactgagcagcctgttccccttcgccctgctgcagagacacagcagcaagcccgtgctgcccaccagcggctggaaggccctgggcgacgaggacgacctggccaagagagaggacgagttcgtggacctgggcgacgtgtag

SEQ ID NO: 90171 - DNA, 1953 bp, Artificial Sequence
  Description of Artificial Sequence: Synthetic coding sequence
atggccggcgccagagccgccgccgccgccgccagcgccggcagcagcgccagcagcggcaaccagcccccccaggagctgggcctgggcgagctgctggaggagttcagcagaacccagtacagagccaaggacggcagcggcaccggcggcagcaaggtggagagaatcgagaagagatgcctggagctgttcggcagagactactgcttcagcgtgatccccaacaccaacggcgacatctgcggccactaccccagacacatcgtgttcctggagtacgagagcagcgagaaggagaaggacaccttcgagagcaccgtgcaggtgagcaagctgcaggacctgatccacagaagcaagatggccagatgcagaggcagattcgtgtgccccgtgatcctgttcaagggcaagcacatctgcagaagcgccaccctggccggctggggcgagctgtacggcagaagcggctacaactacttcttcagcggcggcgccgacgacgcctgggccgacgtggaggacgtgaccgaggaggactgcgccctgagaagcggcgacacccacctgttcgacaaggtgagaggctacgacatcaagctgctgagatacctgagcgtgaagtacatctgcgacctgatggtggagaacaagaaggtgaagttcggcatgaacgtgaccagcagcgagaaggtggacaaggcccagagatacgccgacttcaccctgctgagcatcccctaccccggctgcgagttcttcaaggagtacaaggacagagactacatggccgagggcctgatcttcaactggaagcaggactacgtggacgcccccctgagcatccccgacttcctgacccacagcctgaacatcgactggagccagtaccagtgctgggacctggtgcagcagacccagaactacctgaagctgctgctgagcctggtgaacagcgacgacgacagcggcctgctggtgcactgcatcagcggctgggacagaacccccctgttcatcagcctgctgagactgagcctgtgggccgacggcctgatccacaccagcctgaagcccaccgagatcctgtacctgaccgtggcctacgactggttcctgttcggccacatgctggtggacagactgagcaagggcgaggagatcttcttcttctgcttcaacttcctgaagcacatcaccagcgaggagttcagcgccctgaagacccagagaagaaagagcctgcccgccagagacggcggcttcaccctggaggacatctgcatgctgagaagaaaggacagaggcagcaccaccagcctgggcagcgacttcagcctggtgatggagagcagccccggcgccaccggcagcttcacctacgaggccgtggagctggtgcccgccggcgcccccacccaggccgcctggagaaagagccacagcagcagcccccagagcgtgctgtggaacagaccccagcccagcgaggacagactgcccagccagcagggcctggccgaggccagaagcagcagcagcagcagcagcaaccacagcgacaacttcttcagaatgggcagcagccccctggaggtgcccaagcccagaagcgtggaccaccccctgcccggcagcagcctgagcaccgactacggcagctggcagatggtgaccggctgcggcagcatccaggagagagccgtgctgcacaccgacagcagcctgcccttcagcttccccgacgagctgcccaacagctgcctgctggccgccctgagcgacagagagaccagactgcaggaggtgagaagcgccttcctggccgcctacagcagcaccgtgggcctgagagccgtggcccccagccccagcggcgccatcggcggcctgctggagcagttcgccagaggcgtgggcctgagaagcatcagcagcaacgccctgtag

SEQ ID NO: 90172 - DNA, 1617 bp, Artificial Sequence
  Description of Artificial Sequence: Synthetic coding sequence
atggccggcgccagagccgccgccgccgccgccagcgccggcagcagcgccagcagcggcaaccagcccccccaggagctgggcctgggcgagctgctggaggagttcagcagaacccagtacagagccaaggacggcagcggcaccggcggcagcaaggtggagagaatcgagaagagatgcctggagctgttcggcagagactactgcttcagcgtgatccccaacaccaacggcgacatctgcggccactaccccagacacatcgtgttcctggagtacgagagcagcgagaaggagaaggacaccttcgagagcaccgtgcaggtgagcaagctgcaggacctgatccacagaagcaagatggccagatgcagaggcagattcgtgtgccccgtgatcctgttcaagggcaagcacatctgcagaagcgccaccctggccggctggggcgagctgtacggcagaagcggctacaactacttcttcagcggcggcgccgacgacgcctgggccgacgtggaggacgtgaccgaggaggactgcgccctgagaagcggcgacacccacctgttcgacaaggtgagaggctacgacatcaagctgctgagatacctgagcgtgaagtacatctgcgacctgatggtggagaacaagaaggtgaagttcggcatgaacgtgaccagcagcgagaaggtggacaaggcccagagatacgccgacttcaccctgctgagcatcccctaccccggctgcgagttcttcaaggagtacaaggacagagactacatggccgagggcctgatcttcaactggaagcaggactacgtggacgcccccctgagcatccccgacttcctgacccacagcctgaacatcgactggagccagtaccagtgctgggacctggtgcagcagacccagaactacctgaagctgctgctgagcctggtgaacagcgacgacgacagcggcctgctggtgcactgcatcagcggctgggacagaacccccctgttcatcagcctgctgagactgagcctgtgggccgacggcctgatccacaccagcctgaagcccaccgagatcctgtacctgaccgtggcctacgactggttcctgttcggccacatgctggtggacagactgagcaagggcgaggagatcttcttcttctgcttcaacttcctgaagcacatcaccagcgaggagttcagcgccctgaagacccagagaagaaagagcctgcccgccagagacggcggcttcaccctggaggacatctgcatgctgagaagaaaggacagaggcagcaccaccagcctgggcagcgacttcagcctggtgatggagagcagccccggcgccaccggcagcttcacctacgaggccgtggagctggtgcccgccggcgcccccacccaggccgcctggctggccgccctgagcgacagagagaccagactgcaggaggtgagaagcgccttcctggccgcctacagcagcaccgtgggcctgagagccgtggcccccagccccagcggcgccatcggcggcctgctggagcagttcgccagaggcgtgggcctgagaagcatcagcagcaacgccctgtag

SEQ ID NO: 90173 - DNA, 1797 bp, Artificial Sequence
  Description of Artificial Sequence: Synthetic coding sequence
atggccggcgccagagccgccgccgccgccgccagcgccggcagcagcgccagcagcggcaaccagcccccccaggagctgggcctgggcgagctgctggaggagttcagcagaacccagtacagagccaaggacggcagcggcaccggcggcagcaaggtggagagaatcgagaagagatgcctggagctgttcggcagagactactgcttcagcgtgatccccaacaccaacggcgacatctgcggccactaccccagacacatcgtgttcctggagtacgagagcagcgagaaggagaaggacaccttcgagagcaccgtgcaggtgagcaagctgcaggacctgatccacagaagcaagatggccagatgcagaggcagattcgtgtgccccgtgatcctgttcaagggcaagcacatctgcagaagcgccaccctggccggctggggcgagctgtacggcagaagcggctacaactacttcttcagcggcggcgccgacgacgcctgggccgacgtggaggacgtgaccgaggaggactgcgccctgagaagcggcgacacccacctgttcgacaaggtgagaggctacgacatcaagctgctgagatacctgagcgtgaagtacatctgcgacctgatggtggagaacaagaaggtgaagttcggcatgaacgtgaccagcagcgagaaggtggacaaggcccagagatacgccgacttcaccctgctgagcatcccctaccccggctgcgagttcttcaaggagtacaaggacagagactacatggccgagggcctgatcttcaactggaagcaggactacgtggacgcccccctgagcatccccgacttcctgacccacagcctgaacatcgactggagccagtaccagtgctgggacctggtgcagcagacccagaactacctgaagctgctgctgagcctggtgaacagcgacgacgacagcggcctgctggtgcactgcatcagcggctgggacagaacccccctgttcatcagcctgctgagactgagcctgtgggccgacggcctgatccacaccagcctgaagcccaccgagatcctgtacctgaccgtggcctacgactggttcctgttcggccacatgctggtggacagactgagcaagggcgaggagatcttcttcttctgcttcaacttcctgaagcacatcaccagcgaggagttcagcgccctgaagacccagagaagaaagagcctgcccgccagagacggcggcttcaccctggaggacatctgcatgctgagaagaaaggacagaggcagcaccaccagcctgggcagcgacttcagcctggtgatggagagcagccccggcgccaccggcagcttcacctacgaggccgtggagctggtgcccgccggcgcccccacccaggccgcctggagaaagagccacagcagcagcccccagagcgtgctgtggaacagaccccagcccagcgaggacagactgcccagccagcagggcctggccgaggccagaagcagcagcagcagcagcagcaaccacagcgacaacttcttcagaatgggcagcagccccctggaggtgcccaagcccagactggccgccctgagcgacagagagaccagactgcaggaggtgagaagcgccttcctggccgcctacagcagcaccgtgggcctgagagccgtggcccccagccccagcggcgccatcggcggcctgctggagcagttcgccagaggcgtgggcctgagaagcatcagcagcaacgccctgtag

SEQ ID NO: 90174 - DNA, 1563 bp, Artificial Sequence
  Description of Artificial Sequence: Synthetic coding sequence
atggccggcgccagagccgccgccgccgccgccagcgccggcagcagcgccagcagcggcaaccagcccccccaggagctgggcctgggcgagctgctggaggagttcagcagaacccagtacagagccaaggacggcagcggcaccggcggcagcaaggtggagagaatcgagaagagatgcctggagctgttcggcagagactactgcttcagcgtgatccccaacaccaacggcgacatctgcggccactaccccagacacatcgtgttcctggagtacgagagcagcgagaaggagaaggacaccttcgagagcaccgtgcaggtgagcaagctgcaggacctgatccacagaagcaagatggccagatgcagaggcagattcgtgtgccccgtgatcctgttcaagggcaagcacatctgcagaagcgccaccctggccggctggggcgagctgtacggcagaagcggctacaactacttcttcagcggcggcgccgacgacgcctgggccgacgtggaggacgtgaccgaggaggactgcgccctgagaagcggcgacacccacctgttcgacaaggtgagaggctacgacatcaagctgctgagatacctgagcgtgaagtacatctgcgacctgatggtggagaacaagaaggtgaagttcggcatgaacgtgaccagcagcgagaaggtggacaaggcccagagatacgccgacttcaccctgctgagcatcccctaccccggctgcgagttcttcaaggagtacaaggacagagactacatggccgagggcctgatcttcaactggaagcaggactacgtggacgcccccctgagcatccccgacttcctgacccacagcctgaacatcgactggagccagtaccagtgctgggacctggtgcagcagacccagaactacctgaagctgctgctgagcctggtgaacagcgacgacgacagcggcctgctggtgcactgcatcagcggctgggacagaacccccctgttcatcagcctgctgagactgagcctgtgggccgacggcctgatccacaccagcctgaagcccaccgagatcctgtacctgaccgtggcctacgactggttcctgttcggccacatgctggtggacagactgagcaagggcgaggagatcttcttcttctgcttcaacttcctgaagcacatcaccagcgaggagttcagcgccctgaagacccagagaagaaagagcctgcccgccagagacggcggcttcaccctggaggacatctgcatgctgagaagaaaggacagaggcagcaccaccagcctgggcagcgacttcagcctggtgatggagagcagccccggcgccaccggcagcttcacctacgagagaggcgccggccccagcagaagcgccaacagcggcagcctggaggaggagcccctgatcctgagcaccgagtgccccctggagcccgccaccaccctgagaggccccctggccttccccgccggcgccggcggcagccaggtgttccagctgctgttcctgaagcccttctag

SEQ ID NO: 90175 - DNA, 1932 bp, Artificial Sequence
  Description of Artificial Sequence: Synthetic coding sequence
atggagaagagcagcagctgcgagagcctgggcagccagcccgccgccgccagaccccccagcgtggacagcctgagcagcgccagcaccagccacagcgagaacagcgtgcacaccaagagcgccagcgtggtgagcagcgacagcatcagcaccagcgccgacaacttcagccccgacctgagagtgctgagagagagcaacaagctggccgagatggaggagccccccctgctgcccggcgagaacatcaaggacatggccaaggacgtgacctacatctgccccttcaccggcgccgtgagaggcaccctgaccgtgaccaactacagactgtacttcaagagcatggagagagacccccccttcgtgctggacgccagcctgggcgtgatcaacagagtggagaagatcggcggcgccagcagcagaggcgagaacagctacggcctggagaccgtgtgcaaggacatcagaaacctgagattcgcccacaagcccgagggcagaaccagaagaagcatcttcgagaacctgatgaagtacgccttccccgtgagcaacaacctgcccctgttcgccttcgagtacaaggaggtgttccccgagaacggctggaagctgtacgaccccctgctggagtacagaagacagggcatccccaacgagagctggagaatcaccaagatcaacgagagatacgagctgtgcgacacctaccccgccctgctggtggtgcccgccaacatccccgacgaggagctgaagagagtggccagcttcagaagcagaggcagaatccccgtgctgagctggatccaccccgagagccaggccaccatcaccagatgcagccagcccatggtgggcgtgagcggcaagagaagcaaggaggacgagaagtacctgcaggccatcatggacagcaacgcccagagccacaagatcttcatcttcgacgccagacccagcgtgaacgccgtggccaacaaggccaagggcggcggctacgagagcgaggacgcctaccagaacgccgagctggtgttcctggacatccacaacatccacgtgatgagagagagcctgagaaagctgaaggagatcgtgtaccccaacatcgaggagacccactggctgagcaacctggagagcacccactggctggagcacatcaagctgatcctggccggcgccctgagaatcgccgacaaggtggagagcggcaagaccagcgtggtggtgcactgcagcgacggctgggacagaaccgcccagctgaccagcctggccatgctgatgctggacggctactacagaaccatcagaggcttcgaggtgctggtggagaaggagtggctgagcttcggccacagattccagctgagagtgggccacggcgacaagaaccacgccgacgccgacagaagccccgtgttcctgcagttcatcgactgcgtgtggcagatgaccagacagttccccaccgccttcgagttcaacgagtacttcctgatcaccatcctggaccacctgtacagctgcctgttcggcaccttcctgtgcaacagcgagcagcagagaggcaaggagaacctgcccaagagaaccgtgagcctgtggagctacatcaacagccagctggaggacttcaccaaccccctgtacggcagctacagcaaccacgtgctgtaccccgtggccagcatgagacacctggagctgtgggtgggctactacatcagatggaaccccagaatgaagccccaggagcccatccacaacagatacaaggagctgctggccaagagagccgagctgcagaagaaggtggaggagctgcagagagagatcagcaacagaagcaccagcagcagcgagagagccagcagccccgcccagtgcgtgacccccgtgcagaccgtggtgtag

SEQ ID NO: 90176 - DNA, 1716 bp, Artificial Sequence
  Description of Artificial Sequence: Synthetic coding sequence
atggaggagccccccctgctgcccggcgagaacatcaaggacatggccaaggacgtgacctacatctgccccttcaccggcgccgtgagaggcaccctgaccgtgaccaactacagactgtacttcaagagcatggagagagacccccccttcgtgctggacgccagcctgggcgtgatcaacagagtggagaagatcggcggcgccagcagcagaggcgagaacagctacggcctggagaccgtgtgcaaggacatcagaaacctgagattcgcccacaagcccgagggcagaaccagaagaagcatcttcgagaacctgatgaagtacgccttccccgtgagcaacaacctgcccctgttcgccttcgagtacaaggaggtgttccccgagaacggctggaagctgtacgaccccctgctggagtacagaagacagggcatccccaacgagagctggagaatcaccaagatcaacgagagatacgagctgtgcgacacctaccccgccctgctggtggtgcccgccaacatccccgacgaggagctgaagagagtggccagcttcagaagcagaggcagaatccccgtgctgagctggatccaccccgagagccaggccaccatcaccagatgcagccagcccatggtgggcgtgagcggcaagagaagcaaggaggacgagaagtacctgcaggccatcatggacagcaacgcccagagccacaagatcttcatcttcgacgccagacccagcgtgaacgccgtggccaacaaggccaagggcggcggctacgagagcgaggacgcctaccagaacgccgagctggtgttcctggacatccacaacatccacgtgatgagagagagcctgagaaagctgaaggagatcgtgtaccccaacatcgaggagacccactggctgagcaacctggagagcacccactggctggagcacatcaagctgatcctggccggcgccctgagaatcgccgacaaggtggagagcggcaagaccagcgtggtggtgcactgcagcgacggctgggacagaaccgcccagctgaccagcctggccatgctgatgctggacggctactacagaaccatcagaggcttcgaggtgctggtggagaaggagtggctgagcttcggccacagattccagctgagagtgggccacggcgacaagaaccacgccgacgccgacagaagccccgtgttcctgcagttcatcgactgcgtgtggcagatgaccagacagttccccaccgccttcgagttcaacgagtacttcctgatcaccatcctggaccacctgtacagctgcctgttcggcaccttcctgtgcaacagcgagcagcagagaggcaaggagaacctgcccaagagaaccgtgagcctgtggagctacatcaacagccagctggaggacttcaccaaccccctgtacggcagctacagcaaccacgtgctgtaccccgtggccagcatgagacacctggagctgtgggtgggctactacatcagatggaaccccagaatgaagccccaggagcccatccacaacagatacaaggagctgctggccaagagagccgagctgcagaagaaggtggaggagctgcagagagagatcagcaacagaagcaccagcagcagcgagagagccagcagccccgcccagtgcgtgacccccgtgcagaccgtggtgtag

SEQ ID NO: 90177 - DNA, 1716 bp, Artificial Sequence; identical to SEQ ID NO: 90176
  Description of Artificial Sequence: Synthetic coding sequence

SEQ ID NO: 90178 - DNA, 1716 bp, Artificial Sequence; identical to SEQ ID NO: 90176
  Description of Artificial Sequence: Synthetic coding sequence

SEQ ID NO: 90179 - DNA, 981 bp, Artificial Sequence
  Description of Artificial Sequence: Synthetic coding sequence
atgctggccgtggccctgaccatcctgagcgccagcaccagccacagcgagaacagcgtgcacaccaagagcgccagcgtggtgagcagcgacagcatcagcaccagcgccgacaacttcagccccgacctgagagtgctgagagagagcaacaagctggccgagatggaggagccccccctgctgcccggcgagaacatcaaggacatggccaaggacgtgacctacatctgccccttcaccggcgccgtgagaggcaccctgaccgtgaccaactacagactgtacttcaagagcatggagagagacccccccttcgtgctggacgccagcctgggcgtgatcaacagagtggagaagatcggcggcgccagcagcagaggcgagaacagctacggcctggagaccgtgtgcaaggacatcagaaacctgagattcgcccacaagcccgagggcagaaccagaagaagcatcttcgagaacctgatgaagtacgccttccccgtgagcaacaacctgcccctgttcgccttcgagtacaaggaggtgttccccgagaacggctggaagctgtacgaccccctgctggagtacagaagacagggcatccccaacgagagctggagaatcaccaagatcaacgagagatacgagctgtgcgacacctaccccgccctgctggtggtgcccgccaacatccccgacgaggagctgaagagagtggccagcttcagaagcagaggcagaatccccgtgctgagctggatccaccccgagagccaggccaccatcaccagatgcagccagcccatggtgggcgtgagcggcaagagaagcaaggaggacgagaagtacctgcaggccatcatggacagcaacgcccagagccacaagatcttcatcttcgacgccagacccagcgtgaacgccgtggccaacaaggccaagggcggcggctacgagagcgaggacgcctactag

SEQ ID NO: 90180 - DNA, 3513 bp, Artificial Sequence
  Description of Artificial Sequence: Synthetic coding sequence
atggacgaggagaccagacacagcctggagtgcatccaggccaaccagatcttccccagaaagcagctgatcagagaggacgagaacctgcaggtgcccttcctggagctgcacggcgagagcaccgagttcgtgggcagagccgaggacgccatcatcgccctgagcaactacagactgcacatcaagttcaaggagagcctggtgaacgtgcccctgcagctgatcgagagcgtggagtgcagagacatcttccagctgcacctgacctgcaaggactgcaaggtgatcagatgccagttcagcaccttcgagcagtgccaggagtggctgaagagactgaacaacgccatcagaccccccgccaagatcgaggacctgttcagcttcgcctaccacgcctggtgcatggaggtgtacgccagcgagaaggagcagcacggcgacctgtgcagacccggcgagcacgtgaccagcagattcaagaacgaggtggagagaatgggcttcgacatgaacaacgcctggagaatcagcaacatcaacgagaagtacaagctgtgcggcagctacccccaggagctgatcgtgcccgcctggatcaccgacaaggagctggagagcgtgagcagcttcagaagctggaagagaatccccgccgtgatctacagacaccagagcaacggcgccgtgatcgccagatgcggccagcccgaggtgagctggtggggctggagaaacgccgacgacgagcacctggtgcagagcgtggccaaggcctgcgccagcgacagcagaagcagcggcagcaagctgagcaccagaaacaccagcagagacttccccaacggcggcgacctgagcgacgtggagttcgacagcagcctgagcaacgccagcggcgccgagagcctggccatccagccccagaagctgctgatcctggacgccagaagctacgccgccgccgtggccaacagagccaagggcggcggctgcgagtgccccgagtactaccccaactgcgaggtggtgttcatgggcatggccaacatccacagcatcagaagaagcttccagagcctgagactgctgtgcacccagatgcccgaccccggcaactggctgagcgccctggagagcaccaagtggctgcaccacctgagcgtgctgctgaagagcgccctgctggtggtgcacgccgtggaccaggaccagagacccgtgctggtgcactgcagcgacggctgggacagaaccccccagatcgtggccctggccaagctgctgctggacccctactacagaaccatcgagggcttccaggtgctggtggagatggagtggctggacttcggccacaagttcgccgacagatgcggccacggcgagaacagcgacgacctgaacgagagatgccccgtgttcctgcagtggctggactgcgtgcaccagctgcagagacagttcccctgcagcttcgagttcaacgaggccttcctggtgaagctggtgcagcacacctacagctgcctgttcggcaccttcctgtgcaacaacgccaaggagagaggcgagaagcacacccaggagagaacctgcagcgtgtggagcctgctgagagccggcaacaaggccttcaagaacctgctgtacagcagccagagcgaggccgtgctgtaccccgtgtgccacgtgagaaacctgatgctgtggagcgccgtgtacctgccctgccccagccccaccacccccgtggacgacagctgcgccccctaccccgcccccggcaccagccccgacgacccccccctgagcagactgcccaagaccagaagctacgacaacctgaccaccgcctgcgacaacaccgtgcccctggccagcagaagatgcagcgaccccagcctgaacgagaagtggcaggagcacagaagaagcctggagctgagcagcctggccggccccggcgaggaccccctgagcgccgacagcctgggcaagcccaccagagtgcccggcggcgccgagctgagcgtggccgccggcgtggccgagggccagatggagaacatcctgcaggaggccaccaaggaggagagcggcgtggaggagcccgcccacagagccggcatcgagatccaggagggcaaggaggaccccctgctggagaaggagagcagaagaaagacccccgaggccagcgccatcggcctgcaccaggaccccgagctgggcgacgccgccctgagaagccacctggacatgagctggcccctgttcagccagggcatcagcgagcagcagagcggcctgagcgtgctgctgagcagcctgcaggtgccccccagaggcgaggacagcctggaggtgcccgtggagcagttcagaatcgaggagatcgccgagggcagagaggaggccgtgctgcccatccccgtggacgccaaggtgggctacggcaccagccagagctgcagcctgctgcccagccaggtgcccttcgagaccagaggccccaacgtggacagcagcaccgacatgctggtggaggacaaggtgaagagcgtgagcggcccccagggccaccacagaagctgcctggtgaacagcggcaaggacagactgccccagaccatggagcccagccccagcgagaccagcctggtggagagaccccaggtgggcagcgtggtgcacagaaccagcctgggcagcaccctgagcctgaccagaagcccctgcgccctgcccctggccgagtgcaaggagggcctggtgtgcaacggcgcccccgagaccgagaacagagccagcgagcagccccccggcctgagcaccctgcagatgtaccccacccccaacggccactgcgccaacggcgaggccggcagaagcaaggacagcctgagcagacagctgagcgccatgagctgcagcagcgcccacctgcacagcagaaacctgcaccacaagtggctgcacagccacagcggcagacccagcgccaccagcagccccgaccagcccagcagaagccacctggacgacgacggcatgagcgtgtacaccgacaccatccagcagagactgagacagatcgagagcggccaccagcaggaggtggagaccctgaagaagcaggtgcaggagctgaagagcagactggagagccagtacctgaccagcagcctgcacttcaacggcgacttcggcgacgaggtgatgaccagatggctgcccgaccacctggccgcccactgctacgcctgcgacagcgccttctggctggccagcagaaagcaccactgcagagacaccgacagagtggaccagacctggaactgcggcaacgtgttctgcagcagctgctgcaaccagaaggtgcccgtgcccagccagcagctgttcgagcccagcagagtgtgcaagagctgctacagcagcctgcaccccaccagcagcagcatcgacctggagctggacaagcccatcgccgccaccagcaactag

SEQ ID NO: 90181 - DNA, 3486 bp, Artificial Sequence
  Description of Artificial Sequence: Synthetic coding sequence
atggacgaggagaccagacacagcctggagtgcatccaggccaaccagatcttccccagaaagcagctgatcagagaggacgagaacctgcaggtgcccttcctggagctgcacggcgagagcaccgagttcgtgggcagagccgaggacgccatcatcgccctgagcaactacagactgcacatcaagttcaaggagagcctggtgaacgtgcccctgcagctgatcgagagcgtggagtgcagagacatcttccagctgcacctgacctgcaaggactgcaaggtgatcagatgccagttcagcaccttcgagcagtgccaggagtggctgaagagactgaacaacgccatcagaccccccgccaagatcgaggacctgttcagcttcgcctaccacgcctggtgcatggaggtgtacgccagcgagaaggagcagcacggcgacctgtgcagacccggcgagcacgtgaccagcagattcaagaacgaggtggagagaatgggcttcgacatgaacaacgcctggagaatcagcaacatcaacgagaagtacaagctgtgcggcagctacccccaggagctgatcgtgcccgcctggatcaccgacaaggagctggagagcgtgagcagcttcagaagctggaagagaatccccgccgtgatctacagacaccagagcaacggcgccgtgatcgccagatgcggccagcccgaggtgagctggtggggctggagaaacgccgacgacgagcacctggtgcagagcgtggccaaggcctgcgccagcgacagcagaagcagcggcagcaagctgagcaccagaaacaccagcagagacttccccaacggcggcgacctgagcgacgtggagttcgacagcagcctgagcaacgccagcggcgccgagagcctggccatccagccccagaagctgctgatcctggacgccagaagctacgccgccgccgtggccaacagagccaagggcggcggctgcgagtgccccgagtactaccccaactgcgaggtggtgttcatgggcatggccaacatccacagcatcagaagaagcttccagagcctgagactgctgtgcacccagatgcccgaccccggcaactggctgagcgccctggagagcaccaagtggctgcaccacctgagcgtgctgctgaagagcgccctgctggtggtgcacgccgtggaccaggaccagagacccgtgctggtgcactgcagcgacggctgggacagaaccccccagatcgtggccctggccaagctgctgctggacccctactacagaaccatcgagggcttccaggtgctggtggagatggagtggctggacttcggccacaagttcgccgacagatgcggccacggcgagaacagcgacgacctgaacgagagatgccccgtgttcctgcagtggctggactgcgtgcaccagctgcagagacagttcccctgcagcttcgagttcaacgaggccttcctggtgaagctggtgcagcacacctacagctgcctgttcggcaccttcctgtgcaacaacgccaaggagagaggcgagaagcacacccaggagagaacctgcagcgtgtggagcctgctgagagccggcaacaaggccttcaagaacctgctgtacagcagccagagcgaggccgtgctgtaccccgtgtgccacgtgagaaacctgatgctgtggagcgccgtgtacctgccctgccccagccccaccacccccgtggacgacagctgcgccccctaccccgcccccggcaccagccccgacgacccccccctgagcagactgcccaagaccagaagctacgacaacctgaccaccgcctgcgacaacaccgtgcccctggccagcagaagatgcagcgaccccagcctgaacgagaagtggcaggagcacagaagaagcctggagctgagcagcctggccggccccggcgaggaccccctgagcgccgacagcctgggcaagcccaccagagtgcccggcggcgccgagctgagcgtggccgccggcgtggccgagggccagatggagaacatcctgcaggaggccaccaaggaggagagcggcgtggaggagcccgcccacagagccggcatcgagatccaggagggcaaggaggaccccctgctggagaaggagagcagaagaaagacccccgaggccagcgccatcggcctgcaccaggaccccgagctgggcgacgccgccctgagaagccacctggacatgagctggcccctgttcagccagggcatcagcgagcagcagagcggcctgagcgtgctgctgagcagcctgcaggtgccccccagaggcgaggacagcctggaggtgcccgtggagcagttcagaatcgaggagatcgccgagggcagagaggaggccgtgctgcccatccccgtggacgccaaggtgggctacggcaccagccagagctgcagcctgctgcccagccaggtgcccttcgagaccagaggccccaacgtggacagcagcaccgacatgctggtggaggacaaggtgaagagcgtgagcggcccccagggccaccacagaagctgcctggtgaacagcggcaaggacagactgccccagaccatggagcccagccccagcgagaccagcctggtggagagaccccaggtgggcagcgtggtgcacagaaccagcctgggcagcaccctgagcctgaccagaagcccctgcgccctgcccctggccgagtgcaaggagggcctggtgtgcaacggcgcccccgagaccgagaacagagccagcgagcagccccccggcctgagcaccctgcagatgtaccccacccccaacggccactgcgccaacggcgaggccggcagaagcaaggacagcctgagcagacagctgagcgccatgagctgcagcagcgcccacctgcacagcagaaacctgcaccacaagtggctgcacagccacagcggcagacccagcgccaccagcagccccgaccagcccagcagaagccacctggacgacgacggcatgagcgtgtacaccgacaccatccagcagagactgagacagatcgagagcggccaccagcaggaggtggagaccctgaagaagcaggtgcaggagctgaagagcagactggagagccagtacctgaccagcagcctgcacttcaacggcgacttcggcgacgaggtgatgaccagatggctgcccgaccacctggccgcccactgctacgcctgcgacagcgccttctggctggccagcagaaagcaccactgcagaaactgcggcaacgtgttctgcagcagctgctgcaaccagaaggtgcccgtgcccagccagcagctgttcgagcccagcagagtgtgcaagagctgctacagcagcctgcaccccaccagcagcagcatcgacctggagctggacaagcccatcgccgccaccagcaactag

SEQ ID NO: 90182 - DNA, 3597 bp, Artificial Sequence
  Description of Artificial Sequence: Synthetic coding sequence
atggacgaggagaccagacacagcctggagtgcatccaggccaaccagatcttccccagaaagcagctgatcagagaggacgagaacctgcaggtgcccttcctggagctgcacggcgagagcaccgagttcgtgggcagagccgaggacgccatcatcgccctgagcaactacagactgcacatcaagttcaaggagagcctggtgaacgtgcccctgcagctgatcgagagcgtggagtgcagagacatcttccagctgcacctgacctgcaaggactgcaaggtgatcagatgccagttcagcaccttcgagcagtgccaggagtggctgaagagactgaacaacgccatcagaccccccgccaagatcgaggacctgttcagcttcgcctaccacgcctggtgcatggaggtgtacgccagcgagaaggagcagcacggcgacctgtgcagacccggcgagcacgtgaccagcagattcaagaacgaggtggagagaatgggcttcgacatgaacaacgcctggagaatcagcaacatcaacgagaagtacaagctgtgcggcagctacccccaggagctgatcgtgcccgcctggatcaccgacaaggagctggagagcgtgagcagcttcagaagctggaagagaatccccgccgtgatctacagacaccagagcaacggcgccgtgatcgccagatgcggccagcccgaggtgagctggtggggctggagaaacgccgacgacgagcacctggtgcagagcgtggccaaggcctgcgccagcgacagcagaagcagcggcagcaagctgagcaccagaaacaccagcagagacttccccaacggcggcgacctgagcgacgtggagttcgacagcagcctgagcaacgccagcggcgccgagagcctggccatccagccccagaagctgctgatcctggacgccagaagctacgccgccgccgtggccaacagagccaagggcggcggctgcgagtgccccgagtactaccccaactgcgaggtggtgttcatgggcatggccaacatccacagcatcagaagaagcttccagagcctgagactgctgtgcacccagatgcccgaccccggcaactggctgagcgccctggagagcaccaagtggctgcaccacctgagcgtgctgctgaagagcgccctgctggtggtgcacgccgtggaccaggaccagagacccgtgctggtgcactgcagcgacggctgggacagaaccccccagatcgtggccctggccaagctgctgctggacccctactacagaaccatcgagggcttccaggtgctggtggagatggagtggctggacttcggccacaagttcgccgacagatgcggccacggcgagaacagcgacgacctgaacgagagatgccccgtgttcctgcagtggctggactgcgtgcaccagctgcagagacagttcccctgcagcttcgagttcaacgaggccttcctggtgaagctggtgcagcacacctacagctgcctgttcggcaccttcctgtgcaacaacgccaaggagagaggcgagaagcacacccaggagagaacctgcagcgtgtggagcctgctgagagccggcaacaaggccttcaagaacctgctgtacagcagccagagcgaggccgtgctgtaccccgtgtgccacgtgagaaacctgatgctgtggagcgccgtgtacctgccctgccccagccccaccacccccgtggacgacagctgcgccccctaccccgcccccggcaccagccccgacgacccccccctgagcagactgcccaagaccagaagctacgacaacctgaccaccgcctgcgacaacaccgtgcccctggccagcagaagatgcagcgaccccagcctgaacgagaagtggcaggagcacagaagaagcctggagctgagcagcctggccggccccggcgaggaccccctgagcgccgacagcctgggcaagcccaccagagtgcccggcggcgccgagctgagcgtggccgccggcgtggccgagggccagatggagaacatcctgcaggaggccaccaaggaggagagcggcgtggaggagcccgcccacagagccggcatcgagatccaggagggcaaggaggaccccctgctggagaaggagagcagaagaaagacccccgaggccagcgccatcggcctgcaccaggaccccgagctgggcgacgccgccctgagaagccacctggacatgagctggcccctgttcagccagggcatcagcgagcagcagagcggcctgagcgtgctgctgagcagcctgcaggtgccccccagaggcgaggacagcctggaggtgcccgtggagcagttcagaatcgaggagatcgccgagggcagagaggaggccgtgctgcccatccccgtggacgccaaggtgggctacggcaccagccagagctgcagcctgctgcccagccaggtgcccttcgagaccagaggccccaacgtggacagcagcaccgacatgctggtggaggacaaggtgaagagcgtgagcggcccccagggccaccacagaagctgcctggtgaacagcggcaaggacagactgccccagaccatggagcccagccccagcgagaccagcctggtggagagaccccaggtgggcagcgtggtgcacagaaccagcctgggcagcaccctgagcctgaccagaagcccctgcgccctgcccctggccgagtgcaaggagggcctggtgtgcaacggcgcccccgagaccgagaacagagccagcgagcagccccccggcctgagcaccctgcagatgtaccccacccccaacggccactgcgccaacggcgaggccggcagaagcaaggacagcctgagcagacagctgagcgccatgagctgcagcagcgcccacctgcacagcagaaacctgcaccacaagtggctgcacagccacagcggcagacccagcgccaccagcagccccgaccagcccagcagaagccacctggacgacgacggcatgagcgtgtacaccgacaccatccagcagagactgagacagatcgagagcggccaccagcaggaggtggagaccctgaagaagcaggtgcaggagctgaagagcagactggagagccagtacctgaccagcagcctgcacttcaacggcgacttcggcgacgaggtgaccagcatccccgacagcgagagcaacctggaccagaactgcctgagcagatgcagcaccgagatcttcagcgaggccagctgggagcaggtggacaagcaggacaccgagatgaccagatggctgcccgaccacctggccgcccactgctacgcctgcgacagcgccttctggctggccagcagaaagcaccactgcagaaactgcggcaacgtgttctgcagcagctgctgcaaccagaaggtgcccgtgcccagccagcagctgttcgagcccagcagagtgtgcaagagctgctacagcagcctgcaccccaccagcagcagcatcgacctggagctggacaagcccatcgccgccaccagcaactag

SEQ ID NO: 90183 - DNA, 3513 bp, Artificial Sequence; identical to SEQ ID NO: 90180
  Description of Artificial Sequence: Synthetic coding sequence

SEQ ID NO: 90184 - DNA, 420 bp, Artificial Sequence
  Description of Artificial Sequence: Synthetic coding sequence
atggacgaggagaccagacacagcctggagtgcatccaggccaaccagatcttccccagaaagcagctgatcagagaggacgagaacctgcaggtgcccttcctggagctgcacggcgagagcaccgagttcgtgggcagagccgaggacgccatcatcgccctgagcaactacagactgcacatcaagttcaaggagagcctggtgaacgtgcccctgcagctgatcgagagcgtggagtgcagagacatcttccagctgcacctgacctgcaaggactgcaaggtgatcagatgccagttcagcaccttcgagcagtgccaggagtggctgaagagactgaacaacgccatcagaccccccgccaagatcgaggacctgttcagcttcgcctaccacgcctggtgcatggaggtgtag

SEQ ID NO: 90185 - DNA, 3588 bp, Artificial Sequence
  Description of Artificial Sequence: Synthetic coding sequence
atgggcgaggagggcccccccagcctggagtacatccaggccaaggacctgttcccccccaaggagctggtgaaggaggaggagaacctgcaggtgcccttcaccgtgctgcagggcgagggcgtggagttcctgggcagagccgccgacgccctgatcgccatcagcaactacagactgcacatcaagttcaaggacagcgtgatcaacgtgcccctgagaatgatcgacagcgtggagagcagagacatgttccagctgcacatcagctgcaaggacagcaaggtggtgagatgccacttcagcaccttcaagcagtgccaggagtggctgagcagactgagcagagccaccgccagacccgccaagcccgaggacctgttcgccttcgcctaccacgcctggtgcctgggcctgaccgaggaggaccagcacacccacctgtgccagcccggcgagcacatcagatgcagacaggaggccgagctggccagaatgggcttcgacctgcagaacgtgtggagagtgagccacatcaacagcaactacaagctgtgccccagctacccccagaagctgctggtgcccgtgtggatcaccgacaaggagctggagaacgtggccagcttcagaagctggaagagaatccccgtggtggtgtacagacacctgagaaacggcgccgccatcgccagatgcagccagcccgagatcagctggtggggctggagaaacgccgacgacgagtacctggtgaccagcatcgccaaggcctgcgccctggaccccggcaccagagccaccggcggcagcctgagcaccggcaacaacgacaccagcgaggcctgcgacgccgacttcgacagcagcctgaccgcctgcagcggcgtggagagcaccgccgccccccagaagctgctgatcctggacgccagaagctacaccgccgccgtggccaacagagccaagggcggcggctgcgagtgcgaggagtactaccccaactgcgaggtggtgttcatgggcatggccaacatccacgccatcagaaacagcttccagtacctgagagccgtgtgcagccagatgcccgaccccagcaactggctgagcgccctggagagcaccaagtggctgcagcacctgagcgtgatgctgaaggccgccgtgctggtggccaacaccgtggacagagagggcagacccgtgctggtgcactgcagcgacggctgggacagaaccccccagatcgtggccctggccaagatcctgctggacccctactacagaaccctggagggcttccaggtgctggtggagagcgactggctggacttcggccacaagttcggcgacagatgcggccaccaggagaacgtggaggaccagaacgagcagtgccccgtgttcctgcagtggctggacagcgtgcaccagctgctgaagcagttcccctgcctgttcgagttcaacgaggccttcctggtgaagctggtgcagcacacctacagctgcctgtacggcaccttcctggccaacaacccctgcgagagagagaagagaaacatctacaagagaacctgcagcgtgtgggccctgctgagagccggcaacaagaacttccacaacttcctgtacacccccagcagcgacatggtgctgcaccccgtgtgccacgtgagagccctgcacctgtggaccgccgtgtacctgcccgccagcagcccctgcaccctgggcgaggagaacatggacctgtacctgagccccgtggcccagagccaggagttcagcggcagaagcctggacagactgcccaagaccagaagcatggacgacctgctgagcgcctgcgacaccagcagccccctgaccagaaccagcagcgaccccaacctgaacaaccactgccaggaggtgagagtgggcctggagccctggcacagcaaccccgagggcagcgagaccagcttcgtggacagcggcgtgggcggcccccagcagaccgtgggcgaggtgggcctgcccccccccctgcccagcagccagaaggactacctgagcaacaagcccttcaagagccacaagagctgcagccccagctacaagctgctgaacaccgccgtgcccagagagatgaagagcaacaccagcgaccccgagatcaaggtgctggaggagaccaagggccccgcccccgaccccagcgcccaggacgagctgggcagaaccctggacggcatcggcgagccccccgagcactgccccgagaccgaggccgtgagcgccctgagcaaggtgatcagcaacaagtgcgacggcgtgtgcaacttccccgagagcagccagaacagccccaccggcaccccccagcaggcccagcccgacagcatgctgggcgtgcccagcaagtgcgtgctggaccacagcctgagcaccgtgtgcaacccccccagcgccgcctgccagacccccctggaccccagcaccgacttcctgaaccaggaccccagcggcagcgtggccagcatcagccaccaggagcagctgagcagcgtgcccgacctgacccacggcgaggaggacatcggcaagagaggcaacaacagaaacggccagctgctggagaaccccagattcggcaagatgcccctggagctggtgagaaagcccatcagccagagccagatcagcgagttcagcttcctgggcagcaactgggacagcttccagggcatggtgaccagcttccccagcggcgaggccacccccagaagactgctgagctacggctgctgcagcaagagacccaacagcaagcagatgagagccaccggcccctgcttcggcggccagtgggcccagagagagggcgtgaagagccccgtgtgcagcagccacagcaacggccactgcaccggccccggcggcaagaaccagatgtggctgagcagccaccccaagcaggtgagcagcaccaagcccgtgcccctgaactgccccagccccgtgccccccctgtacctggacgacgacggcctgcccttccccaccgacgtgatccagcacagactgagacagatcgaggccggctacaagcaggaggtggagcagctgagaagacaggtgagagagctgcagatgagactggacatcagacactgctgcgccccccccgccgagccccccatggactacgaggacgacttcacctgcctgaaggagagcgacggcagcgacaccgaggacttcggcagcgaccacagcgaggactgcctgagcgaggccagctgggagcccgtggacaagaaggagaccgaggtgaccagatgggtgcccgaccacatggccagccactgctacaactgcgactgcgagttctggctggccaagagaagacaccactgcagaaactgcggcaacgtgttctgcgccggctgctgccacctgaagctgcccatccccgaccagcagctgtacgaccccgtgctggtgtgcaacagctgctacgagcacatccaggtgagcagagccagagagctgatgagccagcagctgaagaagcccatcgccaccgccagcagctag

SEQ ID NO: 90186 - DNA, 570 bp, Artificial Sequence
  Description of Artificial Sequence: Synthetic coding sequence
atgcccgtgtggaagctgccctggaagctgagcgagggcaagagaagagcccaggtggagggcgaggacctgttccccgtggccatcagcttcggcagacccaaggaggtgctgcccctgtacagcagcgagagccacagattcaccgtgctggagcccaacaccgtgagcttcaacttcaagttctggagaaacatgtaccaccagttcgacagaaccctgcaccccagacagagcgtgttcaacatcatcatgaacatgaacgagcagaacaagcagctggagaaggacatcaaggacctggagagcaagatcaagcagagaaagaacaagcagaccgacggcatcctgaccaaggagctgctgcacagcgtgcaccccgagagccccaacctgaagaccagcctgtgcttcaaggagcagaccctgctgcccgtgaacgacgccctgagaaccatcgagggcagcagccccgccgacaacagatacagcgagtacgccgaggagttcagcaagagcgagcccgccgtggtgagcctggagtacggcgtggccagaatgacctgctag

SEQ ID NO: 90187 - DNA, 1866 bp, Artificial Sequence
  Description of Artificial Sequence: Synthetic coding sequence
atggagcacatcagaaccaccaaggtggagcaggtgaagctgctggacagattcagcaccagcaacaagagcctgaccggcaccctgtacctgaccgccacccacctgctgttcatcgacagccaccagaaggagacctggatcctgcaccaccacatcgccagcgtggagaagctggccctgaccaccagcggctgccccctggtgatccagtgcaagaacttcagaaccgtgcacttcatcgtgcccagagagagagactgccacgacatctacaacagcctgctgcagctgagcaagcaggccaagtacgaggacctgtacgccttcagctacaaccccaagcagaacgacagcgagagactgcagggctggcagctgatcgacctggccgaggagtacaagagaatgggcgtgcccaacagccactggcagctgagcgacgccaacagagactacaagatctgcgagacctaccccagagagctgtacgtgcccagaatcgccagcaagcccatcatcgtgggcagcagcaagttcagaagcaagggcagattccccgtgctgagctactaccaccaggacaaggaggccgccatctgcagatgcagccagcccctgagcggcttcagcgccagatgcctggaggacgagcacctgctgcaggccatcagcaaggccaaccccgtgaacagatacatgtacgtgatggacaccagacccaagctgaacgccatggccaacagagccgccggcaagggctacgagaacgaggacaactacagcaacatcagattccagttcgtgggcatcgagaacatccacgtgatgagaagcagcctgcagaagctgctggaggtgaacggcaccaagggcctgagcgtgaacgacttctacagcggcctggagagcagcggctggctgagacacatcaaggccgtgatggacgccgccatcttcctggccaaggccatcaccgtggagaacgccagcgtgctggtgcactgcagcgacggctgggacagaaccagccaggtgtgcagcctgggcagcctgctgctggacagctactacagaaccatcaagggcttcatggtgctgatcgagaaggactggatcagcttcggccacaagttcagcgagagatgcggccagctggacggcgaccccaaggaggtgagccccgtgttcacccagttcctggagtgcgtgtggcacctgaccgagcagttcccccaggccttcgagttcagcgaggccttcctgctgcagatccacgagcacatccacagctgccagttcggcaacttcctgggcaactgccagaaggagagagaggagctgaagctgaaggagaagacctacagcctgtggcccttcctgctggaggaccagaagaagtacctgaaccccctgtacagcagcgagagccacagattcaccgtgctggagcccaacaccgtgagcttcaacttcaagttctggagaaacatgtaccaccagttcgacagaaccctgcaccccagacagagcgtgttcaacatcatcatgaacatgaacgagcagaacaagcagctggagaaggacatcaaggacctggagagcaagatcaagcagagaaagaacaagcagaccgacggcatcctgaccaaggagctgctgcacagcgtgcaccccgagagccccaacctgaagaccagcctgtgcttcaaggagcagaccctgctgcccgtgaacgacgccctgagaaccatcgagggcagcagccccgccgacaacagatacagcgagtacgccgaggagttcagcaagagcgagcccgccgtggtgagcctggagtacggcgtggccagaatgacctgctag

SEQ ID NO: 90188 - DNA, 1647 bp, Artificial Sequence
  Description of Artificial Sequence: Synthetic coding sequence
atggagcacatcagaaccaccaaggtggagcaggtgaagctgctggacagattcagcaccagcaacaagagcctgaccggcaccctgtacctgaccgccacccacctgctgttcatcgacagccaccagaaggagacctggatcctgcaccaccacatcgccagcgtggagaagctggccctgaccaccagcggctgccccctggtgatccagtgcaagaacttcagaaccgtgcacttcatcgtgcccagagagagagactgccacgacatctacaacagcctgctgcagctgagcaagcaggccaagtacgaggacctgtacgccttcagctacaaccccaagcagaacgacagcgagagactgcagggctggcagctgatcgacctggccgaggagtacaagagaatgggcgtgcccaacagccactggcagctgagcgacgccaacagagactacaagatctgcgagacctaccccagagagctgtacgtgcccagaatcgccagcaagcccatcatcgtgggcagcagcaagttcagaagcaagggcagattccccgtgctgagctactaccaccaggacaaggaggccgccatctgcagatgcagccagcccctgagcggcttcagcgccagatgcctggaggacgagcacctgctgcaggccatcagcaaggccaaccccgtgaacagatacatgtacgtgatggacaccagacccaagctgaacgccatggccaacagagccgccggcaagggctacgagaacgaggacaactacagcaacatcagattccagttcgtgggcatcgagaacatccacgtgatgagaagcagcctgcagaagctgctggaggtgaacggcaccaagggcctgagcgtgaacgacttctacagcggcctggagagcagcggctggctgagacacatcaaggccgtgatggacgccgccatcttcctggccaaggccatcaccgtggagaacgccagcgtgctggtgcactgcagcgacggctgggacagaaccagccaggtgtgcagcctgggcagcctgctgctggacagctactacagaaccatcaagggcttcatggtgctgatcgagaaggactggatcagcttcggccacaagttcagcgagagatgcggccagctggacggcgaccccaaggaggtgagccccgtgttcacccagttcctggagtgcgtgtggcacctgaccgagcagttcccccaggccttcgagttcagcgaggccttcctgctgcagatccacgagcacatccacagctgccagttcggcaacttcctgggcaactgccagaaggagagagaggagctgaagctgaaggagaagacctacagcctgtggcccttcctgctggaggaccagaagaagtacctgaaccccctgtacagcagcgagagccacagattcaccgtgctggagcccaacaccgtgagcttcaacttcaagttctggagaaacatgtaccaccagttcgacagaaccctgcaccccagacagagcgtgttcaacatcatcatgaacatgaacgagcagaacaagcagctggagaaggacatcaaggacctggagagcctgaccagctacagcagcttcaagatcatcgtgggccagtag

SEQ ID NO: 90189 - DNA, 1647 bp, Artificial Sequence
  Description of Artificial Sequence: Synthetic coding sequence
atggagcacatcagaaccaccaaggtggagcaggtgaagctgctggacagattcagcaccagcaacaagagcctgaccggcaccctgtacctgaccgccacccacctgctgttcatcgacagccaccagaaggagacctggatcctgcaccaccacatcgccagcgtggagaagctggccctgaccaccagcggctgccccctggtgatccagtgcaagaacttcagaaccgtgcacttcatcgtgcccagagagagagactgccacgacatctacaacagcctgctgcagctgagcaagcaggccaagtacgaggacctgtacgccttcagctacaaccccaagcagaacgacagcgagagactgcagggctggcagctgatcgacctggccgaggagtacaagagaatgggcgtgcccaacagccactggcagctgagcgacgccaacagagactacaagatctgcgagacctaccccagagagctgtacgtgcccagaatcgccagcaagcccatcatcgtgggcagcagcaagttcagaagcaagggcagattccccgtgctgagctactaccaccaggacaaggaggccgccatctgcagatgcagccagcccctgagcggcttcagcgccagatgcctggaggacgagcacctgctgcaggccatcagcaaggccaaccccgtgaacagatacatgtacgtgatggacaccagacccaagctgaacgccatggccaacagagccgccggcaagggctacgagaacgaggacaactacagcaacatcagattccagttcgtgggcatcgagaacatccacgtgatgagaagcagcctgcagaagctgctggaggtgaacggcaccaagggcctgagcgtgaacgacttctacagcggcctggagagcagcggctggctgagacacatcaaggccgtgatggacgccgccatcttcctggccaaggccatcaccgtggagaacgccagcgtgctggtgcactgcagcgacggctgggacagaaccagccaggtgtgcagcctgggcagcctgctgctggacagctactacagaaccatcaagggcttcatggtgctgatcgagaaggactggatcagcttcggccacaagttcagcgagagatgcggccagctggacggcgaccccaaggaggtgagccccgtgttcacccagttcctggagtgcgtgtggcacctgaccgagcagttcccccaggccttcgagttcagcgaggccttcctgctgcagatccacgagcacatccacagctgccagttcggcaacttcctgggcaactgccagaaggagagagaggagctgaagctgaaggagaagacctacagcctgtggcccttcctgctggaggaccagaagaagtacctgaaccccctgtacagcagcgagagccacagattcaccgtgctggagcccaacaccgtgagcttcaacttcaagttctggagaaacatgtaccaccagttcgacagaaccctgcaccccagacagagcgtgttcaacatcatcatgaacatgaacgagcagaacaagcagctggagaaggacatcaaggacctggagagcttcaccagcttcgccgccgccagagtgatccagggccagtag

SEQ ID NO: 90190 - DNA, 1983 bp, Artificial Sequence
  Description of Artificial Sequence: Synthetic coding sequence
atggagcacatcagaacccccaaggtggagaacgtgagactggtggacagagtgagccccaagaaggccgccctgggcaccctgtacctgaccgccacccacgtgatcttcgtggagaacagccccgaccccagaaaggagacctggatcctgcacagccagatcagcaccatcgagaagcaggccaccaccgccaccggctgccccctgctgatcagatgcaagaacttccagatcatccagctgatcatcccccaggagagagactgccacgacgtgtacatcagcctgatcagactggccagacccgtgaagtacgaggagctgtactgcttcagcttcaaccccatgctggacaaggaggagagagagcagggctgggtgctgatcgacctgagcgaggagtacaccagaatgggcctgcccaaccactactggcagctgagcgacgtgaacagagactacagagtgtgcgacagctaccccaccgagctgtacgtgcccaagagcgccaccgcccacatcatcgtgggcagcagcaagttcagaagcagaagaagattccccgtgctgagctactactacaaggacaaccacgccagcatctgcagaagcagccagcccctgagcggcttcagcgccagatgcctggaggacgagcagatgctgcaggccatcagaaaggccaaccccggcagcgacttcgtgtacgtggtggacaccagacccaagctgaacgccatggccaacagagccgccggcaagggctacgagaacgaggacaactacagcaacatcaagttccagttcatcggcatcgagaacatccacgtgatgagaaacagcctgcagaagatgctggaggtgtgcgagctgaagagccccagcatgagcgacttcctgtggggcctggagaacagcggctggctgagacacatcaaggccatcatggacgccggcatcttcatcgccaaggccgtgagcgaggagggcgccagcgtgctggtgcactgcagcgacggctgggacagaaccgcccaggtgtgcagcgtggccagcctgctgctggacccccactacagaaccctgaagggcttcatggtgctgatcgagaaggactggatcagcttcggccacaagttcaaccacagatacggcaacctggacggcgaccccaaggagatcagccccgtgatcgaccagttcatcgagtgcgtgtggcagctgatggagcagttcccctgcgccttcgagttcaacgagagattcctgatccacatccagcaccacatctacagctgccagttcggcaacttcctgtgcaacagccagaaggagagaagagagctgaagatccaggagagaacctacagcctgtgggcccacctgtggaagaacagagccgactacctgaaccccctgttcagagccgaccacagccagacccagggcaccctgcacctgcccaccaccccctgcaacttcatgtacaagttctggagcggcatgtacaacagattcgagaagggcatgcagcccagacagagcgtgaccgactacctgatggccgtgaaggaggagacccagcagctggaggaggagctggaggccctggaggagagactggagaagatccagaaggtgcagctgaactgcaccaaggtgaagagcaagcagagcgagcccagcaagcacagcggcttcagcaccagcgacaacagcatcgccaacaccccccaggactacagcggcaacatgaagagcttccccagcagaagccccagccagggcgacgaggacagcgccctgatcctgacccaggacaacctgaagagcagcgaccccgacctgagcgccaacagcgaccaggagagcggcgtggaggacctgagctgcagaagccccagcggcggcgagcacgcccccagcgaggacagcggcaaggacagagacagcgacgaggccgtgttcctgaccgcctag

SEQ ID NO: 90191 - DNA, 756 bp, Artificial Sequence
  Description of Artificial Sequence: Synthetic coding sequence
atggagcagttcccctgcgccttcgagttcaacgagagattcctgatccacatccagcaccacatctacagctgccagttcggcaacttcctgtgcaacagccagaaggagagaagagagctgaagatccaggagagaacctacagcctgtgggcccacctgtggaagaacagagccgactacctgaaccccctgttcagagccgaccacagccagacccagggcaccctgcacctgcccaccaccccctgcaacttcatgtacaagttctggagcggcatgtacaacagattcgagaagggcatgcagcccagacagagcgtgaccgactacctgatggccgtgaaggaggagacccagcagctggaggaggagctggaggccctggaggagagactggagaagatccagaaggtgcagctgaactgcaccaaggtgaagagcaagcagagcgagcccagcaagcacagcggcttcagcaccagcgacaacagcatcgccaacaccccccaggactacagcggcaacatgaagagcttccccagcagaagccccagccagggcgacgaggacagcgccctgatcctgacccaggacaacctgaagagcagcgaccccgacctgagcgccaacagcgaccaggagagcggcgtggaggacctgagctgcagaagccccagcggcggcgagcacgcccccagcgaggacagcggcaaggacagagacagcgacgaggccgtgttcctgaccgcctag

SEQ ID NO: 90192 - DNA, 1668 bp, Artificial Sequence
  Description of Artificial Sequence: Synthetic coding sequence
atggagcacatcagaacccccaaggtggagaacgtgagactggtggacagagtgagccccaagaaggccgccctgggcaccctgtacctgaccgccacccacgtgatcttcgtggagaacagccccgaccccagaaaggagacctggatcctgcacagccagatcagcaccatcgagaagcaggccaccaccgccaccggctgccccctgctgatcagatgcaagaacttccagatcatccagctgatcatcccccaggagagagactgccacgacgtgtacatcagcctgatcagactggccagacccgtgaagtacgaggagctgtactgcttcagcttcaaccccatgctggacaaggaggagagagagcagggctgggtgctgatcgacctgagcgaggagtacaccagaatgggcctgcccaaccactactggcagctgagcgacgtgaacagagactacagagtgtgcgacagctaccccaccgagctgtacgtgcccaagagcgccaccgcccacatcatcgtgggcagcagcaagttcagaagcagaagaagattccccgtgctgagctactactacaaggacaaccacgccagcatctgcagaagcagccagcccctgagcggcttcagcgccagatgcctggaggacgagcagatgctgcaggccatcagaaaggccaaccccggcagcgacttcgtgtacgtggtggacaccagacccaagctgaacgccatggccaacagagccgccggcaagggctacgagaacgaggacaactacagcaacatcaagttccagttcatcggcatcgagaacatccacgtgatgagaaacagcctgcagaagatgctggaggtgtgcgagctgaagagccccagcatgagcgacttcctgtggggcctggagaacagcggctggctgagacacatcaaggccatcatggacgccggcatcttcatcgccaaggccgtgagcgaggagggcgccagcgtgctggtgcactgcagcgacggctgggacagaaccgcccaggtgtgcagcgtggccagcctgctgctggacccccactacagaaccctgaagggcttcatggtgctgatcgagaaggactggatcagcttcggccacaagttcaaccacagatacggcaacctggacggcgaccccaaggagatcagccccgtgatcgaccagttcatcgagtgcgtgtggcagctgatggagcagttcccctgcgccttcgagttcaacgagagattcctgatccacatccagcaccacatctacagctgccagttcggcaacttcctgtgcaacagccagaaggagagaagagagctgaagatccaggagagaacctacagcctgtgggcccacctgtggaagaacagagccgactacctgaaccccctgttcagagccgaccacagccagacccagggcaccctgcacctgcccaccaccccctgcaacttcatgtacaagttctggagcggcatgtacaacagattcgagaagggcatgcagcccagacagagcgtgaccgactacctgatggccgtgaaggaggagacccagcagctggaggaggagctggaggccctggaggaggtgagacacacctgcttcgtgaacctgttcagcgtgctgatcagctag

SEQ ID NO: 90193 - DNA, 1773 bp, Artificial Sequence
  Description of Artificial Sequence: Synthetic coding sequence
ctggacctgctggtgcccaaggtggagaacgtgaagctggtggacagatacgtgagcaagaagcccgccaacggcatcctgtacctgaccgccacccacctgatctacgtggaggccagcggcgccgccagaaaggagacctggatcgccctgcaccacatcgccaccgtggagaagctgcccatcaccagcctgggctgccccctgaccctgagatgcaagaacttcagagtggcccacttcgtgctggacagcgacctggtgtgccacgaggtgtacatcagcctgctgaagctgagccagcccgccctgcccgaggacctgtacgccttcagctacaaccccaagagcagcaaggagatgagagagagcggctggaagctgatcgaccccatcagcgacttcggcagaatgggcatccccaacagaaactggaccatcaccgacgccaacatcagattcagattcatgggcatcgagaacatccacgtgatgagaagcagcctgcagaagctgctggaggtgtgcgagctgaagacccccaccatgagcgagttcctgagcggcctggagagcagcggctggctgagacacatcaaggccatcatggacgccggcatcttcatcaccaaggccgtgaaggtggagaaggccagcgtgctggtgcactgcagcgacggctgggacagaaccgcccaggtgtgcagcgtggccagcatcctgctggaccccttctacagaaccttcaagggcctgatgatcctgatcgagaaggagtggatcagcatgggccacaagttcagccagagatgcggccacctggacggcgacagcaaggaggtgagccccatcttcacccagttcctggactgcatctggcagctgatggagcagttcccctgcgccttcgagttcaacgagaacttcctgctggagatccacgaccacgtgttcagctgccagttcggcaacttcctgggcaactgccagaaggacagagaggacctgagagtgtacgagaagacccacagcgtgtggcccttcctggtgcagagaaagcccgacttcagaaaccccctgtacaagggcttcaccatgtacggcgtgctgaaccccagcaccgtgccctacaacatccagttctggtgcggcatgtacaacagattcgacaagggcctgcagcccaagcagagcatgctggagagcctgctggagatcaagaagcagagagccatgctggagaccgacgtgcacgagctggagaagaagctgaaggtgagagacgagccccccgaggagatctgcacctgcagccagctgggcaacatcctgagccagcacctgggcagccccctgaccaaccccctgggcttcatgggcatcaacggcgacctgaacaccctgatggagaacggcaccctgagcagagagggcggcctgagagcccagatggaccaggtgaagagccagggcgccgacctgcaccacaactgctgcgagatcgtgggcagcctgagagccatcaacatcagcggcgacgtgggcatcagcgaggccatgggcatcagcggcgacatgtgcaccttcgaggccaccggcttcagcaaggacctgggcatctgcggcgccatggacatcagcgaggccaccggcatcagcggcaacctgggcatcagcgaggccagaggcttcagcggcgacatgggcatcctgggcgacaccggcatcagcaaggccagcaccaaggaggccgactacagcaagcaccagtag

SEQ ID NO: 90194 - DNA, 2115 bp, Artificial Sequence
  Description of Artificial Sequence: Synthetic coding sequence
atggaccacatcaccgtgcccaaggtggagaacgtgaagctggtggacagatacgtgagcaagaagcccgccaacggcatcctgtacctgaccgccacccacctgatctacgtggaggccagcggcgccgccagaaaggagacctggatcgccctgcaccacatcgccaccgtggagaagctgcccatcaccagcctgggctgccccctgaccctgagatgcaagaacttcagagtggcccacttcgtgctggacagcgacctggtgtgccacgaggtgtacatcagcctgctgaagctgagccagcccgccctgcccgaggacctgtacgccttcagctacaaccccaagagcagcaaggagatgagagagagcggctggaagctgatcgaccccatcagcgacttcggcagaatgggcatccccaacagaaactggaccatcaccgacgccaacagaaactacgagatctgcagcacctacccccccgagatcgtggtgcccaagagcgtgaccctgggcaccgtggtgggcagcagcaagttcagaagcaaggagagagtgcccgtgctgagctacctgtacaaggagaacaacgccgccatctgcagatgcagccagcccctgagcggcttctacaccagatgcgtggacgacgagctgctgctggaggccatcagccagaccaaccccggcagccagttcatgtacgtggtggacaccagacccaagctgaacgccatggccaacagagccgccggcaagggctacgagaacgaggacaactacgccaacatcagattcagattcatgggcatcgagaacatccacgtgatgagaagcagcctgcagaagctgctggaggtgtgcgagctgaagacccccaccatgagcgagttcctgagcggcctggagagcagcggctggctgagacacatcaaggccatcatggacgccggcatcttcatcaccaaggccgtgaaggtggagaaggccagcgtgctggtgcactgcagcgacggctgggacagaaccgcccaggtgtgcagcgtggccagcatcctgctggaccccttctacagaaccttcaagggcctgatgatcctgatcgagaaggagtggatcagcatgggccacaagttcagccagagatgcggccacctggacggcgacagcaaggaggtgagccccatcttcacccagttcctggactgcatctggcagctgatggagcagttcccctgcgccttcgagttcaacgagaacttcctgctggagatccacgaccacgtgttcagctgccagttcggcaacttcctgggcaactgccagaaggacagagaggacctgagagtgtacgagaagacccacagcgtgtggcccttcctggtgcagagaaagcccgacttcagaaaccccctgtacaagggcttcaccatgtacggcgtgctgaaccccagcaccgtgccctacaacatccagttctggtgcggcatgtacaacagattcgacaagggcctgcagcccaagcagagcatgctggagagcctgctggagatcaagaagcagagagccatgctggagaccgacgtgcacgagctggagaagaagctgaaggtgagagacgagccccccgaggagatctgcacctgcagccagctgggcaacatcctgagccagcacctgggcagccccctgaccaaccccctgggcttcatgggcatcaacggcgacctgaacaccctgatggagaacggcaccctgagcagagagggcggcctgagagcccagatggaccaggtgaagagccagggcgccgacctgcaccacaactgctgcgagatcgtgggcagcctgagagccatcaacatcagcggcgacgtgggcatcagcgaggccatgggcatcagcggcgacatgtgcaccttcgaggccaccggcttcagcaaggacctgggcatctgcggcgccatggacatcagcgaggccaccggcatcagcggcaacctgggcatcagcgaggccagaggcttcagcggcgacatgggcatcctgggcgacaccggcatcagcaaggccagcaccaaggaggccgactacagcaagcaccagtag

SEQ ID NO: 90195 - DNA, 1527 bp, Artificial Sequence
  Description of Artificial Sequence: Synthetic coding sequence
tgagacagcgacctggtgtgccacgaggtgtacatcagcctgctgaagctgagccagcccgccctgcccgaggacctgtacgccttcagctacaaccccaagagcagcaaggagatgagagagagcggctggaagctgatcgaccccatcagcgacttcggcagaatgggcatccccaacagaaactggaccatcaccgacgccaacatcagattcagattcatgggcatcgagaacatccacgtgatgagaagcagcctgcagaagctgctggaggtgtgcgagctgaagacccccaccatgagcgagttcctgagcggcctggagagcagcggctggctgagacacatcaaggccatcatggacgccggcatcttcatcaccaaggccgtgaaggtggagaaggccagcgtgctggtgcactgcagcgacggctgggacagaaccgcccaggtgtgcagcgtggccagcatcctgctggaccccttctacagaaccttcaagggcctgatgatcctgatcgagaaggagtggatcagcatgggccacaagttcagccagagatgcggccacctggacggcgacagcaaggaggtgagccccatcttcacccagttcctggactgcatctggcagctgatggagcagttcccctgcgccttcgagttcaacgagaacttcctgctggagatccacgaccacgtgttcagctgccagttcggcaacttcctgggcaactgccagaaggacagagaggacctgagagtgtacgagaagacccacagcgtgtggcccttcctggtgcagagaaagcccgacttcagaaaccccctgtacaagggcttcaccatgtacggcgtgctgaaccccagcaccgtgccctacaacatccagttctggtgcggcatgtacaacagattcgacaagggcctgcagcccaagcagagcatgctggagagcctgctggagatcaagaagcagagagccatgctggagaccgacgtgcacgagctggagaagaagctgaaggtgagagacgagccccccgaggagatctgcacctgcagccagctgggcaacatcctgagccagcacctgggcagccccctgaccaaccccctgggcttcatgggcatcaacggcgacctgaacaccctgatggagaacggcaccctgagcagagagggcggcctgagagcccagatggaccaggtgaagagccagggcgccgacctgcaccacaactgctgcgagatcgtgggcagcctgagagccatcaacatcagcggcgacgtgggcatcagcgaggccatgggcatcagcggcgacatgtgcaccttcgaggccaccggcttcagcaaggacctgggcatctgcggcgccatggacatcagcgaggccaccggcatcagcggcaacctgggcatcagcgaggccagaggcttcagcggcgacatgggcatcctgggcgacaccggcatcagcaaggccagcaccaaggaggccgactacagcaagcaccagtag

SEQ ID NO: 90196 - DNA, 2082 bp, Artificial Sequence
  Description of Artificial Sequence: Synthetic coding sequence
atggaccacatcaccgtgcccaaggtggagaacgtgaagctggtggacagatacgtgagcaagaagcccgccaacggcatcctgtacctgaccgccacccacctgatctacgtggaggccagcggcgccgccagaaaggagacctggatcgccctgcaccacatcgccaccgtggagaagctgcccatcaccagcctgggctgccccctgaccctgagatgcaagaacttcagagtggcccacttcgtgctggacagcgacctggtgtgccacgaggtgtacatcagcctgctgaagctgagccagcccgccctgcccgaggacctgtacgccttcagctacaaccccaagagcagcaaggagatgagagagagcggctggaagctgatcgaccccatcagcgacttcggcagaatgggcatccccaacagaaactggaccatcaccgacgccaacagaaactacgagatctgcagcacctacccccccgagatcgtggtgcccaagagcgtgaccctgggcaccgtggtgggcagcagcaagttcagaagcaaggagagagtgcccgtgctgagctacctgtacaaggagaacaacgccgccatctgcagatgcagccagcccctgagcggcttctacaccagatgcgtggacgacgagctgctgctggaggccatcagccagaccaaccccggcagccagttcatgtacgtggtggacaccagacccaagctgaacgccatggccaacagagccgccggcaagggctacgagaacgaggacaactacgccaacatcagattcagattcatgggcatcgagaacatccacgtgatgagaagcagcctgcagaagctgctggaggtgtgcgagctgaagacccccaccatgagcgagttcctgagcggcctggagagcagcggctggctgagacacatcaaggccatcatggacgccggcatcttcatcaccaaggccgtgaaggtggagaaggccagcgtgctggtgcactgcagcgacggctgggacagaaccgcccaggtgtgcagcgtggccagcatcctgctggaccccttctacagaaccttcaagggcctgatgatctggcacttcctggtgctgatcatgagaatcgtgctgcagctggccaagatgaacctgatggacatcaccaagatcttcagcctgctgcagcccgacaaggaggaggaggacaccgacaccgaggagaagcaggccctgaaccaggccgtgtacgacaacgacagctacaccctggaccagctgctgagacaggagagatacaagagattcatcaacagcagaagcggctggggcgtgcccggcacccccctgagactggccgccagctacggccacctgagctgcctgcaggtgctgctggcccacggcgccgacgtggacagcctggacgtgaaggcccagacccccctgttcaccgccgtgagccacggccacctggactgcgtgagagtgctgctggaggccggcgccagccccggcggcagcatctacaacaactgcagccccgtgctgaccgccgccagagacggcgccgtggccatcctgcaggagctgctggaccacggcgccgaggccaacgtgaaggccaagctgcccgtgtgggccagcaacatcgccagctgcagcggccccctgtacctggccgccgtgtacggccacctggactgcttcagactgctgctgctgcacggcgccgaccccgactacaactgcaccgaccagggcctgctggccagagtgcccagacccagaaccctgctggagatctgcctgcaccacaactgcgagcccgagtacatccagctgctgatcgacttcggcgccaacatctacctgcccagcctgagcctggacctgaccagccaggacgacaagggcatcgccctgctgctgcaggccagagccacccccagaagcctgctgagccaggtgagactggtggtgagaagagccctgtgccaggccggccagccccaggccatcaaccagctggacatcccccccatgctgatcagctacctgaagcaccagctgtag

SEQ ID NO: 90197 - DNA, 861 bp, Artificial Sequence
  Description of Artificial Sequence: Synthetic coding sequence
atgggcggcgagagaagcggcgtgagaggcaacaagatggccgccgccgagcccagccccagaagagtgggcttcgtgggcgccggcagaatggccggcgccatcgcccagggcctgatcagagccggcaaggtggaggcccagcacatcctggccagcgcccccaccgacagaaacctgtgccacttccaggccctgggctgcagaaccacccacagcaaccaggaggtgctgcagagctgcctgctggtgatcttcgccaccaagccccacgtgctgcccgccgtgctggccgaggtggcccccgtggtgaccaccgagcacatcctggtgagcgtggccgccggcgtgagcctgagcaccctggaggagctgctgccccccaacaccagagtgctgagagtgctgcccaacctgccctgcgtggtgcaggagggcgccatcgtgatggccagaggcagacacgtgggcagcagcgagaccaagctgctgcagcacctgctggaggcctgcggcagatgcgaggaggtgcccgaggcctacgtggacatccacaccggcctgagcggcagcggcgtggccttcgtgtgcgccttcagcgaggccctggccgagggcgccgtgaagatgggcatgcccagcagcctggcccacagaatcgccgcccagaccctgctgggcaccgccaagatgctgctgcacgagggccagcaccccgcccagctgagaagcgacgtgtgcacccccggcggcaccaccatctacggcctgcacgccctggagcagggcggcctgagagccgccaccatgagcgccgtggaggccgccacctgcagagccaaggagctgagcagaaagtag

SEQ ID NO: 90198 - DNA, 900 bp, Artificial Sequence
  Description of Artificial Sequence: Synthetic coding sequence
atgcccctgagcggcacccccgcccccaacaagaagagaaagagcagcaagctgatcatggagctgaccggcggcggccaggagagcagcggcctgaacctgggcaagaagatcagcgtgcccagagacgtgatgctggaggagctgagcctgctgaccaacagaggcagcaagatgttcaagctgagacagatgagagtggagaagttcatctacgagaaccaccccgacgtgttcagcgacagcagcatggaccacttccagaagttcctgcccaccgtgggcggccagctgggcaccgccggccagggcttcagctacagcaagagcaacggcagaggcggcagccaggccggcggcagcggcagcgccggccagtacggcagcgaccagcagcaccacctgggcagcggcagcggcgccggcggcaccggcggccccgccggccaggccggcagaggcggcgccgccggcaccgccggcgtgggcgagaccggcagcggcgaccaggccggcggcgagggcaagcacatcaccgtgttcaagacctacatcagcccctgggagagagccatgggcgtggacccccagcagaagatggagctgggcatcgacctgctggcctacggcgccaaggccgagctgcccaagtacaagagcttcaacagaaccgccatgccctacggcggctacgagaaggccagcaagagaatgaccttccagatgcccaagttcgacctgggccccctgctgagcgagcccctggtgctgtacaaccagaacctgagcaacagacccagcttcaacagaacccccatcccctggctgagcagcggcgagcccgtggactacaacgtggacatcggcatccccctggacggcgagaccgaggagctgtag

SEQ ID NO: 90199 - DNA, 795 bp, Artificial Sequence
  Description of Artificial Sequence: Synthetic coding sequence
atgctgagccacaacaccatgatgaagcagagaaagcagcaggccaccgccatcatgaaggaggtgcacggcaacgacgtggacggcatggacctgggcaagaaggtgagcatccccagagacatcatgctggaggagctgagccacctgagcaacagaggcgccagactgttcaagatgagacagagaagaagcgacaagtacaccttcgagaacttccagtaccagagcagagcccagatcaaccacagcatcgccatgcagaacggcaaggtggacggcagcaacctggagggcggcagccagcaggcccccctgaccccccccaacacccccgaccccagaagcccccccaaccccgacaacatcgcccccggctacagcggccccctgaaggagatcccccccgagaagttcaacaccaccgccgtgcccaagtactaccagagcccctgggagcaggccatcagcaacgaccccgagctgctggaggccctgtaccccaagctgttcaagcccgagggcaaggccgagctgcccgactacagaagcttcaacagagtggccacccccttcggcggcttcgagaaggccagcagaatggtgaagttcaaggtgcccgacttcgagctgctgctgctgaccgaccccagattcatgagcttcgtgaaccccctgagcggcagaagaagcttcaacagaacccccaagggctggatcagcgagaacatccccatcgtgatcaccaccgagcccaccgacgacaccaccgtgcccgagagcgaggacctgtag

SEQ ID NO: 90200 - DNA, 756 bp, Artificial Sequence
  Description of Artificial Sequence: Synthetic coding sequence
atgatccccaaggagcagaagggccccgtgatggccgccatgggcgacctgaccgagcccgtgcccaccctggacctgggcaagaagctgagcgtgccccaggacctgatgatggaggagctgagcctgagaaacaacagaggcagcctgctgttccagaagagacagagaagagtgcagaagttcaccttcgagctggccgccagccagagagccatgctggccggcagcgccagaagaaaggtgaccggcaccgccgagagcggcaccgtggccaacgccaacggccccgagggccccaactacagaagcgagctgcacatcttccccgccagccccggcgccagcctgggcggccccgagggcgcccaccccgccgccgcccccgccggctgcgtgcccagccccagcgccctggcccccggctacgccgagcccctgaagggcgtgccccccgagaagttcaaccacaccgccatcagcaagggctacagatgcccctggcaggagttcgtgagctacagagactaccagagcgacggcagaagccacacccccagccccaacgactacagaaacttcaacaagacccccgtgcccttcggcggccccctggtgggcggcaccttccccagacccggcacccccttcatccccgagcccctgagcggcctggagctgctgagactgagacccagcttcaacagagtggcccagggctgggtgagaaacctgcccgagagcgaggagctgtag

SEQ ID NO: 90201 - DNA, 756 bp, Artificial Sequence; identical to SEQ ID NO: 90200
  Description of Artificial Sequence: Synthetic coding sequence

SEQ ID NO: 90202 - DNA, 1989 bp, Artificial Sequence
  Description of Artificial Sequence: Synthetic coding sequence
atggtggtgagcgaggtggacatcgccaaggccgaccccgccgccgccagccaccccctgctgctgaacggcgacgccaccgtggcccagaagaaccccggcagcgtggccgagaacaacctgtgcagccagtacgaggagaaggtgagaccctgcatcgacctgatcgacagcctgagagccctgggcgtggagcaggacctggccctgcccgccatcgccgtgatcggcgaccagagcagcggcaagagcagcgtgctggaggccctgagcggcgtggccctgcccagaggcagcggcatcgtgaccagatgccccctggtgctgaagctgaagaagctggtgaacgaggacaagtggagaggcaaggtgagctaccaggactacgagatcgagatcagcgacgccagcgaggtggagaaggagatcaacaaggcccagaacgccatcgccggcgagggcatgggcatcagccacgagctgatcaccctggagatcagcagcagagacgtgcccgacctgaccctgatcgacctgcccggcatcaccagagtggccgtgggcaaccagcccgccgacatcggctacaagatcaagaccctgatcaagaagtacatccagagacaggagaccatcagcctggtggtggtgcccagcaacgtggacatcgccaccaccgaggccctgagcatggcccaggaggtggaccccgagggcgacagaaccatcggcatcctgaccaagcccgacctggtggacaagggcaccgaggacaaggtggtggacgtggtgagaaacctggtgttccacctgaagaagggctacatgatcgtgaagtgcagaggccagcaggagatccaggaccagctgagcctgagcgaggccctgcagagagagaagatcttcttcgagaaccacccctacttcagagacctgctggaggagggcaaggccaccgtgccctgcctggccgagaagctgaccagcgagctgatcacccacatctgcaagagcctgcccctgctggagaaccagatcaaggagacccaccagagaatcaccgaggagctgcagaagtacggcgtggacatccccgaggacgagaacgagaagatgttcttcctgatcgacaaggtgaacgccttcaaccaggacatcaccgccctgatgcagggcgaggagaccgtgggcgaggaggacatcagactgttcaccagactgagacacgagttccacaagtggagcaccatcatcgagaacaacttccaggagggccacaagatcctgagcagaaagatccagaagttcgagaaccagtacagaggcagagagctgcccggcttcgtgaactacagaaccttcgagaccatcgtgaagcagcagatcaaggccctggaggagcccgccgtggacatgctgcacaccgtgaccgacatggtgagactggccttcaccgacgtgagcatcaagaacttcgaggagttcttcaacctgcacagaaccgccaagagcaagatcgaggacatcagagccgagcaggagagagagggcgagaagctgatcagactgcacttccagatggagcagatcgtgtactgccaggaccaggtgtacagaggcgccctgcagaaggtgagagagaaggagctggaggaggagaagaagaagaagagctgggacttcggcgccttccagagcagcagcgccaccgacagcagcatggaggagatcttccagcacctgatggcctaccaccaggaggccagcaagagaatcagcagccacatccccctgatcatccagttcttcatgctgcagacctacggccagcagctgcagaaggccatgctgcagctgctgcaggacaaggacacctacagctggctgctgaaggagagaagcgacaccagcgacaagagaaagttcctgaaggagagactggccagactgacccaggccagaagaagactggcccagttccccggctag

SEQ ID NO: 90203 - DNA, 1989 bp, Artificial Sequence; identical to SEQ ID NO: 90202
  Description of Artificial Sequence: Synthetic coding sequence

SEQ ID NO: 90204 - DNA, 207 bp, Artificial Sequence
  Description of Artificial Sequence: Synthetic coding sequence
atggtggtgagcgaggtggacatcgccaaggccgaccccgccgccgccagccaccccctgctgctgaacggcgacgccaccgtggcccagaagaaccccggcagcgtggccgagaacaacctgtgcagccagtacgaggagaaggtgagaccctgcatcgacctgatcgacagcctgagagccctgggcgtggagcaggacctgtag

SEQ ID NO: 90205 - DNA, 606 bp, Artificial Sequence
  Description of Artificial Sequence: Synthetic coding sequence
atggtggtgagcgaggtggacatcgccaaggccgaccccgccgccgccagccaccccctgctgctgaacggcgacgccaccgtggcccagaagaaccccggcagcgtggccgagaacaacctgtgcagccagtacgaggagaaggtgagaccctgcatcgacctgatcgacagcctgagagccctgggcgtggagcaggacctggccctgcccgccatcgccgtgatcggcgaccagagcagcggcaagagcagcgtgctggaggccctgagcggcgtggccctgcccagaggcagcggcatcgtgaccagatgccccctggtgctgaagctgaagaagctggtgaacgaggacaagtggagaggcaaggtgagctaccaggactacgagatcgagatcagcgacgccagcgaggtggagaaggagatcaacaaggcccagaacgccatcgccggcgagggcatgggcatcagccacgagctgatcaccctggagatcagcagcagagacgtgcccgacctgaccctgatcgacctgcccggcatcaccagagtggccgtgggcaaccagcccgccgacatcggctacaagatcaagaccctgtag

SEQ ID NO: 90206 - DNA, 81 bp, Artificial Sequence
  Description of Artificial Sequence: Synthetic coding sequence
atggtggtgagcgaggtggacatcgccaaggccgaccccgccgccgccagccaccccctgctgctgaacggcgacgcctag

SEQ ID NO: 90207 - DNA, 594 bp, Artificial Sequence
  Description of Artificial Sequence: Synthetic coding sequence
atggtggtgagcgaggtggacatcgccaaggccgaccccgccgccgccagccaccccctgctgctgaacggcgacgccaccgtggcccagaagaaccccggcagcgtggccgagaacaacctgtgcagccagtacgaggagaaggtgagaccctgcatcgacctgatcgacagcctgagagccctgggcgtggagcaggacctggccctgcccgccatcgccgtgatcggcgaccagagcagcggcaagagcagcgtgctggaggccctgagcggcgtggccctgcccagaggcagcggcatcgtgaccagatgccccctggtgctgaagctgaagaagctggtgaacgaggacaagtggagaggcaaggtgagctaccaggactacgagatcgagatcagcgacgccagcgaggtggagaaggagatcaacaaggcccagaacgccatcgccggcgagggcatgggcatcagccacgagctgatcaccctggagatcagcagcagagacgtgcccgacctgaccctgatcgacctgcccggcatcaccagagtggccgtgggcaaccagcccgccgacatcggctacaagtag

SEQ ID NO: 90208 - DNA, 108 bp, Artificial Sequence
  Description of Artificial Sequence: Synthetic coding sequence
atggtggtgagcgaggtggacatcgccaaggccgaccccgccgccgccagccaccccctgctgctgaacggcgacgccaccgtggcccagaagaaccccggcagctag

SEQ ID NO: 90209 - DNA, 234 bp, Artificial Sequence
  Description of Artificial Sequence: Synthetic coding sequence
atggtggtgagcgaggtggacatcgccaaggccgaccccgccgccgccagccaccccctgctgctgaacggcgacgccaccgtggcccagaagaaccccggcagcgtggccgagaacaacctgtgcagccagtacgaggagaaggtgagaccctgcatcgacctgatcgacagcctgagagccctgggcgtggagcaggacctggccctgcccgccatcgccgtgatcggctag

SEQ ID NO: 90210 - DNA, 1989 bp, Artificial Sequence; identical to SEQ ID NO: 90202
  Description of Artificial Sequence: Synthetic coding sequence

SEQ ID NO: 90211 - DNA, 2148 bp, Artificial Sequence
  Description of Artificial Sequence: Synthetic coding sequence
atgagcaaggcccacaagccctggccctacagaagaagaagccagttcagcagcagaaagtacctgaagaaggagatgaacagcttccagcagcagcccccccccttcggcaccgtgcccccccagatgatgttcccccccaactggcagggcgccgagaaggacgccgccttcctggccaaggacttcaacttcctgaccctgaacaaccagcccccccccggcaacagaagccagcccagagccatgggccccgagaacaacctgtacagccagtacgagcagaaggtgagaccctgcatcgacctgatcgacagcctgagagccctgggcgtggagcaggacctggccctgcccgccatcgccgtgatcggcgaccagagcagcggcaagagcagcgtgctggaggccctgagcggcgtggccctgcccagaggcagcggcatcgtgaccagatgccccctggtgctgaagctgaagaagcagccctgcgaggcctgggccggcagaatcagctacagaaacaccgagctggagctgcaggaccccggccaggtggagaaggagatccacaaggcccagaacgtgatggccggcaacggcagaggcatcagccacgagctgatcagcctggagatcaccagccccgaggtgcccgacctgaccatcatcgacctgcccggcatcaccagagtggccgtggacaaccagcccagagacatcggcctgcagatcaaggccctgatcaagaagtacatccagagacagcagaccatcaacctggtggtggtgccctgcaacgtggacatcgccaccaccgaggccctgagcatggcccacgaggtggaccccgagggcgacagaaccatcggcatcctgaccaagcccgacctgatggacagaggcaccgagaagagcgtgatgaacgtggtgagaaacctgacctaccccctgaagaagggctacatgatcgtgaagtgcagaggccagcaggagatcaccaacagactgagcctggccgaggccaccaagaaggagatcaccttcttccagacccacccctacttcagagtgctgctggaggagggcagcgccaccgtgcccagactggccgagagactgaccaccgagctgatcatgcacatccagaagagcctgcccctgctggagggccagatcagagagagccaccagaaggccaccgaggagctgagaagatgcggcgccgacatccccagccaggaggccgacaagatgttcttcctgatcgagaagatcaagatgttcaaccaggacatcgagaagctggtggagggcgaggaggtggtgagagagaacgagaccagactgtacaacaagatcagagaggacttcaagaactgggtgggcatcctggccaccaacacccagaaggtgaagaacatcatccacgaggaggtggagaagtacgagaagcagtacagaggcaaggagctgctgggcttcgtgaactacaagaccttcgagatcatcgtgcaccagtacatccagcagctggtggagcccgccctgagcatgctgcagaaggccatggagatcatccagcaggccttcatcaacgtggccaagaagcacttcggcgagttcttcaacctgaaccagaccgtgcagagcaccatcgaggacatcaaggtgaagcacaccgccaaggccgagaacatgatccagctgcagttcagaatggagcagatggtgttctgccaggaccagatctacagcgtggtgctgaagaaggtgagagaggagatcttcaaccccctgggcacccccagccagaacatgaagctgaacagccacttccccagcaacgagagcagcgtgagcagcttcaccgagatcggcatccacctgaacgcctacttcctggagaccagcaagagactggccaaccagatccccttcatcatccagtacttcatgctgagagagaacggcgacagcctgcagaaggccatgatgcagatcctgcaggagaagaacagatacagctggctgctgcaggagcagagcgagaccgccaccaagagaagaatcctgaaggagagaatctacagactgacccaggccagacacgccctgtgccagttcagcagcaaggagatccactag

SEQ ID NO: 90212 - DNA, 45 bp, Artificial Sequence
  Description of Artificial Sequence: Synthetic coding sequence
atgagcaaggcccacaagccctggccctacagaagaagaagctag

SEQ ID NO: 90213 - DNA, 405 bp, Artificial Sequence
  Description of Artificial Sequence: Synthetic coding sequence
atgagcaaggcccacaagccctggccctacagaagaagaagccagttcagcagcagaaagtacctgaagaaggagatgaacagcttccagcagcagcccccccccttcggcaccgtgcccccccagatgatgttcccccccaactggcagggcgccgagaaggacgccgccttcctggccaaggacttcaacttcctgaccctgaacaaccagcccccccccggcaacagaagccagcccagagccatgggccccgagaacaacctgtacagccagtacgagcagaaggtgagaccctgcatcgacctgatcgacagcctgagagccctgggcgtggagcaggacctggccctgcccgccatcgccgtgatcggcgaccagagcagcggcaagagcagcgtgtag

SEQ ID NO: 90214 - DNA, 378 bp, Artificial Sequence
  Description of Artificial Sequence: Synthetic coding sequence
atgagcaaggcccacaagccctggccctacagaagaagaagccagttcagcagcagaaagtacctgaagaaggagatgaacagcttccagcagcagcccccccccttcggcaccgtgcccccccagatgatgttcccccccaactggcagggcgccgagaaggacgccgccttcctggccaaggacttcaacttcctgaccctgaacaaccagcccccccccggcaacagaagccagcccagagccatgggccccgagaacaacctgtacagccagtacgagcagaaggtgagaccctgcatcgacctgatcgacagcctgagagccctgggcgtggagcaggacctggccctgcccgccatcgccgtgatcggctag

SEQ ID NO: 90215 - DNA, 390 bp, Artificial Sequence
  Description of Artificial Sequence: Synthetic coding sequence
atgagcaaggcccacaagccctggccctacagaagaagaagccagttcagcagcagaaagtacctgaagaaggagatgaacagcttccagcagcagcccccccccttcggcaccgtgcccccccagatgatgttcccccccaactggcagggcgccgagaaggacgccgccttcctggccaaggacttcaacttcctgaccctgaacaaccagcccccccccggcaacagaagccagcccagagccatgggccccgagaacaacctgtacagccagtacgagcagaaggtgagaccctgcatcgacctgatcgacagcctgagagccctgggcgtggagcaggacctggccctgcccgccatcgccgtgatcggcgaccagagcagctag

SEQ ID NO: 90216 - DNA, 606 bp, Artificial Sequence
  Description of Artificial Sequence: Synthetic coding sequence
atgagcaaggcccacaagccctggccctacagaagaagaagccagttcagcagcagaaagtacctgaagaaggagatgaacagcttccagcagcagcccccccccttcggcaccgtgcccccccagatgatgttcccccccaactggcagggcgccgagaaggacgccgccttcctggccaaggacttcaacttcctgaccctgaacaaccagcccccccccggcaacagaagccagcccagagccatgggccccgagaacaacctgtacagccagtacgagcagaaggtgagaccctgcatcgacctgatcgacagcctgagagccctgggcgtggagcaggacctggccctgcccgccatcgccgtgatcggcgaccagagcagcggcaagagcagcgtgctggaggccctgagcggcgtggccctgcccagaggcagcgcccagaacgtgatggccggcaacggcagaggcatcagccacgagctgatcagcctggagatcaccagccccgaggtgcccgacctgaccatcatcgacctgcccggcatcaccagagtggccgtggacaaccagcccagagacatcggcctgcaggtgagctag

SEQ ID NO: 90217 - DNA, 663 bp, Artificial Sequence
  Description of Artificial Sequence: Synthetic coding sequence
atgaacatcagaaacgccagacccgaggacctgatgaacatgcagcactgcaacctgctgtgcctgcccgagaactaccagatgaagtactacttctaccacggcctgagctggccccagctgagctacatcgccgaggacgagaacggcaagatcgtgggctacgtgctggccaagatggaggaggaccccgacgacgtgccccacggccacatcaccagcctggccgtgaagagaagccacagaagactgggcctggcccagaagctgatggaccaggccagcagagccatgatcgagaacttcaacgccaagtacgtgagcctgcacgtgagaaagagaatcagcgaggtggagcccaagtactacgccgacggcgaggacgcctacgccatgaagagagacctgacccagatggccgacgagctgagaagacacctggagctgaaggagaagggcagacacgtggtgctgggcgccatcgagaacaaggtggagagcaagggcaacagcccccccagcagcggcgaggcctgcagagaggagaagggcctggccgccgaggacagcggcggcgacagcaaggacctgagcgaggtgagcgagaccaccgagagcaccgacgtgaaggacagcagcgaggccagcgacagcgccagctag

SEQ ID NO: 90218 - DNA, 708 bp, Artificial Sequence
  Description of Artificial Sequence: Synthetic coding sequence
atgaacatcagaaacgccagacccgaggacctgatgaacatgcagcactgcaacctgctgtgcctgcccgagaactaccagatgaagtactacttctaccacggcctgagctggccccagctgagctacatcgccgaggacgagaacggcaagatcgtgggctacgtgctggccaagatggaggaggaccccgacgacgtgccccacggccacatcaccagcctggccgtgaagagaagccacagaagactgggcctggcccagaagctgatggaccaggccagcagagccatgatcgagaacttcaacgccaagtacgtgagcctgcacgtgagaaagagcaacagagccgccctgcacctgtacagcaacaccctgaacttccagatcagcgaggtggagcccaagtactacgccgacggcgaggacgcctacgccatgaagagagacctgacccagatggccgacgagctgagaagacacctggagctgaaggagaagggcagacacgtggtgctgggcgccatcgagaacaaggtggagagcaagggcaacagcccccccagcagcggcgaggcctgcagagaggagaagggcctggccgccgaggacagcggcggcgacagcaaggacctgagcgaggtgagcgagaccaccgagagcaccgacgtgaaggacagcagcgaggccagcgacagcgccagctag

SEQ ID NO: 90219 - DNA, 396 bp, Artificial Sequence
  Description of Artificial Sequence: Synthetic coding sequence
atgaacatcagaaacgccagacccgaggacctgatgaacatgcagcactgcaacctgctgtgcctgcccgagaactaccagatgaagtactacttctaccacggcctgagctggccccagctgagctacatcgccgaggacgagaacggcaagatcgtgggctacgtgctggccaagatggaggaggaccccgacgacgtgccccacggccacatcaccagcctggccgtgaagagaagccacagaagactgggcctggcccagaagctgatggaccaggccagcagagccatgatcgagaacttcaacgccaagtacgtgagcctgcacgtgagaaagagaagcgtgaagtggagccccaacaccatgcagatgggcagaacccccatgccctag

SEQ ID NO: 90220 - DNA, 534 bp, Artificial Sequence
  Description of Artificial Sequence: Synthetic coding sequence
atgatcgtggccgagatcaagaacagaaccaagatccacaaggaggacggcgacatcctggccagcaacttcagcgtggacacccaggtggcctacatcctgagcctgggcgtggtgaaggagttcagaaagcacggcatcggcagcctgctgctggagagcctgaaggaccacatcagcaccaccgcccaggaccactgcaaggccatctacctgcacgtgctgaccaccaacaacaccgccatcaacttctacgagaacagagacttcaagcagcaccactacctgccctactactacagcatcagaggcgtgctgaaggacggcttcacctacgtgctgtacatcaacggcggccaccccccctggaccatcctggactacatccagcacctgggcagcgccctggccagcctgagcccctgcagcatcccccacagagtgtacagacaggcccacagcctgctgtgcagcttcctgccctggagcggcatcagcagcaagagcggcatcgagtacagcagaaccatgtag

SEQ ID NO: 90221 - DNA, 729 bp, Artificial Sequence
  Description of Artificial Sequence: Synthetic coding sequence
atgaccgaggtggtgcccagcagcgccctgagcgaggtgagcctgagactgctgtgccacgacgacatcgacaccgtgaagcacctgtgcggcgactggttccccatcgagtaccccgacagctggtacagagacatcaccagcaacaagaagttcttcagcctggccgccacctacagaggcgccatcgtgggcatgatcgtggccgagatcaagaacagaaccaagatccacaaggaggacggcgacatcctggccagcaacttcagcgtggacacccaggtggcctacatcctgagcctgggcgtggtgaaggagttcagaaagcacggcatcggcagcctgctgctggagagcctgaaggaccacatcagcaccaccgcccaggaccactgcaaggccatctacctgcacgtgctgaccaccaacaacaccgccatcaacttctacgagaacagagacttcaagcagcaccactacctgccctactactacagcatcagaggcgtgctgaaggacggcttcacctacgtgctgtacatcaacggcggccaccccccctggaccatcctggactacatccagcacctgggcagcgccctggccagcctgagcccctgcagcatcccccacagagtgtacagacaggcccacagcctgctgtgcagcttcctgccctggagcggcatcagcagcaagagcggcatcgagtacagcagaaccatgtag

SEQ ID NO: 90222 - DNA, 729 bp, Artificial Sequence; identical to SEQ ID NO: 90221
  Description of Artificial Sequence: Synthetic coding sequence

SEQ ID NO: 90223 - DNA, 573 bp, Artificial Sequence
  Description of Artificial Sequence: Synthetic coding sequence
atgaccgaggtggtgcccagcagcgccctgagcgaggtgagcctgagactgctgtgccacgacgacatcgacaccgtgaagcacctgtgcggcgactggttccccatcgagtaccccgacagctggtacagagacatcaccagcaacaagaagttcttcagcctggccgccacctacagaggcgccatcgtgggcatgatcgtggccgagatcaagaacagaaccaagatccacaaggaggacggcgacatcctggccagcaacttcagcgtggacacccaggtggcctacatcctgagcctgggcgtggtgaaggagttcagaaagcacggcatcgagccccacggcctgcaccccgcccccggcctgtgcaccagccagcccgagcccctgctgcacagcgcccagagcctgccccccggcccccagcccgccctgcagctgcccgccatggtgggccacctgttccaggagtggcacagagtgcagcccgaccacgtgatgagcgccggccagcccccccccggccccaccctgagaccccccgccgagcccgccttcctgagcatctag

SEQ ID NO: 90224 - DNA, 750 bp, Artificial Sequence
  Description of Artificial Sequence: Synthetic coding sequence
atgttccccagaagaagaaccgagagaagactgggcgacaccggcaccagaaagaagatcgcctacagaaaggccgtgcccggcggcagaaagtgcggcgccagcctgagctgggagaagagcagcagagagtaccccgacagctggtacagagacatcaccagcaacaagaagttcttcagcctggccgccacctacagaggcgccatcgtgggcatgatcgtggccgagatcaagaacagaaccaagatccacaaggaggacggcgacatcctggccagcaacttcagcgtggacacccaggtggcctacatcctgagcctgggcgtggtgaaggagttcagaaagcacggcatcggcagcctgctgctggagagcctgaaggaccacatcagcaccaccgcccaggaccactgcaaggccatctacctgcacgtgctgaccaccaacaacaccgccatcaacttctacgagaacagagacttcaagcagcaccactacctgccctactactacagcatcagaggcgtgctgaaggacggcttcacctacgtgctgtacatcaacggcggccaccccccctggaccatcctggactacatccagcacctgggcagcgccctggccagcctgagcccctgcagcatcccccacagagtgtacagacaggcccacagcctgctgtgcagcttcctgccctggagcggcatcagcagcaagagcggcatcgagtacagcagaaccatgtag

SEQ ID NO: 90225 - DNA, 492 bp, Artificial Sequence
  Description of Artificial Sequence: Synthetic coding sequence
atggccgtgatcctgggcatcttcggcaccgtgcagtacagaagcagatacctgatcctgtacgccgcctggctggtgctgtgggtgggctggaacgccttcatcatctgcttctacctggaggtgggccagctgagccaggacagagacttcatcatgaccttcaacaccagcctgcacagaagctggtggatggagaacggccccggctgcctggtgacccccgtgctgaacagcagactggccctggaggaccaccacgtgatcagcgtgaccggctgcctgctggactacccctacatcgaggccctgagcagcgccctgcagatcttcctggccctgttcggcttcgtgttcgcctgctacgtgagcaaggtgttcctggaggaggaggacagcttcgacttcatcggcggcttcgacagctacggctaccaggccccccagaagaccagccacctgcagctgcagcccctgtacaccagcggctag

SEQ ID NO: 90226 - DNA, 624 bp, Artificial Sequence
  Description of Artificial Sequence: Synthetic coding sequence
atgggcaagtgcagcggcagatgcaccctggtggccttctgctgcctgcagctggtggccgccctggagagacagatcttcgacttcctgggctaccagtgggcccccatcctggccaacttcctgcacatcatggccgtgatcctgggcatcttcggcaccgtgcagtacagaagcagatacctgatcctgtacgccgcctggctggtgctgtgggtgggctggaacgccttcatcatctgcttctacctggaggtgggccagctgagccaggacagagacttcatcatgaccttcaacaccagcctgcacagaagctggtggatggagaacggccccggctgcctggtgacccccgtgctgaacagcagactggccctggaggaccaccacgtgatcagcgtgaccggctgcctgctggactacccctacatcgaggccctgagcagcgccctgcagatcttcctggccctgttcggcttcgtgttcgcctgctacgtgagcaaggtgttcctggaggaggaggacagcttcgacttcatcggcggcttcgacagctacggctaccaggccccccagaagaccagccacctgcagctgcagcccctgtacaccagcggctag

SEQ ID NO: 90227 - DNA, 411 bp, Artificial Sequence
  Description of Artificial Sequence: Synthetic coding sequence
atggccgtgatcctgggcatcttcggcaccgtgcagtacagaagcagatacctgatcctggacagagacttcatcatgaccttcaacaccagcctgcacagaagctggtggatggagaacggccccggctgcctggtgacccccgtgctgaacagcagactggccctggaggaccaccacgtgatcagcgtgaccggctgcctgctggactacccctacatcgaggccctgagcagcgccctgcagatcttcctggccctgttcggcttcgtgttcgcctgctacgtgagcaaggtgttcctggaggaggaggacagcttcgacttcatcggcggcttcgacagctacggctaccaggccccccagaagaccagccacctgcagctgcagcccctgtacaccagcggctag

SEQ ID NO: 90228 - DNA, 567 bp, Artificial Sequence
  Description of Artificial Sequence: Synthetic coding sequence
atgggctactgcagcggcagatgcaccctgatcttcatctgcggcatgcagctggtgtgcgtgctggagagacagatcttcgacttcctgggctaccagtgggcccccatcctggccaacttcgtgcacatcatcatcgtgatcctgggcctgttcggcaccatccagtacagacccagatacatcaccggctacgccgtgtggctggtgctgtgggtgacctggaacgtgttcgtgatctgcttctacctggaggccggcgacctgagcaaggagaccgacctgatcctgaccttcaacatcagcatgcacagaagctggtggatggagaacggccccggctgcaccgtgaccagcgtgacccccgcccccgactgggcccccgaggaccacagatacatcaccgtgagcggctgcctgctggagtaccagtacatcgaggtggcccacagcagcctgcagatcgtgctggccgtgagcgtgggcagccagcccctgctgctggtgcccctgggcctgttctacttctgcgccaacagcgtgcacaccaacggcatctgcggctag

SEQ ID NO: 90229 - DNA, 627 bp, Artificial Sequence
  Description of Artificial Sequence: Synthetic coding sequence
atgggctactgcagcggcagatgcaccctgatcttcatctgcggcatgcagctggtgtgcgtgctggagagacagatcttcgacttcctgggctaccagtgggcccccatcctggccaacttcgtgcacatcatcatcgtgatcctgggcctgttcggcaccatccagtacagacccagatacatcaccggctacgccgtgtggctggtgctgtgggtgacctggaacgtgttcgtgatctgcttctacctggaggccggcgacctgagcaaggagaccgacctgatcctgaccttcaacatcagcatgcacagaagctggtggatggagaacggccccggctgcaccgtgaccagcgtgacccccgcccccgactgggcccccgaggaccacagatacatcaccgtgagcggctgcctgctggagtaccagtacatcgaggtggcccacagcagcctgcagatcgtgctggccctggccggcttcatctacgcctgctacgtggtgaagtgcatcaccgaggaggaggacagcttcgacttcatcggcggcttcgacagctacggctaccagggcccccagaagaccagccacctgcagctgcagcccatgtacatgagcaagtag

SEQ ID NO: 90230 - DNA, 624 bp, Artificial Sequence
  Description of Artificial Sequence: Synthetic coding sequence
atgggcatcatcagattcctgctgctgtactgccccaccaacatcctgaccgtgtgcgtgctggagagacagatcttcgacttcctgggctaccagtgggcccccatcctggccaacttcgtgcacatcatcatcgtgatcctgggcctgttcggcaccatccagtacagacccagatacatcaccggctacgccgtgtggctggtgctgtgggtgacctggaacgtgttcgtgatctgcttctacctggaggccggcgacctgagcaaggagaccgacctgatcctgaccttcaacatcagcatgcacagaagctggtggatggagaacggccccggctgcaccgtgaccagcgtgacccccgcccccgactgggcccccgaggaccacagatacatcaccgtgagcggctgcctgctggagtaccagtacatcgaggtggcccacagcagcctgcagatcgtgctggccctggccggcttcatctacgcctgctacgtggtgaagtgcatcaccgaggaggaggacagcttcgacttcatcggcggcttcgacagctacggctaccagggcccccagaagaccagccacctgcagctgcagcccatgtacatgagcaagtag

SEQ ID NO: 90231 - DNA, 576 bp, Artificial Sequence
  Description of Artificial Sequence: Synthetic coding sequence
atgaagatcgtgtgcgtgctggagagacagatcttcgacttcctgggctaccagtgggcccccatcctggccaacttcgtgcacatcatcatcgtgatcctgggcctgttcggcaccatccagtacagacccagatacatcaccggctacgccgtgtggctggtgctgtgggtgacctggaacgtgttcgtgatctgcttctacctggaggccggcgacctgagcaaggagaccgacctgatcctgaccttcaacatcagcatgcacagaagctggtggatggagaacggccccggctgcaccgtgaccagcgtgacccccgcccccgactgggcccccgaggaccacagatacatcaccgtgagcggctgcctgctggagtaccagtacatcgaggtggcccacagcagcctgcagatcgtgctggccctggccggcttcatctacgcctgctacgtggtgaagtgcatcaccgaggaggaggacagcttcgacttcatcggcggcttcgacagctacggctaccagggcccccagaagaccagccacctgcagctgcagcccatgtacatgtag

SEQ ID NO: 90232 - DNA, 420 bp, Artificial Sequence
  Description of Artificial Sequence: Synthetic coding sequence
atgggctactgcagcggcagatgcaccctgatcttcatctgcggcatgcagctggtgtgcgtgctggagagacagatcttcgacttcctgggctaccagtgggcccccatcctggccaacttcgtgcacatcatcatcgtgatcctgggcctgttcggcaccatccagtacagacccagatacatcaccggctacgccgtgtggctggtgctgtgggtgacctggaacgtgttcgtgatctgcttctacctggaggccggcgacctgagcaagctggccggcttcatctacgcctgctacgtggtgaagtgcatcaccgaggaggaggacagcttcgacttcatcggcggcttcgacagctacggctaccagggcccccagaagaccagccacctgcagctgcagcccatgtacatgtag

SEQ ID NO: 90233 - DNA, 594 bp, Artificial Sequence
  Description of Artificial Sequence: Synthetic coding sequence
atgggctgctgcaccggcagatgcagcctgatctgcctgtgcgccctgcagctggtgagcgccctggagagacagatcttcgacttcctgggcttccagtgggcccccatcctgggcaacttcctgcacatcatcgtggtgatcctgggcctgttcggcaccatccagtacagacccagatacatcatggtgtacaccgtgtggaccgccctgtgggtgacctggaacgtgttcatcatctgcttctacctggaggtgggcggcctgagcaaggacaccgacctgatgaccttcaacatcagcgtgcacagaagctggtggagagagcacggccccggctgcgtgagaagagtgctgccccccagcgcccacggcatgatggacgactacacctacgtgagcgtgaccggctgcatcgtggacttccagtacctggaggtgatccacagcgccgtgcagatcctgctgagcctggtgggcttcgtgtacgcctgctacgtgatcagcatcagcatggaggaggaggacacctacagctgcgacctgcaggtgtgcaagcacctgttcatccagatgctgcagatcatcgagtag

SEQ ID NO: 90234 - DNA, 594 bp, Artificial Sequence; identical to SEQ ID NO: 90233
  Description of Artificial Sequence: Synthetic coding sequence

SEQ ID NO: 90235 - DNA, 486 bp, Artificial Sequence
  Description of Artificial Sequence: Synthetic coding sequence
atgggctgctgcaccggcagatgcagcctgatctgcctgtgcgccctgcagctggtgagctgggtgttcgacagacagatcttcctgctgagcttccagtgggcccccatcctgggcaacttcctgcacatcatcgtggtgatcctgggcctgttcggcaccatccagtacagacccagatacatcatggtgtacaccgtgtggaccgccctgtgggtgacctggaacgtgttcatcatctgcttctacctggaggtgggcggcctgagcaaggacaccgacctgatgaccttcaacatcagcgtgcacagaagctggtggagagagcacggccccggctgcgtgagaagagtgctgccccccagcgcccacggcatgatggacgactacacctacgtgagcgtgaccggctgcatcgtggacttccagtacctggaggtgatccacagcgccgtgcagatcctgctgagcatcttcttcctgtag

SEQ ID NO: 90236 - DNA, 627 bp, Artificial Sequence
  Description of Artificial Sequence: Synthetic coding sequence
atgggcagctgcagcggcagatgcgccctggtggtgctgtgcgccttccagctggtggccgccctggagagacaggtgttcgacttcctgggctaccagtgggcccccatcctggccaacttcgtgcacatcatcatcgtgatcctgggcctgttcggcaccatccagtacagactgagatacgtgatggtgtacaccctgtgggccgccgtgtgggtgacctggaacgtgttcatcatctgcttctacctggaggtgggcggcctgctgaaggacagcgagctgctgaccttcagcctgagcagacacagaagctggtggagagagagatggcccggctgcctgcacgaggaggtgcccgccgtgggcctgggcgccccccacggccaggccctggtgagcggcgccggctgcgccctggagcccagctacgtggaggccctgcacagctgcctgcagatcctgatcgccctgctgggcttcgtgtgcggctgccaggtggtgagcgtgttcaccgaggaggaggacagcttcgacttcatcggcggcttcgaccccttccccctgtaccacgtgaacgagaagcccagcagcctgctgagcaagcaggtgtacctgcccgcctag

SEQ ID NO: 90237 - DNA, 267 bp, Artificial Sequence
  Description of Artificial Sequence: Synthetic coding sequence
atggccgagagcagaggcagactgtacctgtggatgtgcctggccgccgccctggccagcttcctgatgggcttcatggtgggctggttcatcaagcccctgaaggagaccaccaccagcgtgagataccaccagagcatcagatggaagctggtgagcgagatgaaggccgagaacatcaagagcttcctgagaagcttcaccaagctgccccacctggccggcaccgagcagaacttcctgctggccaagaagatccagacctag

SEQ ID NO: 90238 - DNA, 2223 bp, Artificial Sequence
  Description of Artificial Sequence: Synthetic coding sequence
atggccgagagcagaggcagactgtacctgtggatgtgcctggccgccgccctggccagcttcctgatgggcttcatggtgggctggttcatcaagcccctgaaggagaccaccaccagcgtgagataccaccagagcatcagatggaagctggtgagcgagatgaaggccgagaacatcaagagcttcctgagaagcttcaccaagctgccccacctggccggcaccgagcagaacttcctgctggccaagaagatccagacccagtggaagaagttcggcctggacagcgccaagctggtgcactacgacgtgctgctgagctaccccaacgagaccaacgccaactacatcagcatcgtggacgagcacgagaccgagatcttcaagaccagctacctggagcccccccccgacggctacgagaacgtgaccaacatcgtgcccccctacaacgccttcagcgcccagggcatgcccgagggcgacctggtgtacgtgaactacgccagaaccgaggacttcttcaagctggagagagagatgggcatcaactgcaccggcaagatcgtgatcgccagatacggcaagatcttcagaggcaacaaggtgaagaacgccatgctggccggcgccatcggcatcatcctgtacagcgaccccgccgactacttcgcccccgaggtgcagccctaccccaagggctggaacctgcccggcaccgccgcccagagaggcaacgtgctgaacctgaacggcgccggcgaccccctgacccccggctaccccgccaaggagtacaccttcagactggacgtggaggagggcgtgggcatccccagaatccccgtgcaccccatcggctacaacgacgccgagatcctgctgagatacctgggcggcatcgccccccccgacaagagctggaagggcgccctgaacgtgagctacagcatcggccccggcttcaccggcagcgacagcttcagaaaggtgagaatgcacgtgtacaacatcaacaagatcaccagaatctacaacgtggtgggcaccatcagaggcagcgtggagcccgacagatacgtgatcctgggcggccacagagacagctgggtgttcggcgccatcgaccccaccagcggcgtggccgtgctgcaggagatcgccagaagcttcggcaagctgatgagcaagggctggagacccagaagaaccatcatcttcgccagctgggacgccgaggagttcggcctgctgggcagcaccgagtgggccgaggagaacgtgaagatcctgcaggagagaagcatcgcctacatcaacagcgacagcagcatcgagggcaactacaccctgagagtggactgcacccccctgctgtaccagctggtgtacaagctgaccaaggagatccccagccccgacgacggcttcgagagcaagagcctgtacgagagctggctggagaaggaccccagccccgagaacaagaacctgcccagaatcaacaagctgggcagcggcagcgacttcgaggcctacttccagagactgggcatcgccagcggcagagccagatacaccaagaacaagaagaccgacaagtacagcagctaccccgtgtaccacaccatctacgagaccttcgagctggtggagaagttctacgaccccaccttcaagaagcagctgagcgtggcccagctgagaggcgccctggtgtacgagctggtggacagcaagatcatccccttcaacatccaggactacgccgaggccctgaagaactacgccgccagcatctacaacctgagcaagaagcacgaccagcagctgaccgaccacggcgtgagcttcgacagcctgttcagcgccgtgaagaacttcagcgaggccgccagcgacttccacaagagactgatccaggtggacctgaacaaccccatcgccgtgagaatgatgaacgaccagctgatgctgctggagagagccttcatcgaccccctgggcctgcccggcaagctgttctacagacacatcatcttcgcccccagcagccacaacaagtacgccggcgagagcttccccggcatctacgacgccatcttcgacatcgagaacaaggccaacagcagactggcctggaaggaggtgaagaagcacatcagcatcgccgccttcaccatccaggccgccgccggcaccctgaaggaggtgctgtag

SEQ ID NO: 90239 - DNA, 1635 bp, Artificial Sequence
  Description of Artificial Sequence: Synthetic coding sequence
atgcagtggaccaaggtgctgggcctgggcctgggcgccgccgccctgctgggcctgggcatcatcctgggccacttcgccatccccaagaaggccaacagcctggccccccaggacctggacctggagatcctggagaccgtgatgggccagctggacgcccacagaatcagagagaacctgagagagctgagcagagagccccacctggccagcagccccagagacgaggacctggtgcagctgctgctgcagagatggaaggaccccgagagcggcctggacagcgccgaggccagcacctacgaggtgctgctgagcttccccagccaggagcagcccaacgtggtggacatcgtgggccccaccggcggcatcatccacagctgccacagaaccgaggagaacgtgaccggcgagcagggcggccccgacgtggtgcagccctacgccgcctacgcccccagcggcaccccccagggcctgctggtgtacgccaacagaggcgccgaggaggacttcaaggagctgcagacccagggcatcaagctggagggcaccatcgccctgaccagatacggcggcgtgggcagaggcgccaaggccgtgaacgccgccaagcacggcgtggccggcgtgctggtgtacaccgaccccgccgacatcaacgacggcctgagcagccccgacgagaccttccccaacagctggtacctgccccccagcggcgtggagagaggcagctactacgagtacttcggcgaccccctgaccccctacctgcccgccgtgcccagcagcttcagagtggacctggccaacgtgagcggcttcccccccatccccacccagcccatcggcttccaggacgccagagacctgctgtgcaacctgaacggcaccctggcccccgccacctggcagggcgccctgggctgccactacagactgggccccggcttcagacccgacggcgacttccccgccgacagccaggtgaacgtgagcgtgtacaacagactggagctgagaaacagcagcaacgtgctgggcatcatcagaggcgccgtggagcccgacagatacgtgctgtacggcaaccacagagacagctgggtgcacggcgccgtggaccccagcagcggcaccgccgtgctgctggagctgagcagagtgctgggcaccctgctgaagaagggcacctggagacccagaagaagcatcgtgttcgccagctggggcgccgaggagttcggcctgatcggcagcaccgagttcaccgaggagttcttcaacaagctgcaggagagaaccgtggcctacatcaacgtggacatcagcgtgttcgccaacgccaccctgagagtgcagggcaccccccccgtgcagagcgtggtgttcagcgccaccaaggagatcagaagccccggccccggcgacctgagcatctacgacaactggatcagatacttcaacagaagcagccccgtgtacggcctggtgcccagagccagactgcagcccggcagcaccccccccaccacccagcccctgacccccctgaccatgtggaccagcttctggaccagagccagcgccgccatcagactgtggcccggccagagaggcgtgtag

SEQ ID NO: 90240 - DNA, 1569 bp, Artificial Sequence
  Description of Artificial Sequence: Synthetic coding sequence
atgcagtggaccaaggtgctgggcctgggcctgggcgccgccgccctgctgggcctgggcatcatcctgggccacttcgccatccccaagaaggccaacagcctggccccccaggacctggacctggagatcctggagaccgtgatgggccagctggacgcccacagaatcagagagaacctgagagagctgagcagagagccccacctggccagcagccccagagacgaggacctggtgcagctgctgctgcagagatggaaggaccccgagagcggcctggacagcgccgaggccagcacctacgaggtgctgctgagcttccccagccaggagcagcccaacgtggtggacatcgtgggccccaccggcggcatcatccacagctgccacagaaccgaggagaacgtgaccggcgagcagggcggccccgacgtggtgcagccctacgccgcctacgcccccagcggcaccccccagggcctgctggtgtacgccaacagaggcgccgaggaggacttcaaggagctgcagacccagggcatcaagctggagggcaccatcgccctgaccagatacggcggcgtgggcagaggcgccaaggccgtgaacgccgccaagcacggcgtggccggcgtgctggtgtacaccgaccccgccgacatcaacgacggcctgagcagccccgacgagaccttccccaacagctggtacctgccccccagcggcgtggagagaggcagctactacgagtacttcggcgaccccctgaccccctacctgcccgccgtgcccagcagcttcagagtggacctggccaacgtgagcggcttcccccccatccccacccagcccatcggcttccaggacgccagagacctgctgtgcaacctgaacggcaccctggcccccgccacctggcagggcgccctgggctgccactacagactgggccccggcttcagacccgacggcgacttccccgccgacagccaggtgaacgtgagcgtgtacaacagactggagctgagaaacagcagcaacgtgctgggcatcatcagaggcgccgtggagcccgacagatacgtgctgtacggcaaccacagagacagctgggtgcacggcgccgtggaccccagcagcggcaccgccgtgctgctggagctgagcagagtgctgggcaccctgctgaagaagggcacctggagacccagaagaagcatcgtgttcgccagctggggcgccgaggagttcggcctgatcggcagcaccgagttcaccgaggagttcttcaacaagctgcaggagagaaccgtggcctacatcaacgtggacatcagcgtgttcgccaacgccaccctgagagtgcagggcaccccccccgtgcagagcgtggtgttcagcgccaccaaggagatcagaagccccggccccggcgacctgagcatctacgacaactggatcagatacttcaacagaagcagccccgtgtacggcctggtgcccagactgcagcagcccagcggctgcggccccgacagcggcgagtgcgacagccccgcccagtag

SEQ ID NO: 90241 - DNA, 2223 bp, Artificial Sequence
  Description of Artificial Sequence: Synthetic coding sequence
atgcagtggaccaaggtgctgggcctgggcctgggcgccgccgccctgctgggcctgggcatcatcctgggccacttcgccatccccaagaaggccaacagcctggccccccaggacctggacctggagatcctggagaccgtgatgggccagctggacgcccacagaatcagagagaacctgagagagctgagcagagagccccacctggccagcagccccagagacgaggacctggtgcagctgctgctgcagagatggaaggaccccgagagcggcctggacagcgccgaggccagcacctacgaggtgctgctgagcttccccagccaggagcagcccaacgtggtggacatcgtgggccccaccggcggcatcatccacagctgccacagaaccgaggagaacgtgaccggcgagcagggcggccccgacgtggtgcagccctacgccgcctacgcccccagcggcaccccccagggcctgctggtgtacgccaacagaggcgccgaggaggacttcaaggagctgcagacccagggcatcaagctggagggcaccatcgccctgaccagatacggcggcgtgggcagaggcgccaaggccgtgaacgccgccaagcacggcgtggccggcgtgctggtgtacaccgaccccgccgacatcaacgacggcctgagcagccccgacgagaccttccccaacagctggtacctgccccccagcggcgtggagagaggcagctactacgagtacttcggcgaccccctgaccccctacctgcccgccgtgcccagcagcttcagagtggacctggccaacgtgagcggcttcccccccatccccacccagcccatcggcttccaggacgccagagacctgctgtgcaacctgaacggcaccctggcccccgccacctggcagggcgccctgggctgccactacagactgggccccggcttcagacccgacggcgacttccccgccgacagccaggtgaacgtgagcgtgtacaacagactggagctgagaaacagcagcaacgtgctgggcatcatcagaggcgccgtggagcccgacagatacgtgctgtacggcaaccacagagacagctgggtgcacggcgccgtggaccccagcagcggcaccgccgtgctgctggagctgagcagagtgctgggcaccctgctgaagaagggcacctggagacccagaagaagcatcgtgttcgccagctggggcgccgaggagttcggcctgatcggcagcaccgagttcaccgaggagttcttcaacaagctgcaggagagaaccgtggcctacatcaacgtggacatcagcgtgttcgccaacgccaccctgagagtgcagggcaccccccccgtgcagagcgtggtgttcagcgccaccaaggagatcagaagccccggccccggcgacctgagcatctacgacaactggatcagatacttcaacagaagcagccccgtgtacggcctggtgcccagcctgggcagcctgggcgccggcagcgactacgcccccttcgtgcacttcctgggcatcagcagcatggacatcgcctacacctacgacagaagcaagaccagcgccagaatctaccccacctaccacaccgccttcgacaccttcgactacgtggacaagttcctggaccccggcttcagcagccaccaggccgtggccagaaccgccggcagcgtgatcctgagactgagcgacagcttcttcctgcccctgaaggtgagcgactacagcgagaccctgagaagcttcctgcaggccgcccagcaggacctgggcgccctgctggagcagcacagcatcagcctgggccccctggtgaccgccgtggagaagttcgaggccgaggccgccgccctgggccagagaatcagcaccctgcagaagggcagccccgaccccctgcaggtgagaatgctgaacgaccagctgatgctgctggagagaaccttcctgaaccccagagccttccccgaggagagatactacagccacgtgctgtgggcccccagaaccggcagcgtggtgaccttccccggcctgagcaacgcctgcagcagagccagagacaccgccagcggcagcgaggcctgggccgaggtgcagagacagctgagcatcgtggtgaccgccctggagggcgccgccgccaccctgagacccgtggccgacctgtag

SEQ ID NO: 90242 - DNA, 2220 bp, Artificial Sequence
  Description of Artificial Sequence: Synthetic coding sequence
atgcagtggaccaaggtgctgggcctgggcctgggcgccgccgccctgctgggcctgggcatcatcctgggccacttcgccatccccaagaaggccaacagcctggccccccaggacctggacctggagatcctggagaccgtgatgggccagctggacgcccacagaatcagagagaacctgagagagctgagcagagagccccacctggccagcagccccagagacgaggacctggtgcagctgctgctgcagagatggaaggaccccgagagcggcctggacagcgccgaggccagcacctacgaggtgctgctgagcttccccagccaggagcagcccaacgtggtggacatcgtgggccccaccggcggcatcatccacagctgccacagaaccgaggagaacgtgaccggcgagcagggcggccccgacgtggtgcagccctacgccgcctacgcccccagcggcaccccccagggcctgctggtgtacgccaacagaggcgccgaggaggacttcaaggagctgcagacccagggcatcaagctggagggcaccatcgccctgaccagatacggcggcgtgggcagaggcgccaaggccgtgaacgccgccaagcacggcgtggccggcgtgctggtgtacaccgaccccgccgacatcaacgacggcctgagcagccccgacgagaccttccccaacagctggtacctgccccccagcggcgtggagagaggcagctactacgagtacttcggcgaccccctgaccccctacctgcccgccgtgcccagcagcttcagagtggacctggccaacgtgagcggcttcccccccatccccacccagcccatcggcttccaggacgccagagacctgctgtgcaacctgaacggcaccctggcccccgccacctggcagggcgccctgggctgccactacagactgggccccggcttcagacccgacggcgacttccccgccgacagccaggtgaacgtgagcgtgtacaacagactggagctgagaaacagcagcaacgtgctgggcatcatcagaggcgccgtggagcccgacagatacgtgctgtacggcaaccacagagacagctgggtgcacggcgccgtggaccccagcagcggcaccgccgtgctgctggagctgagcagagtgctgggcaccctgctgaagaagggcacctggagacccagaagaagcatcgtgttcgccagctggggcgccgaggagttcggcctgatcggcagcaccgagttcaccgaggagttcttcaacaagctgcaggagagaaccgtggcctacatcaacgtggacatcagcgtgttcgccaacgccaccctgagagtgcagggcaccccccccgtgcagagcgtggtgttcagcgccaccaaggagatcagaagccccggccccggcgacctgagcatctacgacaactggatcagatacttcaacagaagcagccccgtgtacggcctggtgcccagcctgggcagcctgggcgccggcagcgactacgcccccttcgtgcacttcctgggcatcagcagcatggacatcgcctacacctacgacagaagcaagaccagcgccagaatctaccccacctaccacaccgccttcgacaccttcgactacgtggacaagttcctggaccccggcttcagcagccaccaggccgtggccagaaccgccggcagcgtgatcctgagactgagcgacagcttcttcctgcccctgaaggtgagcgactacagcgagaccctgagaagcttcctgcaggccgcccagcaggacctgggcgccctgctggagcagcacagcatcagcctgggccccctggtgaccgccgtggagaagttcgaggccgaggccgccgccctgggccagagaatcagcaccctgcagaagggcagccccgaccccctgcaggtgagaatgctgaacgaccagctgatgctgctggagagaaccttcctgaaccccagagccttccccgaggagagatactacagccacgtgctgtgggcccccagaggcctgagaagccacatccccggcctgagcaacgcctgcagcagagccagagacaccgccagcggcagcgaggcctgggccgaggtgcagagacagctgagcatcgtggtgaccgccctggagggcgccgccgccaccctgagacccgtggccgacctgtag

SEQ ID NO: 90243 - DNA, 405 bp, Artificial Sequence
  Description of Artificial Sequence: Synthetic coding sequence
atggagatcagcaagaagatcaagacccagtggaccagcctgggcctggaggacgtgcagttcgtgaactacagcgtgctgctggacctgcccggccccagccccagcaccgtgaccctgagcagcagcggccagtgcttccaccccaacggccagccctgcagcgaggaggccagaaaggacagcagccaggacctgctgtacagctacgccgcctacagcgccaagggcaccctgaaggccgaggtgatcgacgtgagctacggcatggccgacgacctgaagagaatcagaaagatcaagaacgtgaccaaccagatcgccctgctgaagctgggcaagctgcccctgctgtacaagatgaaggtgctggacaaggccgaccagaccagccccctgtactag

SEQ ID NO: 90244 - DNA, 2388 bp, Artificial Sequence
  Description of Artificial Sequence: Synthetic coding sequence
atgggcgagaacgaggccagcctgcccaacaccagcctgcagggcaagaagatggcctaccagaaggtgcacgccgaccagagagcccccggccacagccagtacctggacaacgacgacctgcaggccaccgccctggacctggagtgggacatggagaaggagctggaggagagcggcttcgaccagttccagctggacggcgccgagaaccagaacctgggccacagcgagaccatcgacctgaacctggacagcatccagcccgccaccagccccaagggcagattccagagactgcaggaggagagcgactacatcacccactacaccagaagcgcccccaagagcaacagatgcaacttctgccacgtgctgaagatcctgtgcaccgccaccatcctgttcatcttcggcatcctgatcggctactacgtgcacaccaactgccccagcgacgcccccagcagcggcaccgtggacccccagctgtaccaggagatcctgaagaccatccaggccgaggacatcaagaagagcttcagaaacctggtgcagctgtacaagaacgaggacgacatggagatcagcaagaagatcaagacccagtggaccagcctgggcctggaggacgtgcagttcgtgaactacagcgtgctgctggacctgcccggccccagccccagcaccgtgaccctgagcagcagcggccagtgcttccaccccaacggccagccctgcagcgaggaggccagaaaggacagcagccaggacctgctgtacagctacgccgcctacagcgccaagggcaccctgaaggccgaggtgatcgacgtgagctacggcatggccgacgacctgaagagaatcagaaagatcaagaacgtgaccaaccagatcgccctgctgaagctgggcaagctgcccctgctgtacaagctgagcagcctggagaaggccggcttcggcggcgtgctgctgtacatcgacccctgcgacctgcccaagaccgtgaaccccagccacgacaccttcatggtgagcctgaaccccggcggcgaccccagcacccccggctaccccagcgtggacgagagcttcagacagagcagaagcaacctgaccagcctgctggtgcagcccatcagcgcccccctggtggccaagctgatcagcagccccaaggccagaaccaagaacgaggcctgcagcagcctggagctgcccaacaacgagatcagagtggtgagcatgcaggtgcagaccgtgaccaagctgaagaccgtgaccaacgtggtgggcttcgtgatgggcctgaccagccccgacagatacatcatcgtgggcagccaccaccacaccgcccacagctacaacggccaggagtgggccagcagcaccgccatcatcaccgccttcatcagagccctgatgagcaaggtgaagagaggctggagacccgacagaaccatcgtgttctgcagctggggcggcaccgccttcggcaacatcggcagctacgagtggggcgaggacttcaagaaggtgctgcagaagaacgtggtggcctacatcagcctgcacagccccatcagaggcaacagcagcctgtaccccgtggccagccccagcctgcagcagctggtggtggagaagaacaacttcaactgcaccagaagagcccagtgccccgagaccaacatcagcagcatccagatccagggcgacgccgactacttcatcaaccacctgggcgtgcccatcgtgcagttcgcctacgaggacatcaagaccctggagggccccagcttcctgagcgaggccagattcagcaccagagccaccaagatcgaggagatggaccccagcttcaacctgcacgagaccatcaccaagctgagcggcgaggtgatcctgcagatcgccaacgagcccgtgctgcccttcaacgccctggacatcgccctggaggtgcagaacaacctgaagggcgaccagcccaacacccaccagctgctggccatggccctgagactgagagagagcgccgagctgttccagagcgacgagatgagacccgccaacgaccccaaggagagagcccccatcagaatcagaatgctgaacgacatcctgcaggacatggagaagagcttcctggtgaagcaggccccccccggcttctacagaaacatcctgtaccacctggacgagaagaccagcagattcagcatcctgatcgaggcctgggagcactgcaagcccctggccagcaacgagaccctgcaggaggccctgagcgaggtgctgaacagcatcaacagcgcccaggtgtacttcaaggccggcctggacgtgttcaagagcgtgctggacggcaagaactag

SEQ ID NO: 90245 - DNA, 1236 bp, Artificial Sequence
  Description of Artificial Sequence: Synthetic coding sequence
atgctgctgaagaccgtgctgctgctgggccacgtggcccaggtgctgatgctggacaacggcctgctgcagaccccccccatgggctggctggcctgggagagattcagatgcaacatcaactgcgacgaggaccccaagaactgcatcagcgagcagctgttcatggagatggccgacagaatggcccaggacggctggagagacatgggctacacctacctgaacatcgacgactgctggatcggcggcagagacgccagcggcagactgatgcccgaccccaagagattcccccacggcatccccttcctggccgactacgtgcacagcctgggcctgaagctgggcatctacgccgacatgggcaacttcacctgcatgggctaccccggcaccaccctggacaaggtggtgcaggacgcccagaccttcgccgagtggaaggtggacatgctgaagctggacggctgcttcagcacccccgaggagagagcccagggctaccccaagatggccgccgccctgaacgccaccggcagacccatcgccttcagctgcagctggcccgcctacgagggcggcctgccccccagagtgaactacagcctgctggccgacatctgcaacctgtggagaaactacgacgacatccaggacagctggtggagcgtgctgagcatcctgaactggttcgtggagcaccaggacatcctgcagcccgtggccggccccggccactggaacgaccccgacatgctgctgatcggcaacttcggcctgagcctggagcagagcagagcccagatggccctgtggaccgtgctggccgcccccctgctgatgagcaccgacctgagaaccatcagcgcccagaacatggacatcctgcagaaccccctgatgatcaagatcaaccaggaccccctgggcatccagggcagaagaatccacaaggagaagagcctgatcgaggtgtacatgagacccctgagcaacaaggccagcgccctggtgttcttcagctgcagaaccgacatgccctacagataccacagcagcctgggccagctgaacttcaccggcagcgtgatctacgaggcccaggacgtgtacagcggcgacatcatcagcggcctgagagacgagaccaacttcaccgtgatcatcaaccccagcggcgtggtgatgtggtacctgtaccccatcaagaacctggagatgagccagcagtag

SEQ ID NO: 90246 - DNA, 1236 bp, Artificial Sequence; identical to SEQ ID NO: 90245
  Description of Artificial Sequence: Synthetic coding sequence

SEQ ID NO: 90247 - DNA, 1236 bp, Artificial Sequence; identical to SEQ ID NO: 90245
  Description of Artificial Sequence: Synthetic coding sequence

SEQ ID NO: 90248 - DNA, 1035 bp, Artificial Sequence
  Description of Artificial Sequence: Synthetic coding sequence
atggccgccatctacggcggcgtggagggcggcggcaccagaagcgaggtgctgctggtgagcgaggacggcaagatcctggccgaggccgacggcctgagcaccaaccactggctgatcggcaccgacaagtgcgtggagagaatcaacgagatggtgaacagagccaagagaaaggccggcgtggaccccctggtgcccctgagaagcctgggcctgagcctgagcggcggcgaccaggaggacgccggcagaatcctgatcgaggagctgagagacagattcccctacctgagcgagagctacctgatcaccaccgacgccgccggcagcatcgccaccgccacccccgacggcggcgtggtgctgatcagcggcaccggcagcaactgcagactgatcaaccccgacggcagcgagagcggctgcggcggctggggccacatgatgggcgacgagggcagcgcctactggatcgcccaccaggccgtgaagatcgtgttcgacagcatcgacaacctggaggccgccccccacgacatcggctacgtgaagcaggccatgttccactacttccaggtgcccgacagactgggcatcctgacccacctgtacagagacttcgacaagtgcagattcgccggcttctgcagaaagatcgccgagggcgcccagcagggcgaccccctgagcagatacatcttcagaaaggccggcgagatgctgggcagacacatcgtggccgtgctgcccgagatcgaccccgtgctgttccagggcaagatcggcctgcccatcctgtgcgtgggcagcgtgtggaagagctgggagctgctgaaggagggcttcctgctggccctgacccagggcagagagatccaggcccagaacttcttcagcagcttcaccctgatgaagctgagacacagcagcgccctgggcggcgccagcctgggcgccagacacatcggccacctgctgcccatggactacagcgccaacgccatcgccttctacagctacaccttcagctag

SEQ ID NO: 90249 - DNA, 1173 bp, Artificial Sequence
  Description of Artificial Sequence: Synthetic coding sequence
atgagaaccagaaccggcagccagctggccgccagagaggtgaccggcagcggcgccgtgcccagacagctggagggcagaagatgccaggccggcagagacgccaacggcggcaccagcagcgacggcagcagcagcatggccgccatctacggcggcgtggagggcggcggcaccagaagcgaggtgctgctggtgagcgaggacggcaagatcctggccgaggccgacggcctgagcaccaaccactggctgatcggcaccgacaagtgcgtggagagaatcaacgagatggtgaacagagccaagagaaaggccggcgtggaccccctggtgcccctgagaagcctgggcctgagcctgagcggcggcgaccaggaggacgccggcagaatcctgatcgaggagctgagagacagattcccctacctgagcgagagctacctgatcaccaccgacgccgccggcagcatcgccaccgccacccccgacggcggcgtggtgctgatcagcggcaccggcagcaactgcagactgatcaaccccgacggcagcgagagcggctgcggcggctggggccacatgatgggcgacgagggcagcgcctactggatcgcccaccaggccgtgaagatcgtgttcgacagcatcgacaacctggaggccgccccccacgacatcggctacgtgaagcaggccatgttccactacttccaggtgcccgacagactgggcatcctgacccacctgtacagagacttcgacaagtgcagattcgccggcttctgcagaaagatcgccgagggcgcccagcagggcgaccccctgagcagatacatcttcagaaaggccggcgagatgctgggcagacacatcgtggccgtgctgcccgagatcgaccccgtgctgttccagggcaagatcggcctgcccatcctgtgcgtgggcagcgtgtggaagagctgggagctgctgaaggagggcttcctgctggccctgacccagggcagagagatccaggcccagaacttcttcagcagcttcaccctgatgaagctgagacacagcagcgccctgggcggcgccagcctgggcgccagacacatcggccacctgctgcccatggactacagcgccaacgccatcgccttctacagctacaccttcagctag

SEQ ID NO: 90250 - DNA, 1548 bp, Artificial Sequence
  Description of Artificial Sequence: Synthetic coding sequence
atggccaccagcaccggcagatggctgctgctgagactggccctgttcggcttcctgtgggaggccagcggcggcctggacagcggcgccagcagagacgacgacctgctgctgccctaccccagagccagagccagactgcccagagactgcaccagagtgagagccggcaacagagagcacgagagctggccccccccccccgccacccccggcgccggcggcctggccgtgagaaccttcgtgagccacttcagagacagagccgtggccggccacctgaccagagccgtggagcccctgagaaccttcagcgtgctggagcccggcggccccggcggctgcgccgccagaagaagagccaccgtggaggagaccgccagagccgccgactgcagagtggcccagaacggcggcttcttcagaatgaacagcggcgagtgcctgggcaacgtggtgagcgacgagagaagagtgagcagcagcggcggcctgcagaacgcccagttcggcatcagaagagacggcaccctggtgaccggctacctgagcgaggaggaggtgctggacaccgagaaccccttcgtgcagctgctgagcggcgtggtgtggctgatcagaaacggcagcatctacatcaacgagagccaggccaccgagtgcgacgagacccaggagaccggcagcttcagcaagttcgtgaacgtgatcagcgccagaaccgccatcggccacgacagaaagggccagctggtgctgttccacgccgacggccagaccgagcagagaggcatcaacctgtgggagatggccgagttcctgctgaagcaggacgtggtgaacgccatcaacctggacggcggcggcagcgccaccttcgtgctgaacggcaccctggccagctaccccagcgaccactgccaggacaacatgtggagatgccccagacaggtgagcaccgtggtgtgcgtgcacgagcccagatgccagccccccgactgccacggccacggcacctgcgtggacggccactgccagtgcaccggccacttctggagaggccccggctgcgacgagctggactgcggccccagcaactgcagccagcacggcctgtgcaccgagaccggctgcagatgcgacgccggctggaccggcagcaactgcagcgaggagtgccccctgggctggcacggccccggctgccagagaccctgcaagtgcgagcaccactgcccctgcgaccccaagaccggcaactgcagcgtgagcagagtgaagcagtgcctgcagccccccgaggccaccctgagagccggcgagctgagcttcttcaccagaaccgcctggctggccctgaccctggccctggccttcctgctgctgatcagcaccgccgccaacctgagcctgctgctgagcagagccgagagaaacagaagactgcacggcgactacgcctaccaccccctgcaggagatgaacggcgagcccctggccgccgagaaggagcagcccggcggcgcccacaaccccttcaaggactag

SEQ ID NO: 90251 - DNA, 1446 bp, Artificial Sequence
  Description of Artificial Sequence: Synthetic coding sequence
atggccaccagcaccggcagatggctgctgctgagactggccctgttcggcttcctgtgggaggccagcggcggcctggacagcggcgccagcagagacgacgacctgctgctgccctaccccagagccagagccagactgcccagagactgcaccagagtgagagccggcaacagagagcacgagagctggccccccccccccgccacccccggcgccggcggcctggccgtgagaaccttcgtgagccacttcagagacagagccgtggccggccacctgaccagagccgtggagcccctgagaaccttcagcgtgctggagcccggcggccccggcggctgcgccgccagaagaagagccaccgtggaggagaccgccagagccgccgactgcagagtggcccagaacggcggcttcttcagaatgaacagcggcgagtgcctgggcaacgtggtgagcgacgagagaagagtgagcagcagcggcggcctgcagaacgcccagttcggcatcagaagagacggcaccctggtgaccggctacctgagcgaggaggaggtgctggacaccgagaaccccttcgtgcagctgctgagcggcgtggtgtggctgatcagaaacggcagcatctacatcaacgagagccaggccaccgagtgcgacgagacccaggagaccggcagcttcagcaagttcgtgaacgtgatcagcgccagaaccgccatcggccacgacagaaagggccagctggtgctgttccacgccgacggccagaccgagcagagaggcatcaacctgtgggagatggccgagttcctgctgaagcaggacgtggtgaacgccatcaacctggacggcggcggcagcgccaccttcgtgctgaacggcaccctggccagctaccccagcgaccactgccaggacaacatgtggagatgccccagacaggtgagcaccgtggtgtgcgtgcacgagcccagatgccagccccccgactgccacggccacggcacctgcgtggacggccactgccagtgcaccggccacttctggagaggccccggctgcgacgagctggactgcggccccagcaactgcagccagcacggcctgtgcaccgagaccggctgcagatgcgacgccggctggaccggcagcaactgcagcgaggtgaagcagtgcctgcagccccccgaggccaccctgagagccggcgagctgagcttcttcaccagaaccgcctggctggccctgaccctggccctggccttcctgctgctgatcagcaccgccgccaacctgagcctgctgctgagcagagccgagagaaacagaagactgcacggcgactacgcctaccaccccctgcaggagatgaacggcgagcccctggccgccgagaaggagcagcccggcggcgcccacaaccccttcaaggactag

SEQ ID NO: 90252 - DNA, 2514 bp, Artificial Sequence
  Description of Artificial Sequence: Synthetic coding sequence
atggccgagcccagccaggcccccacccccgcccccgccgcccagcccagacccctgcagagccccgcccccgcccccacccccacccccgcccccagccccgccagcgcccccatccccacccccacccccgcccccgcccccgcccccgccgccgcccccgccggcagcaccggcaccggcggccccggcgtgggcagcggcggcgccggcagcggcggcgaccccgccagacccggcctgagccagcagcagagagccagccagagaaaggcccaggtgagaggcctgcccagagccaagaagctggagaagctgggcgtgttcagcgcctgcaaggccaacgagacctgcaagtgcaacggctggaagaaccccaagccccccaccgcccccagaatggacctgcagcagcccgccgccaacctgagcgagctgtgcagaagctgcgagcaccccctggccgaccacgtgagccacctggagaacgtgagcgaggacgagatcaacagactgctgggcatggtggtggacgtggagaacctgttcatgagcgtgcacaaggaggaggacaccgacaccaagcaggtgtacttctacctgttcaagctgctgagaaagtgcatcctgcagatgaccagacccgtggtggagggcagcctgggcagcccccccttcgagaagcccaacatcgagcagggcgtgctgaacttcgtgcagtacaagttcagccacctggcccccagagagagacagaccatgttcgagctgagcaagatgttcctgctgtgcctgaactactggaagctggagacccccgcccagttcagacagagaagccaggccgaggacgtggccacctacaaggtgaactacaccagatggctgtgctactgccacgtgccccagagctgcgacagcctgcccagatacgagaccacccacgtgttcggcagaagcctgctgagaagcatcttcaccgtgaccagaagacagctgctggagaagttcagagtggagaaggacaagctggtgcccgagaagagaaccctgatcctgacccacttccccaagttcctgagcatgctggaggaggagatctacggcgccaacagccccatctgggagagcggcttcaccatgccccccagcgagggcacccagctggtgcccagacccgccagcgtgagcgccgccgtggtgcccagcacccccatcttcagccccagcatgggcggcggcagcaacagcagcctgagcctggacagcgccggcgccgagcccatgcccggcgagaagagaaccctgcccgagaacctgaccctggaggacgccaagagactgagagtgatgggcgacatccccatggagctggtgaacgaggtgatgctgaccatcaccgaccccgccgccatgctgggccccgagaccagcctgctgagcgccaacgccgccagagacgagaccgccagactggaggagagaagaggcatcatcgagttccacgtgatcggcaacagcctgacccccaaggccaacagaagagtgctgctgtggctggtgggcctgcagaacgtgttcagccaccagctgcccagaatgcccaaggagtacatcgccagactggtgttcgaccccaagcacaagaccctggccctgatcaaggacggcagagtgatcggcggcatctgcttcagaatgttccccacccagggcttcaccgagatcgtgttctgcgccgtgaccagcaacgagcaggtgaagggctacggcacccacctgatgaaccacctgaaggagtaccacatcaagcacaacatcctgtacttcctgacctacgccgacgagtacgccatcggctacttcaagaagcagggcttcagcaaggacatcaaggtgcccaagagcagatacctgggctacatcaaggactacgagggcgccaccctgatggagtgcgagctgaaccccagaatcccctacaccgagctgagccacatcatcaagaagcagaaggagatcatcaagaagctgatcgagagaaagcaggcccagatcagaaaggtgtaccccggcctgagctgcttcaaggagggcgtgagacagatccccgtggagagcgtgcccggcatcagagagaccggctggaagcccctgggcaaggagaagggcaaggagctgaaggaccccgaccagctgtacaccaccctgaagaacctgctggcccagatcaagagccaccccagcgcctggcccttcatggagcccgtgaagaagagcgaggcccccgactactacgaggtgatcagattccccatcgacctgaagaccatgaccgagagactgagaagcagatactacgtgaccagaaagctgttcgtggccgacctgcagagagtgatcgccaactgcagagagtacaacccccccgacagcgagtactgcagatgcgccagcgccctggagaagttcttctacttcaagctgaaggagggcggcctgatcgacaagtag

SEQ ID NO: 90253 - DNA, 1260 bp, Artificial Sequence
  Description of Artificial Sequence: Synthetic coding sequence
ccccagtgctgcctgcacagcagaggcatgttccccagactgagccccgtggacaccgaggccgtgtggctgctgcagggctggctgttccagcaccagccccagttctggggccccgcccagatcagagccgtgctgggcgccgtgcccagaggcagactgctggtgctggacctgttcgccgagagccagcccgtgtacaccagaaccgccagcttccagggccagcccttcatctggtgcatgctgcacaacttcggcggcaaccacggcctgttcggcgccctggaggccgtgaacggcggccccgaggccgccagactgttccccaacagcaccatggtgggcaccggcatggcccccgagggcatcagccagaacgaggtggtgtacagcctgatggccgagctgggctggagaaaggaccccgtgcccgacctggccgcctgggtgaccagcttcgccgccagaagatacggcgtgagccaccccgacgccggcgccgcctggagactgctgctgagaagcgtgtacaactgcagcggcgaggcctgcagaggccacaacagaagccccctggtgagaagacccagcctgcagatgaacaccagcatctggtacaacagaagcgacgtgttcgaggcctggagactgctgctgaccagcgcccccagcctggccaccagccccgccttcagatacgacctgctggacctgaccagacaggccgtgcaggagctggtgagcctgtactacgaggaggccagaagcgcctacctgagcaaggagctggccagcctgctgagagccggcggcgtgctggcctacgagctgctgcccgccctggacgaggtgctggccagcgacagcagattcctgctgggcagctggctggagcaggccagagccgccgccgtgagcgaggccgaggccgacttctacgagcagaacagcagataccagctgaccctgtggggccccgagggcaacatcctggactacgccaacaagcagctggccggcctggtggccaactactacacccccagatggagactgttcctggaggccctggtggacagcgtggcccagggcatccccttccagcagcaccagttcgacaagaacgtgttccagctggagcaggccttcgtgctgagcaagcagagataccccagccagcccagaggcgacaccgtggacctggccaagaagatcttcctgaagtactaccccagatgggtggccggcagctggtag

SEQ ID NO: 90254 - DNA, 963 bp, Artificial Sequence
  Description of Artificial Sequence: Synthetic coding sequence
atggccttccccaagaagaagctgcagggcctggtggccgccaccatcacccccatgaccgagaacggcgagatcaacttcagcgtgatcggccagtacgtggactacctggtgaaggagcagggcgtgaagaacatcttcgtgaacggcaccaccggcgagggcctgagcctgagcgtgagcgagagaagacaggtggccgaggagtgggtgaccaagggcaaggacaagctggaccaggtgatcatccacgtgggcgccctgagcctgaaggagagccaggagctggcccagcacgccgccgagatcggcgccgacggcatcgccgtgatcgcccccttcttcctgaagccctggaccaaggacatcctgatcaacttcctgaaggaggtggccgccgccgcccccgccctgcccttctactactaccacatccccgccctgaccggcgtgaagatcagagccgaggagctgctggacggcatcctggacaagatccccaccttccagggcctgaagttcagcgacaccgacctgctggacttcggccagtgcgtggaccagaacagacagcagcagttcgccttcctgttcggcgtggacgagcagctgctgagcgccctggtgatgggcgccaccggcgccgtgggcagcacctacaactacctgggcaagaagaccaaccagatgctggaggccttcgagcagaaggacttcagcctggccctgaactaccagttctgcatccagagattcatcaacttcgtggtgaagctgggcttcggcgtgagccagaccaaggccatcatgaccctggtgagcggcatccccatgggcccccccagactgcccctgcagaaggccagcagagagttcaccgacagcgccgaggccaagctgaagagcctggacttcctgagcttcaccgacctgaaggacggcaacctggaggccggcagctag

SEQ ID NO: 90255 - DNA, 330 bp, Artificial Sequence
  Description of Artificial Sequence: Synthetic coding sequence
atggccttccccaagaagaagctgcagggcctggtggccgccaccatcacccccatgaccgagaacggcgagatcaacttcagcgtgatcggccagtacgtggactacctggtgaaggagcagggcgtgaagaacatcttcgtgaacggcaccaccggcgagggcctgagcctgagcgtgagcgagagaagacaggtggccgaggagtgggtgaccaagggcaaggacaagagcaaccaccacaagctgggcaccatcagaaccacccagagcagaagaagcagcttcagaagacagctgaaggcctggcacagcggcagccacctgtag

SEQ ID NO: 90256 - DNA, 558 bp, Artificial Sequence
  Description of Artificial Sequence: Synthetic coding sequence
atgagcagagcccccggcatcctggccagctggagaagagcccccagcctgagcgtgcagaagggcagccagaccgccagacacacctgccaccccgaggtgcccctgggcaactgcttcctgcccgtgtacaaggccagccccctgaccgtgaccagactgtgggccgagagactggaccaggtgatcatccacgtgggcgccctgagcctgaaggagagccaggagctggcccagcacgccgccgagatcggcgccgacggcatcgccgtgatcgcccccttcttcctgaagccctggaccaaggacatcctgatcaacttcctgaaggaggtggccgccgccgcccccgccctgcccttctactactaccacatccccgccctgaccggcgtgaagatcagagccgaggagctgctggacggcatcctggacaagatccccaccttccagggcctgaagttcagcgacaccgacctgctggacttcggccagtgcgtggaccagaacagacagcagcagttcgccttcctgttcggcgtggacgagcacctgtag

SEQ ID NO: 90257 - DNA, 723 bp, Artificial Sequence
  Description of Artificial Sequence: Synthetic coding sequence
atggccttccccaagaagaagctgcagggcctggtggccgccaccatcacccccatgaccgagaacggcgagatcaacttcagcgtgatcggccagtacgtggactacctggtgaaggagcagggcgtgaagaacatcttcgtgaacggcaccaccggcgagggcctgagcctgagcgtgagcgagagaagacaggtggccgaggagtgggtgaccaagggcaaggacaagctggaccaggtgatcatccacgtgggcgccctgagcctgaaggagagccaggagctggcccagcacgccgccgagatcggcgccgacggcatcgccgtgatcgcccccttcttcctgaagccctggaccaaggacatcctgatcaacttcctgaaggaggtggccgccgccgcccccgccctgcccttctactactaccacatccccgccctgaccggcgtgaagatcagagccgaggagctgctggacggcatcctggacaagatccccaccttccagggcctgaagttcagcgacaccgacctgctggacttcggccagtgcgtggaccagaacagacagcagcagttcgccttcctgttcggcgtggacgagttctgcatccagagattcatcaacttcgtggtgaagctggagaacagcaagctgaaggtgagcaagaaccagagaaccctgcccctgggcaccaccaacttccccttcctgcactag

SEQ ID NO: 90258 - DNA, 963 bp, Artificial Sequence; identical to SEQ ID NO: 90254
  Description of Artificial Sequence: Synthetic coding sequence

SEQ ID NO: 90259 - DNA, 906 bp, Artificial Sequence
  Description of Artificial Sequence: Synthetic coding sequence
atgagcagagcccccggcatcctggccagctggagaagagcccccagcctgagcgtgcagaagggcagccagaccgccagacacacctgccaccccgaggtgcccctgggcaactgcttcctgcccgtgtacaaggccagccccctgaccgtgaccagactgtgggccgagagactggaccaggtgatcatccacgtgggcgccctgagcctgaaggagagccaggagctggcccagcacgccgccgagatcggcgccgacggcatcgccgtgatcgcccccttcttcctgaagccctggaccaaggacatcctgatcaacttcctgaaggaggtggccgccgccgcccccgccctgcccttctactactaccacatccccgccctgaccggcgtgaagatcagagccgaggagctgctggacggcatcctggacaagatccccaccttccagggcctgaagttcagcgacaccgacctgctggacttcggccagtgcgtggaccagaacagacagcagcagttcgccttcctgttcggcgtggacgagcagctgctgagcgccctggtgatgggcgccaccggcgccgtgggcagcacctacaactacctgggcaagaagaccaaccagatgctggaggccttcgagcagaaggacttcagcctggccctgaactaccagttctgcatccagagattcatcaacttcgtggtgaagctgggcttcggcgtgagccagaccaaggccatcatgaccctggtgagcggcatccccatgggcccccccagactgcccctgcagaaggccagcagagagttcaccgacagcgccgaggccaagctgaagagcctggacttcctgagcttcaccgacctgaaggacggcaacctggaggccggcagctag

SEQ ID NO: 90260 - DNA, 723 bp, Artificial Sequence; identical to SEQ ID NO: 90257
  Description of Artificial Sequence: Synthetic coding sequence

SEQ ID NO: 90261 - DNA, 624 bp, Artificial Sequence
  Description of Artificial Sequence: Synthetic coding sequence
agagagggccagaagggcagccagaccgccagacacacctgccaccccgaggtgcccctgggcaactgcttcctgcccgtgtacaaggccagccccctgaccgtgaccagactgtgggccgagagactggaccaggtgatcatccacgtgggcgccctgagcctgaaggagagccaggagctggcccagcacgccgccgagatcggcgccgacggcatcgccgtgatcgcccccttcttcctgaagccctggaccaaggacatcctgatcaacttcctgaaggaggtggccgccgccgcccccgccctgcccttctactactaccacatccccgccctgaccggcgtgaagaccaccgtggagtgcagcggcgacggcagcaactggagcagcggccagttctgcatccagagattcatcaacttcgtggtgaagctgggcttcggcgtgagccagaccaaggccatcatgaccctggtgagcggcatccccatgggcccccccagactgcccctgcagaaggccagcagagagttcaccgacagcgccgaggccaagctgaagagcctggacttcctgagcttcaccgacctgaaggacggcaacctggaggccggcagctag

SEQ ID NO: 90262 - DNA, 747 bp, Artificial Sequence
  Description of Artificial Sequence: Synthetic coding sequence
atgggcctgagcagagtgagagccgtgttcttcgacctggacaacaccctgatcgacaccgccggcgccagcagaagaggcatgctggaggtgatcaagctgctgcagagcaagtaccactacaaggaggaggccgagatcatctgcgacaaggtgcaggtgaagctgagcaaggagtgcttccacccctacaacacctgcatcaccgacctgagaaccagccactgggaggaggccatccaggagaccaagggcggcgccgccaacagaaagctggccgaggagtgctacttcctgtggaagagcaccagactgcagcacatgaccctggccgaggacgtgaaggccatgctgaccgagctgagaaaggaggtgagactgctgctgctgaccaacggcgacagacagacccagagagagaagatcgaggcctgcgcctgccagagctacttcgacgccgtggtggtgggcggcgagcagagagaggagaagcccgcccccagcatcttctactactgctgcaacctgctgggcgtgcagcccggcgactgcgtgatggtgggcgacaccctggagaccgacatccagggcggcctgaacgccggcctgaaggccaccgtgtggatcaacaagaacggcatcgtgcccctgaagagcagccccgtgccccactacatggtgagcagcgtgctggagctgcccgccctgctgcagagcatcgactgcaaggtgagcatgagcacctag

SEQ ID NO: 90263 - DNA, 1515 bp, Artificial Sequence
  Description of Artificial Sequence: Synthetic coding sequence
atggccgcccaggccctggccctgctgagagaggtggccagactggaggcccccctggaggagctgagagccctgcacagcgtgctgcaggccgtgcccctgaacgagctgagacagcaggccgccgagctgagactgggccccctgttcagcctgctgaacgagaaccacagagagaagaccaccctgtgcgtgagcatcctggagagactgctgcaggccatggagcccgtgcacgtggccagaaacctgagagtggacctgcagagaggcctgatccaccccgacgacagcgtgaagatcctgaccctgagccagatcggcagaatcgtggagaacagcgacgccgtgaccgagatcctgaacaacgccgagctgctgaagcagatcgtgtactgcatcggcggcgagaacctgagcgtggccaaggccgccatcaagagcctgagcagaatcagcctgacccaggccggcctggaggccctgttcgagagcaacctgctggacgacctgaagagcgtgatgaagaccaacgacatcgtgagatacagagtgtacgagctgatcatcgagatcagcagcgtgagccccgagagcctgaactactgcaccaccagcggcctggtgacccagctgctgagagagctgaccggcgaggacgtgctggtgagagccacctgcatcgagatggtgaccagcctggcctacacccaccacggcagacagtacctggcccaggagggcgtgatcgaccagatcagcaacatcatcgtgggcgccgacagcgaccccttcagcagcttctacctgcccggcttcgtgaagttcttcggcaacctggccgtgatggacagcccccagcagatctgcgagagataccccatcttcgtggagaaggtgttcgagatgatcgagagccaggaccccaccatgatcggcgtggccgtggacaccgtgggcatcctgggcagcaacgtggagggcaagcaggtgctgcagaagaccggcaccagattcgagagactgctgatgagaatcggccaccagagcaagaacgcccccgtggagctgaagatcagatgcctggacgccatcagcagcctgctgtacctgccccccgagcagcagaccgacgacctgctgagaatgaccgagagctggttcagcagcctgagcagagaccccctggagctgttcagaggcatcagcagccagcccttccccgagctgcactgcgccgccctgaaggtgttcaccgccatcgccaaccagccctgggcccagaagctgatgttcaacagccccggcttcgtggagtacgtggtggacagaagcgtggagcacgacaaggccagcaaggacgccaagtacgagctggtgaaggccctggccaacagcaagaccatcgccgagatcttcggcaaccccaactacctgagactgagaacctacctgagcgagggcccctactacgtgaagcccgtgagcaccaccgccgtggagggcgccgagtag

SEQ ID NO: 90264 - DNA, 423 bp, Artificial Sequence
  Description of Artificial Sequence: Synthetic coding sequence
atggtgctggtgctggactacagcggcagacccatggtgatcagcagcggcatgcagagcatggacaccatgaagcaggtgtaccagatcgtgaagcccctgaaccccaacttctgcttcctgcagtgcaccagcgcctaccccctgcagcccgaggacgtgaacctgagagtgatcagcgagtaccagaagctgttccccgacatccccatcggctacagcggccacgagaccggcatcgccatcagcgtggccgccgtggccctgggcgccaaggtgctggagagacacatcaccctggacaagacctggaagggcagcgaccacagcgccagcctggagcccggcgagctggccgagctggtgagaagcgtgagactggtggagagagccctgggcagccccaccaagcagctgctgtag

SEQ ID NO: 90265 - DNA, 348 bp, Artificial Sequence
  Description of Artificial Sequence: Synthetic coding sequence
gaggacgtgaacctgagagtgatcagcgagtaccagaagctgttccccgacatccccatcggctacagcggccacgagaccggcatcgccatcagcgtggccgccgtggccctgggcgccaaggtgctggagagacacatcaccctggacaagacctggaagggcagcgaccacagcgccagcctggagcccggcgagctggccgagctggtgagaagcgtgagactggtggagagagccctgggcagccccaccaagcagctgctgccctgcgagatggcctgcaacgagaaggtgtgccccgccggcctgtacagcgtgctgctgccctgcgtggagaagggctag

SEQ ID NO: 90266 - DNA, 873 bp, Artificial Sequence
  Description of Artificial Sequence: Synthetic coding sequence
atggacatcgaggcctacctggagagaatcggctacaagaagagcagaaacaagctggacctggagaccctgaccgacatcctgcagcaccagatcagagccgtgcccttcgagaacctgaacatccactgcggcgacgccatggacctgggcctggaggccatcttcgaccaggtggtgagaagaaacagaggcggctggtgcctgcaggtgaaccacctgctgtactgggccctgaccaccatcggcttcgagaccaccatgctgggcggctacgtgtacagcacccccgccaagaagtacagcaccggcatgatccacctgctgctgcaggtgaccatcgacggcagaaactacatcgtggacgccggcttcggcagaagctaccagatgtggcagcccctggagctgatcagcggcaaggaccagccccaggtgccctgcgtgttcagactgaccgaggagaacggcttctggtacctggaccagatcagaagagagcagtacatccccaacgaggagttcctgcacagcgacctgctggaggacagcaagtacagaaagatctacagcttcaccctgaagcccagaaccatcgaggacttcgagagcatgaacacctacctgcagaccagccccagcagcgtgttcaccagcaagagcttctgcagcctgcagacccccgacggcgtgcactgcctggtgggcttcaccctgacccacagaagattcaactacaaggacaacaccgacctgatcgagttcaagaccctgagcgaggaggagatcgagaaggtgctgaagaacatcttcaacatcagcctgcagagaaagctggtgcccaagcacggcgacagattcttcaccatctag

SEQ ID NO: 90267 - DNA, 873 bp, Artificial Sequence; identical to SEQ ID NO: 90266
  Description of Artificial Sequence: Synthetic coding sequence

SEQ ID NO: 90268 - DNA, 873 bp, Artificial Sequence; identical to SEQ ID NO: 90266
  Description of Artificial Sequence: Synthetic coding sequence

SEQ ID NO: 90269 - DNA, 873 bp, Artificial Sequence; identical to SEQ ID NO: 90266
  Description of Artificial Sequence: Synthetic coding sequence

SEQ ID NO: 90270 - DNA, 873 bp, Artificial Sequence; identical to SEQ ID NO: 90266
  Description of Artificial Sequence: Synthetic coding sequence

SEQ ID NO: 90271 - DNA, 873 bp, Artificial Sequence; identical to SEQ ID NO: 90266
  Description of Artificial Sequence: Synthetic coding sequence

SEQ ID NO: 90272 - DNA, 873 bp, Artificial Sequence; identical to SEQ ID NO: 90266
  Description of Artificial Sequence: Synthetic coding sequence

SEQ ID NO: 90273 - DNA, 1059 bp, Artificial Sequence
  Description of Artificial Sequence: Synthetic coding sequence
atgctgctgctgctgctgcacaaggaggccgccctggagccccagggccccgccgtgggctacaacagcctgcccgtgagcgacgaccaccacgtgagcggcatccaggccagaaagaagcagcagagcgtgttctggatcaagaccgaggaccagcccaccttcaacctgctgagaaagggcatcatggacatcgaggcctacctggagagaatcggctacaagaagagcagaaacaagctggacctggagaccctgaccgacatcctgcagcaccagatcagagccgtgcccttcgagaacctgaacatccactgcggcgacgccatggacctgggcctggaggccatcttcgaccaggtggtgagaagaaacagaggcggctggtgcctgcaggtgaaccacctgctgtactgggccctgaccaccatcggcttcgagaccaccatgctgggcggctacgtgtacagcacccccgccaagaagtacagcaccggcatgatccacctgctgctgcaggtgaccatcgacggcagaaactacatcgtggacgccggcttcggcagaagctaccagatgtggcagcccctggagctgatcagcggcaaggaccagccccaggtgccctgcgtgttcagactgaccgaggagaacggcttctggtacctggaccagatcagaagagagcagtacatccccaacgaggagttcctgcacagcgacctgctggaggacagcaagtacagaaagatctacagcttcaccctgaagcccagaaccatcgaggacttcgagagcatgaacacctacctgcagaccagccccagcagcgtgttcaccagcaagagcttctgcagcctgcagacccccgacggcgtgcactgcctggtgggcttcaccctgacccacagaagattcaactacaaggacaacaccgacctgatcgagttcaagaccctgagcgaggaggagatcgagaaggtgctgaagaacatcttcaacatcagcctgcagagaaagctggtgcccaagcacggcgacagattcttcaccatctag

SEQ ID NO: 90274 - DNA, 873 bp, Artificial Sequence
  Description of Artificial Sequence: Synthetic coding sequence
atggacatcgaggcctacttcgagagaatcggctacaagaacagcagaaacaagctggacctggagaccctgaccgacatcctggagcaccagatcagagccgtgcccttcgagaacctgaacatgcactgcggccaggccatggagctgggcctggaggccatcttcgaccacatcgtgagaagaaacagaggcggctggtgcctgcaggtgaaccagctgctgtactgggccctgaccaccatcggcttccagaccaccatgctgggcggctacttctacatcccccccgtgaacaagtacagcaccggcatggtgcacctgctgctgcaggtgaccatcgacggcagaaactacatcgtggacgccggcagcggcagcagcagccagatgtggcagcccctggagctgatcagcggcaaggaccagccccaggtgccctgcatcttctgcctgaccgaggagagaggcatctggtacctggaccagatcagaagagagcagtacatcaccaacaaggagttcctgaacagccacctgctgcccaagaagaagcaccagaagatctacctgttcaccctggagcccagaaccatcgaggacttcgagagcatgaacacctacctgcagaccagccccaccagcagcttcatcaccaccagcttctgcagcctgcagacccccgagggcgtgtactgcctggtgggcttcatcctgacctacagaaagttcaactacaaggacaacaccgacctggtggagttcaagaccctgaccgaggaggaggtggaggaggtgctgagaaacatcttcaagatcagcctgggcagaaacctggtgcccaagcccggcgacggcagcctgaccatctag

SEQ ID NO: 90275 - DNA, 684 bp, Artificial Sequence
  Description of Artificial Sequence: Synthetic coding sequence
atggccccctgccacatcagaaagtaccaggagagcgacagacagtgggtggtgggcctgctgagcagaggcatggccgagcacgcccccgccaccttcagacagctgctgaagctgcccagaaccctgatcctgctgctgggcggccccctggccctgctgctggtgagcggcagctggctgctggccctggtgttcagcatcagcctgttccccgccctgtggttcctggccaagaagccctggaccgagtacgtggacatgaccctgtgcaccgacatgagcgacatcaccaagagctacctgagcgagagaggcagctgcttctgggtggccgagagcgaggagaaggtggtgggcatggtgggcgccctgcccgtggacgaccccaccctgagagagaagagactgcagctgttccacctgttcgtggacagcgagcacagaagacagggcatcgccaaggccctggtgagaaccgtgctgcagttcgccagagaccagggctacagcgaggtgatcctggacaccggcaccatccagctgagcgccatggccctgtaccagagcatgggcttcaagaagaccggccagagcttcttctgcgtgtgggccagactggtggccctgcacaccgtgcacttcatctaccacctgcccagcagcaaggtgggcagcctgtag

SEQ ID NO: 90276 - DNA, 405 bp, Artificial Sequence
  Description of Artificial Sequence: Synthetic coding sequence
atggccgacatcgagcagtactacatgaagccccccggcagctgcttctgggtggccgtgctggacggcaacgtggtgggcatcgtggccgccagagcccacgaggaggacaacaccgtggagctgctgagaatgagcgtggacagcagattcagaggcaagggcatcgccaaggccctgggcagaaaggtgctggagttcgccgtggtgcacaactacagcgccgtggtgctgggcaccaccgccgtgaaggtggccgcccacaagctgtacgagagcctgggcttcagacacatgggcgccagcgaccactacgtgctgcccggcatgaccctgagcctggccgagagactgttcttccaggtgagataccacagatacagactgcagctgagagaggagtag

SEQ ID NO: 90277 - DNA, 909 bp, Artificial Sequence
  Description of Artificial Sequence: Synthetic coding sequence
atgcactgcggcccccccgacatggtgtgcgagaccaagatcgtggccgccgaggaccacgaggccctgcccggcgccaagaaggacgccctgctggccgccgccggcgccatgtggccccccctgcccgccgcccccggccccgccgccgccccccccgcccccccccccgcccccgtggcccagccccacggcggcgccggcggcgccggcccccccggcggcagaggcgtgtgcatcagagagttcagagccgccgagcaggaggccgccagaagaatcttctacgacggcatcatggagagaatccccaacaccgccttcagaggcctgagacagcaccccagagcccagctgctgtacgccctgctggccgccctgtgcttcgccgtgagcagaagcctgctgctgacctgcctggtgcccgccgccctgctgggcctgagatactactacagcagaaaggtgatcagagcctacctggagtgcgccctgcacaccgacatggccgacatcgagcagtactacatgaagccccccggcagctgcttctgggtggccgtgctggacggcaacgtggtgggcatcgtggccgccagagcccacgaggaggacaacaccgtggagctgctgagaatgagcgtggacagcagattcagaggcaagggcatcgccaaggccctgggcagaaaggtgctggagttcgccgtggtgcacaactacagcgccgtggtgctgggcaccaccgccgtgaaggtggccgcccacaagctgtacgagagcctgggcttcagacacatgggcgccagcgaccactacgtgctgcccggcatgaccctgagcctggccgagagactgttcttccaggtgagataccacagatacagactgcagctgagagaggagtag

SEQ ID NO: 90278 - DNA, 1182 bp, Artificial Sequence
  Description of Artificial Sequence: Synthetic coding sequence
atggacgagaacgagagcaaccagagcctgatgaccagcagccagtaccccaaggaggccgtgagaaagagacagaacagcgccagaaacagcggcgccagcgacagcagcagattcagcagaaagagcttcaagctggactacagactggaggaggacgtgaccaagagcaagaagggcaaggacggcagattcgtgaacccctggcccacctggaagaaccccagcatccccaacgtgctgagatggctgatcatggagaaggaccacagcagcgtgcccagcagcaaggaggagctggacaaggagctgcccgtgctgaagccctacttcatcaccaaccccgaggaggccggcgtgagagaggccggcctgagagtgacctggctgggccacgccaccgtgatggtggagatggacgagctgatcttcctgaccgaccccatcttcagcagcagagccagccccagccagtacatgggccccaagagattcagaagaagcccctgcaccatcagcgagctgccccccatcgacgccgtgctgatcagccacaaccactacgaccacctggactacaacagcgtgatcgccctgaacgagagattcggcaacgagctgagatggttcgtgcccctgggcctgctggactggatgcagaagtgcggctgcgagaacgtgatcgagctggactggtgggaggagaactgcgtgcccggccacgacaaggtgaccttcgtgttcacccccagccagcactggtgcaagagaaccctgatggacgacaacaaggtgctgtggggcagctggagcgtgctgggcccctggaacagattcttcttcgccggcgacaccggctactgccccgccttcgaggagatcggcaagagattcggccccttcgacctggccgccatccccatcggcgcctacgagcccagatggttcatgaagtaccagcacgtggaccccgaggaggccgtgagaatccacaccgacgtgcagaccaagaagagcatggccatccactggggcaccttcgccctggccaacgagcactacctggagccccccgtgaagctgaacgaggccctggagagatacggcctgaacgccgaggacttcttcgtgctgaagcacggcgagagcagatacctgaacaacgacgacgagaacttctag

SEQ ID NO: 90279 - DNA, 375 bp, Artificial Sequence
  Description of Artificial Sequence: Synthetic coding sequence
atggacgagaacgagagcaaccagagcctgatgaccagcagccagtaccccaaggaggccgtgagaaagagacagaacagcgccagaaacagcggcgccagcgacagcagcagattcagcagaaagagcttcaagctggactacagactggaggaggacgtgaccaagagcaagaagggcaaggacggcagattcgtgaacccctggcccacctggaagaaccccagcatccccaacgtgctgagatggctgatcatggagaaggaccacagcagcgtgcccagcagcaaggaggagctggacaaggagctgcccgtgctgaagccctacttcatcaccaaccccgaggaggccggcgtgagagaggccggctag

SEQ ID NO: 90280 - DNA, 1182 bp, Artificial Sequence; identical to SEQ ID NO: 90278
  Description of Artificial Sequence: Synthetic coding sequence

SEQ ID NO: 90281 - DNA, 18 bp, Artificial Sequence
  Description of Artificial Sequence: Synthetic coding sequence
atggacgagaacgagtag

SEQ ID NO: 90282 - DNA, 1182 bp, Artificial Sequence; identical to SEQ ID NO: 90278
  Description of Artificial Sequence: Synthetic coding sequence

SEQ ID NO: 90283 - DNA, 1401 bp, Artificial Sequence
  Description of Artificial Sequence: Synthetic coding sequence
atggccagaagaagagagctgaagagatgcctgcagctgctggccagcagcgccgagcccgccagaagagccagagtgagaaagaaccccagcgcctgcagaggcagacccagcagatacgccgccgccctgtgcgccggcaccctgtggcccgaggccgccgagctgagaagaagagccctgcccgccacccccagcgccagcagcagccccaaggacatggacgagaacgagagcaaccagagcctgatgaccagcagccagtaccccaaggaggccgtgagaaagagacagaacagcgccagaaacagcggcgccagcgacagcagcagattcagcagaaagagcttcaagctggactacagactggaggaggacgtgaccaagagcaagaagggcaaggacggcagattcgtgaacccctggcccacctggaagaaccccagcatccccaacgtgctgagatggctgatcatggagaaggaccacagcagcgtgcccagcagcaaggaggagctggacaaggagctgcccgtgctgaagccctacttcatcaccaaccccgaggaggccggcgtgagagaggccggcctgagagtgacctggctgggccacgccaccgtgatggtggagatggacgagctgatcttcctgaccgaccccatcttcagcagcagagccagccccagccagtacatgggccccaagagattcagaagaagcccctgcaccatcagcgagctgccccccatcgacgccgtgctgatcagccacaaccactacgaccacctggactacaacagcgtgatcgccctgaacgagagattcggcaacgagctgagatggttcgtgcccctgggcctgctggactggatgcagaagtgcggctgcgagaacgtgatcgagctggactggtgggaggagaactgcgtgcccggccacgacaaggtgaccttcgtgttcacccccagccagcactggtgcaagagaaccctgatggacgacaacaaggtgctgtggggcagctggagcgtgctgggcccctggaacagattcttcttcgccggcgacaccggctactgccccgccttcgaggagatcggcaagagattcggccccttcgacctggccgccatccccatcggcgcctacgagcccagatggttcatgaagtaccagcacgtggaccccgaggaggccgtgagaatccacaccgacgtgcagaccaagaagagcatggccatccactggggcaccttcgccctggccaacgagcactacctggagccccccgtgaagctgaacgaggccctggagagatacggcctgaacgccgaggacttcttcgtgctgaagcacggcgagagcagatacctgaacaacgacgacgagaacttctag

SEQ ID NO: 90284 - DNA, 1182 bp, Artificial Sequence; identical to SEQ ID NO: 90278
  Description of Artificial Sequence: Synthetic coding sequence

SEQ ID NO: 90285 - DNA, 2199 bp, Artificial Sequence
  Description of Artificial Sequence: Synthetic coding sequence
atggagagacaggtgctgctgagcgagcccgaggaggccgccgccctgtacagaggcctgagcagacagcccgccctgagcgccgcctgcctgggccccgaggtgaccacccagtacggcggccagtacagaaccgtgcacaccgagtggacccagagagacctggagagaatggagaacatcagattctgcagacagtacctggtgttccacgacggcgacagcgtggtgttcgccggccccgccggcaacagcgtggagaccagaggcgagctgctgagcagagagagccccagcggcaccatgaaggccgtgctgagaaaggccggcggcaccggccccggcgaggagaagcagttcctggaggtgtgggagaagaacagaaagctgaagagcttcaacctgagcgccctggagaagcacggccccgtgtacgaggacgactgcttcggctgcctgagctggagccacagcgagacccacctgctgtacgtggccgagaagaagagacccaaggccgagagcttcttccagaccaaggccctggacgtgagcgccagcgacgacgagatcgccagactgaagaagcccgaccaggccatcaagggcgaccagttcgtgttctacgaggactggggcgagaacatggtgagcaagagcatccccgtgctgtgcgtgctggacgtggagagcggcaacatcagcgtgctggagggcgtgcccgagaacgtgagccccggccaggccttctgggcccccggcgacgccggcgtggtgttcgtgggctggtggcacgagcccttcagactgggcatcagattctgcaccaacagaagaagcgccctgtactacgtggacctgatcggcggcaagtgcgagctgctgagcgacgacagcctggccgtgagcagccccagactgagccccgaccagtgcagaatcgtgtacctgcagtaccccagcctgatcccccaccaccagtgcagccagctgtgcctgtacgactggtacaccaaggtgaccagcgtggtggtggacgtggtgcccagacagctgggcgagaacttcagcggcatctactgcagcctgctgcccctgggctgctggagcgccgacagccagagagtggtgttcgacagcgcccagagaagcagacaggacctgttcgccgtggacacccaggtgggcaccgtgaccagcctgaccgccggcggcagcggcggcagctggaagctgctgaccatcgaccaggacctgatggtggcccagttcagcacccccagcctgccccccaccctgaaggtgggcttcctgcccagcgccggcaaggagcagagcgtgctgtgggtgagcctggaggaggccgagcccatccccgacatccactggggcatcagagtgctgcagcccccccccgagcaggagaacgtgcagtacgccggcctggacttcgaggccatcctgctgcagcccggcagcccccccgacaagacccaggtgcccatggtggtgatgccccacggcggcccccacagcagcttcgtgaccgcctggatgctgttccccgccatgctgtgcaagatgggcttcgccgtgctgctggtgaactacagaggcagcaccggcttcggccaggacagcatcctgagcctgcccggcaacgtgggccaccaggacgtgaaggacgtgcagttcgccgtggagcaggtgctgcaggaggagcacttcgacgccagccacgtggccctgatgggcggcagccacggcggcttcatcagctgccacctgatcggccagtaccccgagacctacagagcctgcgtggccagaaaccccgtgatcaacatcgccagcatgctgggcagcaccgacatccccgactggtgcgtggtggaggccggcttccccttcagcagcgactgcctgcccgacctgagcgtgtgggccgagatgctggacaagagccccatcagatacatcccccaggtgaagacccccctgctgctgatgctgggccaggaggacagaagagtgcccttcaagcagggcatggagtactacagagccctgaagaccagaaacgtgcccgtgagactgctgctgtaccccaagagcacccacgccctgagcgaggtggaggtggagagcgacagcttcatgaacgccgtgctgtggctgagaacccacctgggcagctag

SEQ ID NO: 90286 - DNA, 1833 bp, Artificial Sequence
  Description of Artificial Sequence: Synthetic coding sequence
gtgctgaacagactgcagagcaagtacggcagcctgtacagaagagacaacgtgatcctgagcggcacccacacccacagcggccccgccggctacttccagtacaccgtgttcgtgatcgccagcgagggcttcagcaaccagaccttccagcacatggtgaccggcatcctgaagagcatcgacatcgcccacaccaacatgaagcccggcaagatcttcatcaacaagggcaacgtggacggcgtgcagatcaacagaagcccctacagctacctgcagaacccccagagcgagagagccagatacagcagcaacaccgacaaggagatgatcgtgctgaagatggtggacctgaacggcgacgacctgggcctgatcagctggttcgccatccaccccgtgagcatgaacaacagcaaccacctggtgaacagcgacaacgtgggctacgccagctacctgctggagcaggagaagaacaagggctacctgcccggccagggccccttcgtggccgccttcagcagcagcaacctgggcgacgtgagccccaacatcctgggccccagatgcatcaacaccggcgagagctgcgacaacgccaacagcacctgccccatcggcggccccagcatgtgcatcgccaagggccccggccaggacatgttcgacagcacccagatcatcggcagagccatgtaccagagagccaaggagctgtacgccagcgccagccaggaggtgaccggccccctggccagcgcccaccagtgggtggacatgaccgacgtgaccgtgtggctgaacagcacccacgccagcaagacctgcaagcccgccctgggctacagcttcgccgccggcaccatcgacggcgtgggcggcctgaacttcacccagggcaagaccgagggcgaccccttctgggacaccatcagagaccagatcctgggcaagcccagcgaggagatcaaggagtgccacaagcccaagcccatcctgctgcacaccggcgagctgagcaagccccacccctggcaccccgacatcgtggacgtgcagatcatcaccctgggcagcctggccatcaccgccatccccggcgagttcaccaccatgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagaaccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 90287 - DNA, 1869 bp, Artificial Sequence
  Description of Artificial Sequence: Synthetic coding sequence
atggacagcgagaagagcagcgagtggagaagcgacgtgctgaacagactgcagagcaagtacggcagcctgtacagaagagacaacgtgatcctgagcggcacccacacccacagcggccccgccggctacttccagtacaccgtgttcgtgatcgccagcgagggcttcagcaaccagaccttccagcacatggtgaccggcatcctgaagagcatcgacatcgcccacaccaacatgaagcccggcaagatcttcatcaacaagggcaacgtggacggcgtgcagatcaacagaagcccctacagctacctgcagaacccccagagcgagagagccagatacagcagcaacaccgacaaggagatgatcgtgctgaagatggtggacctgaacggcgacgacctgggcctgatcagctggttcgccatccaccccgtgagcatgaacaacagcaaccacctggtgaacagcgacaacgtgggctacgccagctacctgctggagcaggagaagaacaagggctacctgcccggccagggccccttcgtggccgccttcagcagcagcaacctgggcgacgtgagccccaacatcctgggccccagatgcatcaacaccggcgagagctgcgacaacgccaacagcacctgccccatcggcggccccagcatgtgcatcgccaagggccccggccaggacatgttcgacagcacccagatcatcggcagagccatgtaccagagagccaaggagctgtacgccagcgccagccaggaggtgaccggccccctggccagcgcccaccagtgggtggacatgaccgacgtgaccgtgtggctgaacagcacccacgccagcaagacctgcaagcccgccctgggctacagcttcgccgccggcaccatcgacggcgtgggcggcctgaacttcacccagggcaagaccgagggcgaccccttctgggacaccatcagagaccagatcctgggcaagcccagcgaggagatcaaggagtgccacaagcccaagcccatcctgctgcacaccggcgagctgagcaagccccacccctggcaccccgacatcgtggacgtgcagatcatcaccctgggcagcctggccatcaccgccatccccggcgagttcaccaccatgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagaaccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 90288 - DNA, 1341 bp, Artificial Sequence
  Description of Artificial Sequence: Synthetic coding sequence
atggagatggagcaggagaagatgaccatgaacaaggagctgagccccgacgccgccgcctactgctgcagcgcctgccacggcgacgagacctggagctacaaccaccccatcagaggcagagccaagagcagaagcctgagcgccagccccgccctgggcagcaccaaggagttcagaagaaccagaagcctgcacggcccctgccccgtgaccaccttcggccccaaggcctgcgtgctgcagaacccccagaccatcatgcacatccaggaccccgccagccagagactgacctggaacaagagccccaagagcgtgctggtgatcaagaagatgagagacgccagcctgctgcagcccttcaaggagctgtgcacccacctgatggaggagaacatgatcgtgtacgtggagaagaaggtgctggaggaccccgccatcgccagcgacgagagcttcggcgccgtgaagaagaagttctgcaccttcagagaggactacgacgacatcagcaaccagatcgacttcatcatctgcctgggcggcgacggcaccctgctgtacgccagcagcctgttccagggcagcgtgccccccgtgatggccttccacctgggcagcctgggcttcctgacccccttcagcttcgagaacttccagagccaggtgacccaggtgatcgagggcaacgccgccgtggtgctgagaagcagactgaaggtgagagtggtgaaggagctgagaggcaagaagaccgccgtgcacaacggcctgggcgagaacggcagccaggccgccggcctggacatggacgtgggcaagcaggccatgcagtaccaggtgctgaacgaggtggtgatcgacagaggccccagcagctacctgagcaacgtggacgtgtacctggacggccacctgatcaccaccgtgcagggcgacggcgtgatcgtgagcacccccaccggcagcaccgcctacgccgccgccgccggcgccagcatgatccaccccaacgtgcccgccatcatgatcacccccatctgcccccacagcctgagcttcagacccatcgtggtgcccgccggcgtggagctgaagatcatgctgagccccgaggccagaaacaccgcctgggtgagcttcgacggcagaaagagacaggagatcagacacggcgacagcatcagcatcaccaccagctgctaccccctgcccagcatctgcgtgagagaccccgtgagcgactggttcgagagcctggcccagtgcctgcactggaacgtgagaaagaagcaggcccacttcgaggaggaggaggaggaggaggaggagggctag

SEQ ID NO: 90289 - DNA, 1341 bp, Artificial Sequence; identical to SEQ ID NO: 90288
  Description of Artificial Sequence: Synthetic coding sequence

SEQ ID NO: 90290 - DNA, 1245 bp, Artificial Sequence
  Description of Artificial Sequence: Synthetic coding sequence
atgggcagacccagagtgagacaggcctggcccggctgctgcggccacaccggcagactgcccgccggcagaggctacctggccagccacatgtgcgaccccgccggcgccgagctgatcggcgacggcatgagcgaccccaccccccccagcaacgcctgcaccggccacatccaggaccccgccagccagagactgacctggaacaagagccccaagagcgtgctggtgatcaagaagatgagagacgccagcctgctgcagcccttcaaggagctgtgcacccacctgatggaggagaacatgatcgtgtacgtggagaagaaggtgctggaggaccccgccatcgccagcgacgagagcttcggcgccgtgaagaagaagttctgcaccttcagagaggactacgacgacatcagcaaccagatcgacttcatcatctgcctgggcggcgacggcaccctgctgtacgccagcagcctgttccagggcagcgtgccccccgtgatggccttccacctgggcagcctgggcttcctgacccccttcagcttcgagaacttccagagccaggtgacccaggtgatcgagggcaacgccgccgtggtgctgagaagcagactgaaggtgagagtggtgaaggagctgagaggcaagaagaccgccgtgcacaacggcctgggcgagaacggcagccaggccgccggcctggacatggacgtgggcaagcaggccatgcagtaccaggtgctgaacgaggtggtgatcgacagaggccccagcagctacctgagcaacgtggacgtgtacctggacggccacctgatcaccaccgtgcagggcgacggcgtgatcgtgagcacccccaccggcagcaccgcctacgccgccgccgccggcgccagcatgatccaccccaacgtgcccgccatcatgatcacccccatctgcccccacagcctgagcttcagacccatcgtggtgcccgccggcgtggagctgaagatcatgctgagccccgaggccagaaacaccgcctgggtgagcttcgacggcagaaagagacaggagatcagacacggcgacagcatcagcatcaccaccagctgctaccccctgcccagcatctgcgtgagagaccccgtgagcgactggttcgagagcctggcccagtgcctgcactggaacgtgagaaagaagcaggcccacttcgaggaggaggaggaggaggaggaggagggctag

SEQ ID NO: 90291 - DNA, 1776 bp, Artificial Sequence
  Description of Artificial Sequence: Synthetic coding sequence
atggagatggagcaggagaagatgaccatgaacaaggagctgagccccgacgccgccgcctactgctgcagcgcctgccacggcgacgagacctggagctacaaccaccccatcagaggcagagccaagagcagaagcctgagcgccagccccgccctgggcagcaccaaggagttcagaagaaccagaagcctgcacggcccctgccccgtgaccaccttcggccccaaggcctgcgtgctgcagaacccccagaccatcatcgccacccccctgagcctggccagccagctgctgcccagccccgccgtgagccacagcggccagggcggcgtgaccggccaggtgcacgtgctgccccagcccagcgaccagggcgtgctgagcggccccagagccgccagaggccagaccgccccccaggaggaggccgtgacccaggaggaggtggaggccctggtgtgcggccacacccagagatgggtgcccggccccgtgtacgacgccgccgccggcggcagcggctgggcccagctgagcctgagagccggcatgggcgtgggccaggccaccggccacatccaggaccccgccagccagagactgacctggaacaagagccccaagagcgtgctggtgatcaagaagatgagagacgccagcctgctgcagcccttcaaggagctgtgcacccacctgatggaggccagaggcgccggcggcaagggcgcctggggcgcccacggcgtgggcggcgccagcatccacatcaccgcccccagagtgggcagcgccggcggcatgagcagactggccctgtgcttccaggagaacatgatcgtgtacgtggagaagaaggtgctggaggaccccgccatcgccagcgacgagagcttcggcgccgtgaagaagaagttctgcaccttcagagaggactacgacgacatcagcaaccagatcgacttcatcatctgcctgggcggcgacggcaccctgctgtacgccagcagcctgttccagggcagcgtgccccccgtgatggccttccacctgggcagcctgggcttcctgacccccttcagcttcgagaacttccagagccaggtgacccaggtgatcgagggcaacgccgccgtggtgctgagaagcagactgaaggtgagagtggtgaaggagctgagaggcaagaagaccgccgtgcacaacggcctgggcgagaacggcagccaggccgccggcctggacatggacgtgggcaagcaggccatgcagtaccaggtgctgaacgaggtggtgatcgacagaggccccagcagctacctgagcaacgtggacgtgtacctggacggccacctgatcaccaccgtgcagggcgacggcgtgatcgtgagcacccccaccggcagcaccgcctacgccgccgccgccggcgccagcatgatccaccccaacgtgcccgccatcatgatcacccccatctgcccccacagcctgagcttcagacccatcgtggtgcccgccggcgtggagctgaagatcatgctgagccccgaggccagaaacaccgcctgggtgagcttcgacggcagaaagagacaggagatcagacacggcgacagcatcagcatcaccaccagctgctaccccctgcccagcatctgcgtgagagaccccgtgagcgactggttcgagagcctggcccagtgcctgcactggaacgtgagaaagaagcaggcccacttcgaggaggaggaggaggaggaggaggagggctag

SEQ ID NO: 90292 - DNA, 1776 bp, Artificial Sequence; identical to SEQ ID NO: 90291
  Description of Artificial Sequence: Synthetic coding sequence

SEQ ID NO: 90293 - DNA, 621 bp, Artificial Sequence
  Description of Artificial Sequence: Synthetic coding sequence
atgggcagacccagagtgagacaggcctggcccggctgctgcggccacaccggcagactgcccgccggcagaggctacctggccagccacatgtgcgaccccgccggcgccgagctgatcggcgacggcatgagcgaccccaccccccccagcaacgcctgcaccggccacatccaggaccccgccagccagagactgacctggaacaagagccccaagagcgtgctggtgatcaagaagatgagagacgccagcctgctgcagcccttcaaggagctgtgcacccacctgatggaggagaacatgatcgtgtacgtggagaagaaggtgctggaggaccccgccatcgccagcgacgagagcttcggcgccgtgaagaagaagttctgcaccttcagagaggactacgacgacatcagcaaccagatcgacttcatcatctgcctgggcggcgacggcaccctgctgtacgccagcagcctgttccagggcagcgtgccccccgtgatggccttccacctgggcagcctgggcttcctgacccccttcagcttcgagaacttccagagccaggtgacccaggtgatcgagggcaacgccgccgtggtgctgagaagctag
